United States Patent 6,812,339 (POLYMORPHISMS IN KNOWN GENES ASSOCIATED WITH HUMAN DISEASE, METHODS OF DETECTION AND USES THEREOF) - sequence listing, part 20

SEQ ID NO: 12541 - DNA, 133157 bp, Human
attgtgtcatccttgtctctcttgacggacgggaagaggagagtgaaacctaagaccacagcggcagcgcgttaacaggaggaccagcaaggaacggaagccaggttgtcaagcctcagttggctttcacgtattctccttttcaggcgggtatttaggaagagaggagggtgaggagcacagcgcacttctgcagcagcagctgcggattggcttgtgggaggcggttctccggagcaaggcaagggcccctgccgcttctgggctgactgtggattccgccacacctcacagggctttgtaactccccacccacttgagggttccagataactttttttttttaacaaagcaggggtgggggtgggagattcctgctgttaaaaacaaacaaagggcttagacaccggctagtcggctgcgggaggcagcaagagaaaggccgaggggcctggagtagctcctgaaaaccgccgagggccctgcgggcagacgcccctgaattcttttggtggggagaaaagccgcggagctccccaatgtgccaattggtttgttgttgttttgctttttttgaatacacaaactctccgaaaactcctgtcttgccccacttttttgtgagttcattgctttggaaacaaaactctcttccatttattggcaattatcaaatttccgatccttctctatcaggagatccagcaacaaacaccctgttatgtaaatttctttcaaagataaattcgaaagcccctccattcattccttcaagaactcaacagatgtccttgaggctcattttctgccgggcactcggttcacaaggctcaagagacccctggctccagccattgtccaggttgtcactggtgtccccagctctccacttctgaggacccacttctcaccccctcctcctccgcacacgttcccgaggctctcggccggtgtgatctcaccgactagagaataaaaacagcccaggggcgccggcgccggccaagggccttgacggggatcagcaagcgcgaggccaagtgcgggccccaacttcctgggcccgggccttccgcgcgccccctctcgggctcgggtcctctccagggtgcactcgcgtccggacgacgcttacttgctgcgagtccaaccctctccggcccgcaactccaaccgagccgcccgagtgtggactccgagagcggacgccacgggccgcgctcagccctcccgcccgaggcccctctcgccgtgtttcccaggacttcctccccgcgcccgcccgacttcaggtcgggccgcgcagggtcccgcgcgctccagccaggactgccgccgcccgggtcgcccacgtgggctgctgggcgcggggtggtggccggccgggcgccctccccggagcagggggcgggcagggcgccgggaggaggtggcggggcgcgggggaggaggcggggagccccggcggcgagggggcggtgacagcacttggaaaggaggctgcacgcggatttgcatgaaacacagactgggagcgggcgggagcgggagcgcggcgcacgccccgggccggcccagccagcgagcgagcgagcgcgagccgggaggaggagggtggcggggcggtgaggccgcagaggcggagggatctgcgcatcaaagctagcgaggcgagcgaagtttggccgggggttggactttccttcccggaggcggcacccaaacagctaccccgtgcggaaacccaaacttctgctgccacttggagtctcgcggccgccgcctccgccccgcgttcggcgcttcccgaccctgcactgctgccgtccgcccgcccggccgctcttctcttcgccgtgggagccgctccgggcgcagggccgcgcgccgagccccgcaagctgcagcgcgcgcccggccggtcgccccggcaacttcgccgagagttgaggcgaagtttgggcgaccgcggcagccccggccgagctccccttctgcgccccggcgtcccgtcgagcccagacccgccggggcgctcctcgcgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtgggggcccgcccgggggggacccggggtcacgccggcccagccccctggcactgcggggccgacccagtggggctggagatgggaagagggagagagagggagggagtgagactgtgtgggtgcgtgtgtgtgagagtgggagagcgcgggcaggaagggggtggggggaccccaaacaaaaccatctctgatttgcaaagatcagagcccgaggcttccacgcggcactctggcttccacacctcacattccctttccacctccgggaggggagagcgggttgctgcgggactcggccgcccccactccggggagctggggctggaagttgaggcccgctttgttcggctccgcgggccggagcccctcctccgccgccgcctcccgcccccgcggcccgcgctcgtggaggtggtggtgtctttgcgtttcttttcttcagtcgggtctccccactttcctctacaggaatgcggtccgtacagctggggctgtgggtgaggagcgggagcctagtgattgacagattccttcttcgttctttctttgccttcgggattagcatttttatcgagtatttttagactcggttgtgccagtctcccgccccctgagcatgcacgcactttggttgcagtgcaatgctctgacttccaaatgggagagacaagtggcggaaaatagggtcttctcccacctcccacccccccatcccgactcttttgcccttcttttggtccaagagattttgaaaccgtgcagaacgagggagaggggcaggctgcagccgggcagataacaaaacacaccccaaagtgggcctcgcatcggccctcgcattcctgtagagccttccttcccaaagcgcgctgccatctgtctggatctcctttatccttcccgttgcgcgctagctaggtcgggcgggagcccacagatggctgatagaaggggtcagtgacttcactcccccagggccttccttagcttagatgtgcctggctgggaactgggggtgcgggtaccttggcttcctatctctacctctcagcctcctttgatgctgaaccaagggagagagcgtgtgtgttgggggctggctcttttgggggtcccaggctgccgaggaatgagtagaaagcaccagggactgtcagccgcaaagggattgtcatccctgctcctgggccagggtggactccatccttggccacctgcttggggcagttgtacaggggctgccaggcgagtcaggcaggcacaaagcaacatctgtccacgggaaccgagggcaggcctcccctggaaataaatgccacatatggtgggagtgcggacttaaattttttttaactgggtggatccagtcaataaagggggagggaaggcggtgtgctgtctggggaagtctctgggcgtgtgatcgggagccagaattgacttcagaggaggtggtgtgatgtgatggtcagagagacctgggatttggttccagctctggttgttaattcttctgtattccttccgtgggggtggctagggtagagtgggtgagtatgctacttctctttctggggaggggtctgccaaacctaccttctccttatctgcctgggtgcattgaagacaagtgctttatgtattgaaacagaagaaaaaaagtggtatcaattgtaaaacaggcagctgtgaaaagtgtttcacagtttacaaagcactttcacatggttttctgaggtcctcaaaaaaagacagaaagcaagcaagcaaccagccatggaaagtagataaggttgttaggcttaagattatcacatttttaaagcagaggaaaccttaaaagagagaggtgaaaaggcttgagtcatagacatggggttctgcctgaatgtgctctttctgctgccccatgctgctttatactttgaagatcctgaatacattctttgctgaatgctaaagctgtgttagcttggggagggccctgtggatctttgtatgtgcggttgcttctttaatctttgggctggtgatagcttggcagagaggccttgctttcccttgccttggtaggagtttgtcctctgtggggccatacctttggcctgccttttcctcttccaaagtcctgctgagactttggaagcctaagacgtgtgaacgctttggatgattctgagagttcaagccaacctgccctgtggccttctcgtgactttgttaggactgaggcatcttctgcctgcctggataggactgaatacaaaagtagattttttttttcatcttttttttcagttagggaaacccagttgcttgggtggatccagacaaaatggattttcatccttggattttgtgcccacgcctctgggtcaccttgtgtcccttggcaacagctgctgctgttttggtcgtgggcagaaaactaaaggccacgtcttggggaggtggctggtttggccctgtgctggtgatatcaatgtgtctgctaagccccatagattgcagtgttgcttgtcaaattgtctgctttcaccacaactgccttttagtttggaaagcagagaaaggaaaatgtttaacttagtcattccccctgtgtgtggggggttggtcactgggtgcttaaaaacactctgcaagatctggactccggggtttaaggagccctcagtctaaggagattaagccaagtgtgttttggctaatatataatcatgagcagcaacagcaacatttggcaattagagctgtatactagggacttccagaccacaggcttgcttctctgtgacaccagctctgacttgtttcaattatcaggggagctggcgtgatacacacttatcgacataaagaaggtgaaagagattggtgccaaggaagtggtaagagcttcatttagatacaccaacaaaggggctgtcaggatactctgaggtctggcaggattggcagaatttacacaagttttataacagcctctcatgcctcacctgcttgagtacctgagtaaagctgcaggtatcttccttgccagtttataagaatggaatcaaagcatttgccactgaatgagagttggtgtgtgagcgttatatgaggaataaggagctcggcacacttaaaacttagttttctggtagacactggtagcttgtacttccaccagggaatccatgccttggcctcgttgttgggagctagaccaagcttaaagcattgcttgtttggaagggaatttgggctttcttgtgtcagagcacccagtccagtggaaaattggagaattgaagcaaacactaggtctgacacacagcatctactccctccctgtgaatctgatgttttttttttggagacagagtcttgccttgttgcccaggctggagcgcagtggcatgatcttagctcactgcaacctctgcctcccggttcaagcgattcttgtgcctcagcctcccgagtagctgggattacaggcgcccgccaccacgcccagctaatttttgtatttttagtagagacggggtttcaccatgttggtcaggctggtgttgaactcctgaccttgtgatctgcccgccttggcctgccaaagtgctgggattacaggcgtgagccaccgcgcctcaccgaatctgatcttttactgtagcctcctcttattatctccttgacttttgccagggtactctcactttgagaaaggaaaaagatcctagtctttaacatgccttttccagatttctggggatagacctattactaaggctgtagaggcctcccttttctcttggctgcacttcagagcaccatgcccgtgtggcccattggaagcaagcccccttccagctgctagggaggtggtccattatctctttgctcttgttaagtttgattaggggagttccacgtagggcctgagaagaggaggtgcctgcaggacaataggtagctgatgagggatctgactcagctgcagctgaacctaggcgccacttgacgttccctgggaacatttagaaccttggaacatgctgcttgcacctgggagtggaatgtttgcagacagcccctctgttgttacagggctggattttgttgatttattgatatttattggaccctcccatgtctgagtcaattttttaggtaccagaggaggatgcagagacacgtttgagaagctcccagcctgtgagaagcttacacatcagtaagggaaacatgaatagggcattatttgagtatctaactgctatctctttctcattcccagctaccagtagaaatatgagatctagtatggatgatttttgatgggggcgggcgttgatgtgccttttaaatattgtagaattcactatgttaggaaataaaataatgacaggcatctgtttttttctgaaaaaaacacaaaattcaggtcctgtacctgccattttaccacctgcaaggatttgggaatccatttaagtttcacagcttttatatctgcacctgtcaagtcaggatgagataagttctgtggaagtgttttgtgaaccagagaatttgacaggtatgttacgtttatacttcattctgcatcattcattcattattgaattattcagtccttcgttgagaacatactacaatgaccacagcagggtccctgtactcaaagagctccctgtctagagcgggagacagacttgcccaaaggtatgaggcatgagctgcagctgaggaatgtgctaagtgcccagcaatgtggaaacacagttaattctgtgggaggaggtgtagagaggaggagaacccatgagaggtggaaaactaagaaggggacaagggttatccaaaggaagctttttggactgcagtatgatgttgggaactttttggtacatggggatagttccctataagaatgaggacgtctttatcctcttttactaaactgagtgctgctataaatatgttaccttgtaactggcactgaacagctagtgacttgggtgctatattttactccactgtaaagcattttctctttgaagtaaaaagtaagttagtactgcaaactgaaattcaggtttccttggtgggaacagggactttagatgtatcagctcagaatatgacagggagtgttaataaaaagtggacaacttggctgggcacggtggctcacacctgtaatcccaagcactttgggaggccgaggcaggcggatcacgaggtcaggagatcacaaccattctggctaacacggtgaaaccctgtctctactaaaaatacaaaaaaattagccgagcttggtggcaggcgcctgtagtcccagctactcgggaggctgaggcaagagaatggcgtgaacccaggaggcggagcttgcagtgagccgagatcgcgccactgcactccagcctgggcgacagagcgagactctgtctcaaaataaataaataaataaatgaaaagtggacaacttgcagatggttgttttgaaattcaaagcttcggtgtgacctagcttctcatttctctagttaacacttgctgagaataaatcctagacgcctgagtttctgaatgaacataggtgcttttagtggtatattttttaaaaagtctttgcaagggtgaagttttaaatgacaattttaataacagaaaaatatgaatacagtcgcatttaattctgatgagaaatgcaagaagttgatgaaattgaaagaatttgtttcaagcttatcacatcaggaatccaactaaatgagttaaaaaataaatattggtttaataatgtaaacatgtgattgctgtattattataatggaataaaattaacacgatttaatgaactgagcgaccattaatttttacttgttaatttattaggagattttaatgccatttgatgcacagtacagccattattctgcgtgagctccttaatgaaataaataagaccaagcagggcttgcttcaaattggaatcagctttcattcctgttaaccttattctcccacctttattcacctctccttcagcttcctgtaattgcaattaagttctctaagattggaatgcagttttcttaatcagcaagtctcatcaatagtcctaattgacttttgcccttttctcctttgccatattgactgattaaaacaaaagcaaaacttaaagactccattccctcccccaaatccccatctcatagtgttggttggctggcaagagaactgcccaagaaggctgctcatgatggcagcctgctgaatgtgcagggggtggaagttcaccagccatgtgcagacgtgaatggctggtgcagtgttggatgggactaactcctccctaaggaggggtatgaccttctgttggcctctgacaagtccctgagccatggagccttcagtcttcccatcttcaagcacaatggttcctggaaacagtgggaagttgccatcctaagcccaccctacagaagtttggtttctaattttactgtgttctaagctttagaaccgagacaattccaagagaacttgtccagttcatttttatgccttcctttaatgccgtaccaggtgctaatttctgtgccagataatgcggacaaaatagtgaataaggcagatactgtccctggtgccttctgtagcttctagtccactggctgtgaaacacaggttctttggagttgtaagaatgctgtatgtgttcactctttagctaatttgtaaatactgtttttttggtgccaaaccacatcccccaagctctgcagtttattgacttgacaaggatctctctctctctttctctttctctctgtataacataatcctttgtttcgacttaacagtttgagaaataaacaaatctatagcatactatccactgttggttatctaaggcccttcctataaacagcagcctgccacagtggcaactgctgtagaatgttttggcagagactcagtttaaaatgaaaacacagtagaagcctattaattaagaagtttggctaattctggactaggcaaaagtttgtttagcaggcctttttgccccataaatgctgtcaaagaaaaattaataaacaagagtttggggattattttggaggtaggagtcagcagaccttggtaggttctagacgtggctctgtttctgattagctgtgtgacctgggacaagtcaccttctttgggcctcgaatgttctcaactggaaaataggctagataaactctattggagggcctttctaacttggaattggtattcatacaagcattttattttattttattttttgagatggagtttcgctcttgttgcccaggctaaagtgcaatggcgcggtcttgcctcactgcaacctccgcttcccaggttcaagtgattgtcctgcctcagccttctgagtagctgggattacaggcatgtgccaccacacccggctaattttgtatttttatcagagaccagtttcgccatgttggccaggctggtctccaactcctggcctcaagtgatctgcccgcctcggcctcccaaagtgctgggattccaggcctgagccaccgcgcccggccacatacaaacattttaaaagctcccagttgcacgcatctagttgatcagtgaatgacagatctttcttaattattgatgttccaagactctatcagcctggtgtcaattaatttacataagtaaaaataataaaattgtaattcagcctttaattttggtgatttccctccctcttcgttgcctcttccttactctgtgagtctaaatcagtgaaatttaactacaaaggaatatgaaaataatgctaggatgaagatgtggaggctgtgcctcttgagatgcagtgaacagtttttcttcttttgttgctatttttgactattctaagaacaggaagtttacttaaactaatgaccacagatgcctaaaaatggttaaatgtaagaggtaggcattatagaggatacctgtggaaaatgtttgctcatatgtcaaagtttacccaggaagcttcctttatttatttccaagcatctatataaagaaaggctgcacttgattgcgtaagcatgagccttttgttaggcagcgtggatgttgcaagtttaaaccccaactaggaaatgaaaagtgagtttcctcctaaatagttctttttcagtatcacatggctctcccagcttacatctggcaagtttttctcttgagtgctttgccggtagtttaggactccagtattgtattgtattgtttgtttgtttctttatctctgtctctctctttttttgttttttgagacggagtcttgctgtgtcgcccaggctggagtgcagtggcgtgatctcagctcactgcaacctccgcctcccaggttcaagcagttctcctgcctcagcctcccatgtagctgggactacaggcgcccgccaccatgcccagctaatttttgtatttttagtagagatggggtaggactccagtattaagaaacactgtgtatggctttgcctttgaaacctacagagttatgaatctggtcccttttgctgctaagtgttgcatcacaaactgccaagccaagttgtaactctgaggtgtcaccattttttttttcttttcaactggacatttgaaaatagtaatgctttttgggtgtgtgttttttaaaggtctgtttttacgctgtcactgctcaaaaatgccaaaaggcattttttccttaaaaaatcacctctgggctaagcccaaatgtggagtaatgaatccagaaaggactttttgagtagttacaagtggctgaaagcaggcactggtgatggaaattgggtttttccttttgcttcaaatcttcctggttgtaaactttttcttacccttattgaagtcagactcaaggtgggtctaatttctcccagcccatgggaaggcagagtgaattactgcttgttgtgccaaccctttacattttgtgtgtggctgtttgtctctacccagacaggttcttcacatattacctggggagcaggagagggggaggacaggaagagcacagttgggcagaaagagcaaagcctctcaagtctgatgggtttgggtttgagtctgacagttattagctatgtggtgaccttgggtactttgcttcaacttattgagccccagtttctgcatctgtaaaatgaggatgaaactacctacttcatagaaatcaacccaagtggccgggcacggtggctcatgcctataatcccagcactttgggaggccaaggtggatggatcacctgaggtcaagagtttgagaccagcctgaccaatatggtgaaacctcggctctactaaaaatataaaaattagccgggcatggtagcgggcgcctgtaatttcagctactcaggaggctgagacaggagaattgcttgaacctgggagccagagcttgccgtgagccaagatcgcaccattgtactccagcctgggcaacagagtgagactctgtctcaaaaaaaaaaaaaatcaacgcaagtgagataagatgtatcaagtactttgccagtatcgatcataatacatagtagatgcttagtaaacgctcatttttcctttccaaggggaaatttggcagatgatgtccgtcgactccaataggtgatccccttcccatcccgacacacttgctcacagagcattctcctttggagagtctcagttgatataggaaaaggatctacttcaacacacacagagaacatacagacatgccacttgttgatgtaaggcttggcaggctattgaaagagaaacaattcatattcttaggcggttctgccctcccccatcaccttctctatcattattcttaaaaatttgtttggtcgactaaaaataatagtactaaaaacaaacttcgatgaatcaggtctcctggggcgggggatgggtaagatcctgaagcagaaacgcagtgactcacgcgcctgtcactgatagctgcccgtaagtgcatggaagtgcatgatgtttattgttgctggtgtttttttgaggcccaagttggaatgcacttccggctccccctcaagtactagcttactggttaggtgggctgttgagtgagaatggtcaggtccagaaactcatggctctgaaatgacccagacgtggtggctatacccttgactgccctcagatacgtgcaagagggagctcacgcttcaagagtcatgctttggccctccacctggctgtgctcctcttactggggcaaggagactgtagggccaagggacaggcccatctagagcaagcacttcctttttccagatcatgctcagaggcctgacccttccagttccctgcatcagtgtcttgagcctgtttccaagtcctgcgtgggcctcttccccaggtctgttttacttgagggcagactgtgttggccatggacagcatgtgtacctgtgggaccaatggctgggcaaggggtgcaggggcatgaaggaattggctagagcttggacttgtggcctggggactctacttgggtgtgcacaaggcctctgaaagttatgggtggtgctaggggtgggctgagatcttgggctgggtctctctgagcttccacattccattgtgaaaccaagaggtcagggaatcctaaactcaaacctggacttattaaagtattggtcaaggcaggatgatagaacgcattctgtgtaaccgtttgttaccttgatttgtctttaaatactacatatggtgtgtaggccttcctctgtatttttgctcttagggcaggcatttctgtatgtatgtatgtatgtacgtatgtatgtatgtatgtatttatttttgtagcatccgctcagttgcgtggccacaactgaatcccagtccaggtggcaccattatatgggtagcattttggagatgttcacaggaattgatttccctcaccctcaacccaggccagagtgaatttaatgcagatgagggagaaggtgctacatattatagctgctcattcaaaaagtggagcagagagctggaccactgaatgtgcctttgtttgctggaaatctttattaagtaccagagatatagagatgaagttgtgtctctgaactgctcagaggcaaaaaagggacaccagtaaccacagttatggtgggcctgtggaagagacactatagtgaaggtcaaacaaaatatttgggagcctagaggaagaacaggtctatttctggaggtatcagaaggcttcacagaggaggcaatactcaattggggccttgaaggatggataggagtgtaggagtggagtgggaggcagcacagagcacagaccagactgcggaagggcctgacgtctagggaaggcaagacagtttagggtggccagagtgtggatgagggagtggccagagaggagttggagaaggatgttgtcaagggctttggcttgccaaacttcgtactttgtgtttggaccttgctctgtaagtgtccaggagattttaaagcaggggagtggcacggtgaaagccaccactctatcgtttcttgtttcatttcctcctcttacccagtggctgttaacagcaggttttctgccggagttatccaggtcagagtcgtaatcccttacagtaccatgtggacagctttaggctatgtctggagcaggttgaagatagtgttttgttcactgtcaggagagaagacatgttgttcagccaggagggctcagggagcccaggcgttcaggtaattagccagtgagtcatgtcaggcttttgatatggataccttgggaaactaagtggggtgttgctggcctccatgcagatgcctggtctacccaagcacaggcccccaaattagatctcggcctctgctgggtcttccctgtgcctgacacagtgccttcatatggaccgtctctggtcagtgttttcaatttctttgttgatgatcatcaatcaaggccaggctttccaattccagaccacactgcaatcagtggaaactacctaaattcagtactgcagacccatagcaggatgtatgtttattgaaaacagattatattccttaatgagagactaaaacagcatgtttaaatcagtattcttcattccttttatcattgagagattggttattatttacctcgcctttagagggtcagcttggtggtggtggtggtggtttaagttgctgggtttttaaaagattgagtttcatgtccaaggactgattctacttcatgggctgtttttgaaaacattgctagaaacctcttaactgaaggcaagaccaggggcagcctattgctgcggagtgccctgggttcaaatccctgctccccaacttactgcggtggtgactgtggacatgttgtttaacttatttgagcttccttttcctcatcagtaaaatgggaaaaacaatgacctccctcaaggagggatgttattgaagttatttacttaaatcagattagatttattttagattaaaagcttcttgcaagctgtgaaatgttttgcaatgtcacatattattattttttttttttgagacggagtttcgctcttgttgcccaggctggagtgcaaaggcgtgatcttggctcacggcaacctctgcttcccggattcaggctattctcctgcctcagcctcccgagtagctgggattacaggcatgcaccaccatgcctggctaattttgtatttttagtaaagacggggtttttctatgttggtcaggctggtctcgaactcccgacctcaggtgatctgcccgcgtcagcctcccaaattgctgggattgcaggtgtaagccaccgcacctcgccccccgcatattatttctttatggtgtagaactcactaatactgctaaaaaccctttctgacagagatgggagttaaggcttctaagttcacacccagatttccacagagaccttagagacaatcataaatattgcacaaaattatattggaatatgagctcggggcacataggctctggtgccttgtactagaagcttaggtgagctgttactcttggccatgtccaagcatttgactcagaagatggtcgagtcagcagtgttgactgttagcaaatcacctaagcccactcacatggggtgatcctggtacgtgttgcatggactgagtgtcaactgcatgctgagtgtatgccagagggggtgatctccttgatcttatttacttacctacagtactctgggtacttatgtatttatgtttacagaggaggaggctgaagcattgaggggtcagtggcagaacaggaatcttaactctggtctctggttcctagttctctgagctctaccccatagcccctcaagaaaggatggccattgttgtcctcatacaaaaagctatgacactgctatcattattctcatttggtaaatgacagaaacaaggttcagattacttaggtaagttgctttaagtctcaggctaagggctggagctggatttgccactgaagctctacaccttctagaatctagggtgactacataatttatcaaacaaaccaggatgtttccaagagtgaaaaggggcagcattattaattatggccactattaattacggtccttggccataaatcaggaccgtccaggcaaacctgggtaatagtcaccctgcctctggtcttgatacctgaccaaggtaatggagaattggatccgccagctcatgtgctgttgcttaagtggaagggaatgtgcaaattatgtcctgctattctaagtgaaaggacttgcccaaggtcatgcaacaagttggcaatgtaatattttaaaactggacgagatgttgaaaacatggtaaagttagcactagagcttaattaactggagtatgagttagggaacatttggctatgctgatgtctactactgaagggaaaggaggtggaggtcaaggtcaggtgtgtatggagcaggtgggggtggcagtggcagggcattcacgtggctctactatgtcggcaccatcatcaggccctgtccctttgaagtccgggagatgccactaggcccagtgcaacttggatgatatttaatggccaagagcagagacttctgggacctgacttttcctgctctccactttactttagctctgggcttcaaagggactattggctgggagtggtgaaagtttagtggataatcctgctgaagaattttggaaggccttgaggaaggaattaaaaataacagtaagcatgccttttctttctctttgattgtggtcagtgcatggaatgtgccagggccgctgcggagcaagcacgtggccccgaataacccctccctgccaacggaattctgcagagaacatgtaagggctgtgctgtttcactcctgctttgggctctcagggtttgtttccgcgatcatccaaacctcatcctccttctcttgccccagataatttattggaagtctggagagggacttgagttctctcaactctccaaccagactgttgctgtgggcgaggccatgtcgggtgagctccaaggagagcagttggaatgacagagaggaacggtttcagcctgagaaatgtgaaatataaattcaaaccaaacttggcacctgtttggagagcttcagctgatactacagtgcccctgtcgttagcctttgtggctcagctgggtcttataaatagaacacgatgcatttccccttttgctaccccacagacacgcggaggcatgtgtgggggtggcatggacagagagtattcattacttatgctccagtgcatcagatagtcatcgtgggaactgagccctggtgtcatggggatgactaggccatcttgtgggtaaggctggaagcggcttttgagtctcctgagttacagctcttcttacccttgccagcctcccttccccagctgaggccctcagtccttcatgcctgtgtgccgcagtaagccagttggccccttccgtcgtgagtccatcccacattctgtatcggagcccagcattgctgtatcaggatgcttttggccaaaagtgacttgaaacccaacaaatagcttcaatcataagagggcttattacttccactaagaaggctagaagcaggaaagtcaggcatcagaaggtctcaggagccttacatctttcctcctggccatattctcttcaagcttgtctcctgttggtccaagggtggccacaactgttgcagatattaccgtctataaacgttgcatccaagggcagaaaagggctcctattccttgggggtctctttaggaagaaaaccttccctgggagcctcctggtatcttgttggtcagtattgtatcacatgcagtcaatgacagaaataatggaccctcagaagcctctcgaggtcaagggcccaggctattcctttgactcatcagggtgattagtatggaggtaggtgcttagtaaattttatttgggttagtgcaaaagtaatggcagtttttgccattgaaaataatggcaaaaactgccattacttaggcaccaacttactaattaatgtttgttggttgctggtttccttcgctaagtgagactcctgaacacttactgatgatgtcttgctgacttctgaggacatgatggtaagtctgccctcatggagcttgcagtcgaggtggagagatagtgctataattgtgtttggagtatctcctgagtagattgtggcagtctggtagctttggaagaggtgttaaattgaggcccaaggagacaaaaggacctgagaaacagagcagggggactctctgggcctctgaatgccatgcccagggccacacattttgtgatgcaagccaggttgtttcaggtttcaagcagttgcgatttctgtctccacccctccaccagtcttattttcctgttgacaaaatgataacaacttgccctagggtttgaagtgggggcagggcacagcgctgagagcctcctccctcaggggaaattttctaaagtttctcactgtgttctagcttcaaaaccatatgcagtttaattgcatgtttagtatctttgtgcatctctcttgttttgaatctgctggaaactttctctgaaagcatatatataggaagacataaaaattctataaatgtttagtggttaaaaacaaagtcctgtccaaattatataaagttttgccgtcgtcggacagaactttctgcagatagggaatacccttgagtcttcagtcgcaaagagctaatcactaacttcaagtgtgcaagtgccctttcattccaattcagagaaaacagagcctgtcccaaggcctcgtgttttgttttcctattgatctaggagctgggataacttggaaccccagggaacatctcagagttaattagttttttgaggtcttcttgtttttcttgcttgattaaaagagttacagtttttgctctgattgtttaaaaaaagaatctatcactgctactgatccaagaggtgagggttggcatggggtgggcactccagtaaatacgtaagttgtcttcctgccgtcttgtcctggtggagcagagagaggtgcctttgagcatgggcctggaaccaacagctactttcctggaaaattcttcagtttccagaagcagtggccaggtgagccggggcatgaaaccagacgaagttgccgcagtgcgaggctggttctgtttgcctcagttctgaagttaatggtccaaggtcaccactcatagagcgtcagcctgttggggagacggaggccctgacggccatgccagggtgcccccaaccctttgtttaaccacggctgtggaccagtggtctcagatgtttaccatcgcctgtttataagagggaagtgtggtcatatttctatctctcttgtgggctgcacggttgccttactggggttcatgtgggaagtggttaccgttaggaggaggatgaaataacagtactcacaaaaaggctttgatccagggatctttttaaatgtcatcttttggccactgtgtttttttatttttattttttgctatctgctttaacttcaacgatgagaaaatcaaaccatatgctggacatcattctgcccagctgggctgagtcagaattgcagttcaaactacttctgctctccctgggtttcgtgtgctttcaatgtggggatatctttcagatctgcagttctccagagctagggacccctcagctccagctgctctctggacaatacctgaacatccctacaatatctgaaattgaatgtttgccatttcttcttctttctcctcacacaacctactctgatgttcatgattactggagcccccaggttctaaaaagtgttgaattagcaagtgaacaaataaaatgagacccaaagaaactgtgatcttagcatcctgttttctgggtgaggttgagggtccttggcctctcttgctggtggagatgggctttatgactttggggaagtcaacttgacttcctgggtgttggtcttctcttctacaaaatgacaagcttgaagggagaatctgaaagaatctgtgtatccgttctcagattttctttttttttctttttttttttttttttttttttgagatggagtctcgctctgtcgcccaggctggagtgcagtgatgcgatctcggctcactgcaagctctgcctccggggttcatgctattctcctgcctcagcctcccgagtagctggcactacaggcgtctgccaccacgcctggctaattttttttttttgtatttttagtagagacggggtttctttgtgttagccaggatggtctccatctcctgacctcgtgatctgcctgcctcggcctcccaaagtgctgggattacaggcatgagccaccgtgcctggccagtctcagattttcatgatagccctctgaactctccttggcttcttgcctttggctgttttctcaatgcatatattttcctgggggacaaatctaagttttcatctgatgctctgccttcagaggggaaccattccttaatgacctatttaattgtattatcattgttgtttaattcatcacatatttactgagcttcttttgttggtggtggtgccatcagacacagtggtccaggagctgcaatgcgttgctgatgaggatggtcacacatagctctgccctcatggagcgtcccagggtgaaatgagacctcccctgagaaccgactcccagggtaggggaaatcagtctgcaggcaaagaggaattcaaatttagcctgaagcacaggttttctgtgcttctaggcaccggctgcattccaaccgtagtgccataaaaatacaggaaggaagggaaacgtgttcacaggttggttagagatgtggaaaccaacaatcagctctctcttatccgtaagaaactagaatctactgctggcttcagtccctcagacctgctgctcaacagagtgccctttcaaacctgggttagactctgtgctaatggcttttttcatgaacctcagacagccggaaagtatattctttgaggattatgatcgactaggatgctcgggaatctttaaagagaagcactatcttggctatatttgccctcagttgttttaaggccagtgaggagactgagcatttcagaggtgaagcatttagaggatggcctctgaaagcatacggctcagtaaacaactgacccatcctttgtcaccgtttttgtccagcggctgtcaccataggggctcctctggtgtggaggagagagaattagaggcagcaggcctgggttctaggtctgcctcattgtgaaccagcttcaggaccttgggtgagtcacttttctgccctggcccctggcttcctcttctataaactgaaggtgttggcttagcaggattttaaagtttcttccaccttaaaaactctgattcctgcacttgcattcaaagaaatgactctattactcatttgaatagtttcagaatcactgtatagtcaactctggactagaaatgggggcctgcagttgaggacaggatggaaagaggtttggggttcagggtgggctgtgagggctaggattcttgattcctcatgatttgcaattggttgttggtgttaccatggaaggttctcaaccatggctgcttttaaaaattttgatgctcagaccacccctggagaccagtgaatttcgaatttctacaggccggcctggggaaatccatgttttttaactttcctaggtgattccggtatgtggccgggattgagaatcacagccatagatgcttatgtaaagctgtgttcagtgttacaggcatctgttctgggtggaaagtgatagtggttggtcaaaaaaaaagtgtgcgcacacacacacacacacacacagagaacagctctaggttctggaagtgtgttgatttggtcaccacaagtgctggtggtgagtagttgccctgaggtttggagttccagttccctcctatctctgggtcagtggtttctcaacatctttgaagtagtgaaaccatctgtagttggttatttctggtcagaaactcacagtacaaagtggggggtggtgcaggggggtggagctggaatggattaaacaggcccttacaaatgcccacacttttttcatgaaactaagttagaggccttagccaactccagcataccttagtgtcagttctttggcattgccccggtggattctaggggctgtgaaggctataggggtgtgtgttactccctgctgctttggtgagagagtgtccctgtctttggctgagagcatcctgtcctgccacttcatcagcagtagcatctaaacagcccttgaagggaatcagtatctacagcctaagaaatctgatgggacacatctctctgcattaaaatattaacagaaaaggtcaaactgggaaggggcagctaagttggaatatctcattcaggtaaagggatgggcttgtggatccttaattggtgtgaaatgcgccctaggaggggagactatatcagtgctgaaagcccttgagggctttcacagatgaagggggatggtatgagaagctttacaaataacaaggtttgagatgcagttgtagacacatgccagatgtaggttgctattttctcagctcaatgaggaatctgtcaaggcactcttagaaatggaaaatatagttcctgccctcaggaactatagtgtcacgtgatagcagtgaagaccttctatgtcctggccacacagtgaggatcagaagacagagcatggagagtggaatgggacacatggatcaaggaacgtggacctgagcaagcaaaagcaagtcactcgggtcccactatcacattgcatatcttctccttttttttttttttttctgagacggagtttcgctcttgttgcccaggctggagttcagtggtgcgatctcagctcactacaacctccacctcccaggttcaagcgattctcgtgcctcagactcccaagtagctggtattacaggcgcctgccaccacacctggctaatttttagtagagatggggtttcactatgttggccagattggtcttgaactcctgacttcaggtgatctgcccacctcagcctcccagagtgctggggttacaggcatgagccacagcaccagcctcttctcctttctaacgtgatgtcagtgtctctgggaagcagccttagttggcacctcactggcagcaagaatgacttcatgttcttgctcccatgaaaattctctgctttcaggaatatactttcctctaggttttttctttgtctgcaagtgggggggtgttctttgccagatccctgctttgatgattaccatctgcccacctgagtttcctgcatagtttcagttggaaactcttttctctttggaccctaagataccgtgtaataggattgttcttggtttcagtaggcacctggcaccctctcagctgtggctgcatttcaggtatggatgggagtgattatctgtgcatcagaaaactcaagattgtcatgtgagcaagttgtgtgatcatcagtaaatgcagagctggctttgttaggccctggttgtggccaaggctttcctttcctggcgggtgattattccagatttcatggtcactagctgagtgtaatcaggagcagataagaaagccctgtatagagcaaagtatgcatttcttaaggtggtgggggaggtggcagaggcattatatagacgtgtgtgtttgtgcatgtgtttaaaaaaagacttatgttttctgggcagcagaacttaagtttccagtaaacatctcctccctttttactttaccttttaattttgtgtttatggtctctgtgctttgaaattgtttttgctgtgatgccagccctgcctgaaatgggtggagcaagccaagccctttggaagccatggtttagatcagagttcttgtactgacatggcccagctgattgacagctcagatgtgatcactccgtctcaactagaagaataaaaataaaaaccttgagctggagcggagaggggtcacacatttgttagtttatcccctactctcacctttatcgcaggaggagtgataaagtgctgctgtgtgtaattctggtctggggttggttttctgtagtcccaaacctgggactaattctccctggagcccgtggcccagaagatgggtgcacagtagggttacttgatgctaaacggctttcctgatagacttgggatctcactgttcttgtcttagctttacttgttgggttggaggaggtgaggtgggtgggcaggggcctagggaagcccactatagaaacactgggacagagaatccagcccaggctaggtgagagcatctgccagtgtgaaaacacgtggaagcgggggaggcaggcgagaaaagctgtgggagaaaacctcacaaatgcagcaaagctgcccagggcccaagcggtggggcggtagcgagggaaacacagtggtgtttggctgctgcttcacaccacttttaattcagcgctgctaggaaggctatttcagaatgctcccgagtgggagggggcagctgctctagggtgggaaggggatgctaaggccgggtgcggtggctcacgcctgtaatcccagcactttgggagccaaggtgggcgaatcacgaggtcaggagttcgagaccagcccgaccaatatggtgaaaccctgcctctactaaaaatacaaaaatgagccaggtgtggtggcgggtgcctgtagtcccagctactcaggaggctgaggcaggagaatcacttgaacccaggaggcagaggttgcagtgagctgagatcacgccactgcacttgagcctgggcaacagagccagactctgtcttaaaaaaaagggggtgctggagagcatgtggggtggatagggctgactagagacctttgtcagggtgacctttctccagagagcccagtaggctcagaaggaaggtccctcagcaccctggcccacacagttccagggagaccccaaataaagcatttgcacaaacagtcctgagtggagcacacctagccgccttctcttgcaaagtgggcctttaaaaaaggggtgtatggctgcttagttctgaagaggccaggctaggagaccccagagggacacccagaaatcccagatgtacctcctccatctgctctgcctgccagatgacccttgctactttactgttttttctttgagcctcttggtgatcttgaatagcagaaaaatgagccaaatttccttcaatctatgccagtcttcgtcctcagcctcccggtggggtgatgaatcacaccagtgggaaagtgcactgtatacttggtcatgtgcagagcaccttcccattggtttatctttacaactgccctgggtggagacacggcaaggtggtcctatccctattttgcaggtgatcaggcacaacttacagttagcgcaggaacagggactgaggccagccctcagttctttgacagagttctttgtctacactgtgttgcctcagaaaaaaatgcccatggggagtgtgtgtgcgtgggcatgtgtgctctcctcgtgtccctcagaaaagaatgaattcttttccaactgatgtcactgggaaagggggacaccactactttcctgcatactgcactttacagtttacaaagcactttcccacacgtcatttcgtttcatctccctgacagtccctggaagtgggtgctagtctggatgagcaggcgcagacttggagaggctgagggacttggcccagggcatatagctaggaagcggccaggcagtaagtgggtagcaccactgcatgttgggggtggggaagcatgagctggatggagcattcggtggtctaaccagtggccagcagtagtgttggggtttgctgccctcacctctgaagccacacaggctcctgcttcctgaggtcaccctctcctggagggctgcccccgcatgggagtgtggacaagtgtgcacgagggggaggcacacccaggccgagtggaacaccaccctaagggggtggtgacaggtggcactgggagtggctggagtcggggttcaccttactcagggtcagggcttcccattttgcaggactgagaggtggactctgaaggaatgcagtgcttagaatcttggtgcctctcctggggtggtgggaagagcagggagtctcgagtccgattttgccaaaaatcccaactttcctgctgagtagctcatgagacaggcatttcacctctctgaacttcaacttgggggtactcagatttccttcagaggctgtgaaagagtcccctgccacaagttactcctctgttcagaagtgacttgactgatcatctagcccaaccccatcattgacagctgggggaaactgagctcctgagcggggcagtgacttgcgcaagtcatttgttgggaagaatggggcaggatgatgatgatgtccacttcttggggacgatggggcagggtggtaaacacttctcaatgcttgcttatgggctctgatgtgaaccactcactataggctgaatcctggttttccaagtgtttagaggctgagctgttgtcccctgggattttggaaggtagactcacatttcactgaaagccctagatgcttctccttactgcagttcccctccccagcactcccatctccctgttttctggggatttaaatcagctttgacttgggtctgaaagtaacccgtgacagcagtaagcctctcgatctgttgtttgcagtgtttcagctaaaatattataaacagaccaccaaactgtgtttggtccaaggccaagcccctccctccctacttgaacacttgattacctgctgcagggttgcgtcttgagctccgaggaggaaactgtttatttcagggctgttagagtgcagtgcaggaatccaggagaatttattgtattgttaccatctggtttcatggagtctgtttcttttgattttaattgtgccctctggagagaaagatcctcgaaatggtggaaaaagaagataccaccttcctccctgccctgcccatgccctggcacacacattgctatggtgcatggtgggcatggctgaaccaagtccccttattctttgaacatctttgcgtattattcctgctcccccagccgtctccaggccccagtctcctctggagggatttcccagatggcttccaggccagagcctgacaggagagataggacctgcctccacggtaacaaatggctgaaggcggtttggggtgttgccagtagcctgcccttccgcagtggctaaggatccggtgttgcggtgatacatgatgtgacctcttcaaccagtgagtcactcacccccagataaccacccggtactttcaggggaaaccgttgtatcattgtggctgtggccatggtttctccaaaataaggtgtttttagaaatgaaagtacagggattggtttccttagattcattgtcatggattcatagttccccaacctttttcacgtaaagactcacctctgtttcctcttaaattgtacatttggtgtctgttttatatattaataataactgacactcttctaaagttttttggggaaagaaaacataagtttaccaagctctcaattctagaaggtaatagccttctagaattgtccatttgcataagcatttttatgcttattgctgtaatcagtgtgtcagtcaaatgggaaggaggaactacatcaggtatttagcacaaagggaatttaatacgggaccttggttacacaggtgataaagcagctgagaagccacaatgggaaggtgaggtgatccagaacttggaggaagccgctgcctttaggctggagggacaaagggaacaggtggtgttcccagagcccagggttggggtcaccagtgggcctgtctagagcagttgcagctgcttctaaaattgccgacccaaggtagaaaaggagagaggggagaaacactgtggcctctccctccctcctacccactgcttgctgtgagagcctcctattatttaaaccctgctggaggcctcctgatctggagcctggaaagtcagggctcagccccagggaggacacagcagagcacaggaagatgagggatggatcagagggcaaactggacttggaccagcacagggtgcaagcctgatgctctaattttatattttatcagcattttcttatatgtggctttcataattacacatattttatcaagtagatgaaccgcatttaaccattccccagctgttaggtgaacactttaaattactataaatcagcagttctcaaagtgtggccctgggccagcagcgtcagcatcaccagggaacttactaggaatgcagagtctcaggccccgcccccaggcctcttggatcagaaaccctgagggcggtcccagcagtctgaattttgtacactctccgagggctgctgatgtgcatttgagcttgacaatcatgattataggcaatgatgcaccgtgtggaagctgggggcaggatactgaggagggtgctgggggtaggagtggtggagggagtttgtccaggggaatgtggtgtagcggaaaaggcacaggactggtagggctgtgcccctttaggcccaagcctgcccttgctcttaacctcttaatgggtttcttctttcttctgttaaacagctaaaaatatcaaatcatggggttgctgtgacggttaaatgtaataacaggcacgatgttccatatatgttgggtcttctggagctttggggaaggaggtgtggcaataacagccagcttctgcatcatggaaaatggcccccatgcccatccctgagttgtgtggtctgaaaatcaatgatgaacacttaggaggctcgtagcctgctttgagtcaacaggaagactggacttgagagtttggaatctatagtctaacttcccttcctcaccctgtctttgtaaatggtgctcatctaaccctacagttactatcttttcactcatgtctagccacttgttagaggggaaggaaccctggtgtcaggacaggactcctggctccctgagcttgctgtgtattccggggcatatccttaacctctctgagatgtacttttcttatctgtaaaacctctatgttgatgcaaatcaggtgcgatgatggacgcaaaaactgccttgaacaccttagcgggcctgtgaatataaagccttcaggatccacacctctgccagggccgacaccagcctcgccacctcggtgagcctctcattccactgccagtgcaggggtgcataatcaggatttgccagtggaggtaggaagggtggctggattgtgactgtcacgctcctggcatcagatgatactggtagcaagctagggtcgtctgtgcactttgctctctctcagtcttcccagcagccctgtcaagcggggagtctagcaagaagtggccaaggcgcagatcatttaagaggaaggatgtgagcaaactggatcccaaggggacagacggaggcccactttgcctcagagtccagagagctgctgctgctaagaagggaaagaggaactgggtcggggtgcctgctgacttgcagcgctgtgttggcatgcgaggtagcactggttgggaggcggttacctgaaggaagcaaaggcagctggtggttcctatcttcttgcctctggcagcacctaaaagaagcctcttgggccaatgagaggatggactgtcccccacctgcagagttctgtgaagtggtgcggacgtctttgttgatctcatttggtgcctccccctgttgatggctgaggaagccaaggctctgagaaggcacatggtttacccgaggggacacaggcaaggaatctgaacccggattgcattttctgttttagggctctttgtgtgaccacggtgcttcccaggcccacacttccagtgttccaggcccttgaccaccaatcctgtggaggggtcctcagggcaggcagtgggaccacctgaggcctgcgtggggtggcctgtggtgtgagggacccaggaagtcagcctgcacctcggcgagtcagaagatgtggccatccaccaaccatcagatgttcccctacgcttagggctgtgaccagaagtggcatcaagatgggaggcgaagcttctgggaccagagaaccagctgctcctgttcatcctgcttttgggtgaatagctgatgctctgggcccctcatcccaccatcccaccccgtggctcctcctgagcagggctgagggcatttacctggctgccttctaaagcagacttggcacgagacaatcttattcaaactctgctcaaaattgctaccctgaggagagggctgtgaccaggcaggacggggtgtgataacatggaacccagggcctgctggagcaggccctgatgagtgtaaataactgtgttagaggcaggacctgagcttttcactccataaatatatattacttctaatgtggccagggccgagctgaagatcataattatgtgagatctgctttacaggcatttagggaaatgcgtggggctgcactgatgtaggcaaagatgtggccacatacatttaacgtgtctcagaggagcctttgctttaaccctttaatcagacccttccagggtgctcctgacttgatgttccagagcgtttggagtcagagttgcactcttttttcttgcattaaatgcacttgagttttaacccagtctctgggcggatggcagggctgcatgagggggtctccgtggatgtggataagtccagagaagtcagctgagctgactgggcaggtcttgggtaagtcacgccacttctctgagcctcagtttctccagcagtaaaatgttacctgtctgttagggttgtaagattgagtcaacatatgtacaaggcattgcttagtgtttaccaccttgctgtgagctggtaaatggttggttggtcccttcctctccccttggtgttaagcatatcaaaagatggctgcgtgctcacctcccctgctttactgggtggacaaaggagctgtcacacagtgtggcagccttagaaaggttaaagaaggccagtgaagtcttctggctcatctggtcctgaggtgggtgagcattaaacccagatcctttttgtgtttcagtattggatcctttggccgtcatatctgagacccagggcctcagagtgtggggtcctaacctaatttggctttgggtgaactggccagcaaatggaaggatggctgtggaagtgtgtcttgagcctgtccttacacaggtgtggctgtcatcaaggccatcttcatgggcacgtgacgagtacagtcacatagagttcatgctcaggagggccctatgcttggtttaatgctctgctgtcaccagcttgaaatccttttttttttgttattgttgcccaagctggagtgcaatggctcaatatcggctctctgtaacctctgcctgcgggttcaagtgattctcctgcttcagcctcccgagtagctgggattacaggcacccgccaccacacccagctaatttttgtatttcttttagtagacgtggggtttcaccatgttggcgaggctggtctcgaactcctgacctcaggtgatccagccttgggctcccaaagtgctgggattacaggtgtaaaccactgcatccggcccatcttgaaattcttaataattttctctttgacctagtgttttggagcatgagcatggatagaggagatgtgggcagcatgtgcccattgagccttctgccccattcacatgtagcatttgagcacagacttctgccggacctacaatgtgggggagttgagtgagagtcaaagtgagtgtgagatgtcacatctgcgactgagtagcaggggccctgacagtcctgatgctttccatctaactggaacttgtcttggttgtagaaagaaggcgatgacattctaagaaacatcaacgaccaaagaaccccatcatatcctttattactcacgtcacttccctgacaccaaccacttatattgaaaatgatgacggaagaaggaaaaggaaagatagggcacccatattgccttttcctttcagatcttccttactcctcaggcagcataaagagtgaggtagaatggacacatagcgagaagtgaagtaaaaacgattgagttagctttatggatgtttctctggttctggtacatcacaaaatgcacatccaagtcctaaaatacaattcatgtaatgttggtgattccacatactagttaaaggctttttatatttgcagttaaaactggcatcacacaatataaataggagtggtaaaattcatgctaattcatgtaatttaaaattttaatgttgctttacttagaataatattaaatagcaaattaaaaataccatgacacatcaagagagagactgtggaggaaagagaaaaagctttctattttagtaccatgattgatactttttttttttttgccttttgcacaaagggttccatattttcattttgcactgggccccacaaattatgcagccaaccctgactggcatcctggggctggaggtctcaggctggtcttgcacgtgcagcctctagatccctggtctgctcacattgtctcctgggttgcggagctaagaagcatcatataggcaagtgagcatgtgtgcttgctctgaagattccaagcttccaggtggtggtggctctgttgatagagataaaaagttgaggaatttcagaggctacaaacatactcttgttgaaggtgctttgggggtctcctgagcatttacttttgtgaatttttgggcagcctagtatagaggtgatccagcagtaagctgagagagaggccctagtttgactcttaactcaggcatggtctccttggatgagtcatttcttcatcaggcagtcctcagtcttttggttgcagtgtagttgttaaaaatgtgggtacttggaggctgaattcttgggtcaaatcttatctccatctctctgtcctttttttgtggttttttttgtttgtttgttttttgtttttgtaggggacaggttcttcctccaccactcaggctggaaggcagtggtatgatattggcacactgcagccttgacctcccagctcaagcgatcttcccacctcagcctcctgagtagcttgggactacaggcacacatctctatgctgggctaattttcatgttttttttgttgttgttttttgttgttgttttttgtagaaacagagtttcactatgttgccccaggctagtctcaaacttgtgagctcaggctatctgcctgcctcagcctcccaaagtgccgggattacaggtgtgagccactgcgcccggccttatctccatctcttaactagttgtttgatgttgggcaggttgttcaagcctcctggagccttggtttacccatctataaaatgggtataatggtaattatcttatagcatggtcatgagcgtgaaatgagagcagggggaggagtaatcattgtgtctggtccatgggactgaatcaatgctagcaatggtcatgatggtgaagaatgaggggaggaggaagaaacaattcctgtgggtgctaggaccaaaagtagtatcctctaggaatcctggccttcaaggtctaacttccaagattctgtgagtacgattctagggagcctctgcctcagacttctaagtagttcttcaggctgtgctctagaagttactggaatgaaagaaaaattgtagtgtttgaaggtcttcaaggatcctggtcctctcacactgtcactcttagtcacatgacctttgactgtccattccctactaagccttggtttacgcatctgtcaaatggagcattcgtgggtgtgcctgccttagaggatgagacccagctgagatgacatatggagaaatcgtttataaacttaagtactggtgttaggaagagctaacacggtgagtcttcagtgtttctttaagtgctgctcactactgtcctgagagactccaagaagcagttactttgtttgggcctcagttcatcatctgtgagatgagaggattgggctttgtgcctaaactgcccccccaccccaccacccaagacagattaaaaaagaaggaaggagggagggagggagggagggagggagagagagcgagcgagcaagcaagcaagcaagccagccagcaggatttggaatcgtcccctaattggaaccacaatcgcaggtttcagggactcaggaaagggtgcagcccagcttgtggttgagaaatgaatgtcagatgttaggaagaaaaaggcctatctcaacatagcaggggtttcttactgcccctgcctcctcagccccggtagcctgtcactccctggcgaacagcttggcagcacagaggcaaaccacagagtacatttgaggcccagatctgcttatttcgagggtggggccgcgtttttctcctgccacagtgagctaattaaagaaaacaagcttcgggagttgggagagaactgtccacaggacacttggggaggcttgctttggttgtggaggcctccacagcccccggaaggcaggtggaagtgggcatggagggtcctacgcatccccagcgggggtctgagggcccactgttgctcagctgggggatttggggacggtgggagggcatacatggatgggagggtggactccgttcctgagggggccagtgtggaggagggtcaggcagcccatggagatgggacagtgttctgaaatgcttcacaaatgtggacttttgccccaaactgtggacagagcgtatgtcctgagcgaggatcaactctgtgagtacccatgataattctcctttctgtggtgccgccctgttgattcatgtgtcagccttagagaaagtggctgtgacttctgcattcctgggaatacactgacatgagaagaagtagccgctcttgttcaaagtcacagggctggaaagtgggataaggactaaggacttctgtctctggattcagcatgctgattatggggaaaagcagacatcaattcctcatgtcttgtaagcatcactgtcctccaaagttggagcccagctcagacagctgcatagtattttatagagaaggtgtgttgttgaaatgttgattgtgcaaattgaattgtgttttaagactactgggaaaaccatttaaaggaatcctattgtaagtcattttgaaaaatggagaattacaccacctccccaaggattttctgttttggtaaatttcatgtggcaagattacttgaagaagggttccagtgttttgctagcttataatggttactgcataaggaaggtttactcgccagaggtccgcacacattggagaactgggggaatatgtaatacttgtgcagaaatgttttgattcatgtactcagaagatgggatctggatgacacctccagcctattgattcccaagtaaggtgtgatgacaccaccaccagcgaggtgtgctatgaggaatttttgttgatgatgaaaagtgaatgctaactgattgcacaccacgtgccccataccttacatagattatcttatttaattgttgctaataatagtactacagtctgtgaatgatttacttagcaattaattcaaaagcatattccactctacaatggaatattttttgagccaagaaatgaagtacgtggccgggcgcagtggcttgcgcctgtaatcccagcactttgggagaccaaggtgggtgggtcatttgaggtcaggagttcaagaccatcctgaccaacatggtgaaaccccatctctactaaaaatacaaaattagccgggcatggtgccacatgcctgtaatcccagctacttgggaggctgaggcaggagaattgcttgaacccaggaggcagaggttgcagtgagccgagatcgcacccttgcactccagcctgggcaacaagagcgaaactccatctaaaaaaaaaaaaaaaaaaaaggaatgaagtatgtgccacaacatgggtgaatcttgaaaacattgtgctgagttgaagaattcagacatcaaaagccacatatcacatgattgcattcccatgcagtatccccataggcaaattcacagagacagaaagcagattagtagttgccagggatggaggagaggggaatggggagtgactgcttcatggatacagggtttccttgaggggtgttctggaacaaaatagttgtggtggttgtacaatattgtgaatgaactcaatgccaccaaattatacacattaaaatggctaacatggtagatttttgctgcatgtattaatatattaatgtattaataaatgtattaattacaatattaatatattgtgatatactgtgatatattgtgataaatatatcaatatattgtgataaacatataaattgattttaatatatattaaaatcaaatgtattcctctaatggtgtccatgtcactgacttagtttctgatatgtttgtattgggtaggaaagaaaggaatgggacatttacgtgtacactgaggcagaagaaagaatgggactttccaatccaggctctacctttatgaggaaccagagacccagagagtgctagtgacttgctcaagggcacagagcagcgtaccagagttgagctttggcttctagcctcctcactttctattggggaagtcacagtggaaaagggggttttggctcctttatgtctttgggtatgttctgggtcactgaggatcagctctattccacctggcattttgtgctttccttgggtgctcaggaaactgtctgtctcaccctgaggtgaggctcaggaggctctggggctttgtagtagaaatagaaatatcccaagtcctgggttgtgtccttgtggatgtgtctagaacaattcctgttgtgctactcgctttgggcagttagcgaaagggactaattgtgtgcaaatacatacgtttggtgtttgttgggagacttgccatgtgacactgcttcttcttttcttctctttttgactatgaacacctgacactacaggaaataagaaactttccagtacctaatttatgcttactctactttcaaaccctgttggccccagcacagggtaaatgaaactgtagcttatagtaatatttacgtatgggagtcaatgagctgtttaaatacttggatgtcagaaaaaggtttcaaatttagcaagccccctgactctcccaccctctggcatgtactgggtaggcctgcctgctctctgaggtcgagctcttgtatcctgtcctggtcggtgccagtatagcaatgatgatgacagtgatgatgatgccactggaacaggctgagctgtaattgaattaaatatctgtgtaatccctaggagaagctgaataaggtttgaggatcttggaagttcagttatactctcagtaactgaggtgagatccgtaggcaaggaatgacaagatcgagattgattagctacatgaccttaggaaagtgacctaaaggttgttcacattcagagtcctcatctttgaatgtgaacgatatttctggcctctcctatcttatggagttggtgtaagcatctgcatgagatgatggacgttaaagtgctttgttagctgttgagactcttactgaaatgaaacccaaggatgggtgccactgaaagaaacaagaatgaatgcaaactggtttgtgttgggagttgtacttggcacagctgaatttgcctttgtctttaggagagccttagctgtgggaagcagggcttggaatgcgctgatatttatttcttccatcaaattggattatgaggcacctgatctgtttaaggctgtgtgagtagaaccaggtcctgccttccagaagttcatggttaaattgtgttttcatgggtcacctggaaggcgagcttgttgagaatgaggataattgacccagtgaatccttcctgcctcgaggcccaccatgttattcagatcagtcttgggggaaatgctgtgaaagtgtgtgtgtgtgtgtgtgtgtgtgtgtgcggtgtgtgtgtgcatgctcgcgtgcatgagtttgtgttgagagaaagaaaaaagccaggagagtaggatgagtcagatttaaccactgttttttcccttttgaaacttgttatgttcatacacatacagcagtcatgcacttgctcagaaatgtgtgaaaaccacttaaaatgtgtgaaatgcagccctttagaaagtgtgccttccaccacattcttttgagcagtggagtggatttgtgagtgttcatatctgtcctcatctgtgggaattgtatgtccaaggtgctaattcagggccatactgggatgacgtgtgtgtatagacttgtcctgggtgagatgggagcaagaccgtccaatgtatgatggggaattctgttaaacaggtagaattctgaacctcttggtggtcctggctggtcagttgcagggagtgacgttgaatggactgggaagatctggatataccatgtttctgtaggcatgatacgtggtcccttagcttggtatttaaagttctttggaagtgaccgctttctggatttacctctgtgcagcccctctgctcctcccaggtgaggctcatcatagctcctcttcaatgtgctttgtccacaactgctgccatgttttagctccccattacgtttcctgggatgctctcctagactcctctgtacctttcttctttcaaacccaaaacaggtcccatctccttagtcttaactgtctatgaatggtctgttgcctcacttcccagctctggtatgtagtacgtgctcagtacacatttttgaatgcattaatttggctcttttctgtgaaggcagcttgtctgtgtgtcattcatctgcccaaatttgattgtcaacttccttcgtatggagctgtactgctctttttgttgtttttcttaactccttgcccctgcctcccatcaccccagtggaagagttatagtcaaggtagtgtagtcaaggtcgtgcaaaagctacacacttgaacctgttccgtgtggtttcacacaaggcacatggcctccttgggactcacttcacatcactcgacaaggggatagcaggacccaccttgactgtattgaagactgcatgatgatcaggagagagtgagggatgagaaagagtttggaaaacagcagaacacgatgcaaacatgagttattcatggttttgtgtccaggctaactgtgccctgacattaaggctgggtgggtctggcccagggcttctggggtaggcgctgtgctggtgtgtgctactgacctggagtccaggatccctgagtcccactcaccctccctgggctgcagtttcctcagcccagctaccctttccagctgtgactgctggttgtggagctgaatgtgtgtggggtgtgggcctgtgtgtggactccccacccctgtgcggttttcctaagcacacagcacaacaaggagctggaacagagctgcaacaatgaggagggtttcctccaactgtcagtgcttctggatccaccgtttcggctttgacattaccgtgagtgaccaccctggacctctttctttgtgccaaactcgttgctggattgccataaacacttacttggattgattagagaggctatttgccgtattgaaggtggcagaattatttcaccttttccagaggtgttgacgttcaagggtagttggtggtgactgtacagaagggagacaggaagcctggaggaaggaaaggggtgcgtagccgagaaagtgcacaacgggccctatttttaaaagtgcctgcctctgctggttttgttgtggcagcgctcaaaggcaggaagacagataagatcggatttcaggattttcgtctgccccccatctccgcccccaacttttgacaaccaagaacttttccccaccaggagtgggtatatttcaacttctgtaatccctgcgtctcgcacaatgcttggtattacaaggtgctcactgagtgtttgaatgaatgaatgccttcccagttctcatcacagctatagggtgtcactgtatacatcaagtcatggttagccgcaggtttgattggggaagagacactaatcaatgtatctgattctagaagaagatggagcttctaggaagggcctgccctcaggctgtcctctgtgttccccggcattctgcattttgcagtcacccctcattatccctgagtccaggaacacctgagattggaaaggattccagccccatagggcctttatcgtggcccccagtaagtgataaatattcgtactaatttggggcagtgtcctttttccagctgttttcccatgagtgccctctgttccgtcaggtggccgaagacggataactttggcaaagggcttggcacaaatggccaagtttacactggatcactatactccgtgttatcttgtttccccgatggtcattgccacacaagaaagtacttcctctgtgggctttgcccaccctcttctcttgacagagacctctgggcctagataaatgtgtaaactgcattgcaggaatgaagccgtttccattaagaactggggtctatgtcctgggatccagttcttctcccccttttagtactgaaagctgcttcccatctgaaagctgtctggggacagacaccgtgcagctgcgtgcagacttctttcagagtttgatcttgcaggcttcccagtggctctcctcttccttgtctgcttcctgggggtctctcagtatcaaagccacctgtggctccatctcacctccctgaacaggaggcactgtttgtcaggaggccttgccacctttggccctttctttccaaagaaagatccctggcctggagtttttgtctcagctctgttgtgtgaccttaggcaagtcagttgacttctctgagcctcagtttactccttagtaaacaaaaaggttggatgaggcgctctccaaagttcttgccctctgtgtccttcctctgcgttctacagggagggagtagctgcctctgtttggtggtggggactcaggcaggatgggtagggaggggtaggggaacaagatcatggcgcacctccacggccacagtggaaaccttgaaccttgagctgtatgcggtgagtccaggatgctgagaagatgccgggctgttgggtaagcagagcccctacgggaagcaaagagtattattcagccctgtggaatgctgaggcagggctgagcttgggcagggtggctgagagaattgtggctctagctgtgggcagaaattcatggccttgaagaatggctactgtatataccagtgataaatattagtcactctggcagcagaatgagtttcctgtgctgcatttttggcacttccagaaaagggaaagcctttctctctgacagggcacaggagggagaaacaggaatgtgtctcttaccctgatgccctggctggagatcccgtggggttttcaacctgcctgaagcaacgcagggcctgctaatgcctcctgttgccctaggtcaggccagggcccattgttgacatctgtgctgtgctgcctctgaaggtcttgcttgagcatgtcctgaatggaaggcttcatctgcattcattccccggccctccctgccgtctgcacagcctcctccaggcctccccttcccagtgaaaagcaccaccatccagacctcaggaagcaatcattttagcctcttctccttctccctcaccatccaggacatcactgagccctgtcagttctgcccccagaatatctaagttcatccaatgccccatttccactgctgcttcctcacccaaatcaggatgtttctggccccgtctccctcctacctggtctccctgcctgtaccctcctctccactgggcccattctccaccggcagccagcatgatctctaagaaatgtacatctgtcatctgtcatatctgctgaaaattgttcagggcttcctgctgccttgagaatgagggtctgaatcccaaacaagggttcaaatctcaacctctcaggcctaccctgaccttacgtatctttcctcagggcctgtgcacatgctgttccttcttcctggaatgcttgtccccatagttttcagctggcgaatgtgagtcaggtctccccttaaatgtcatctaagagagccctttctaattcctccccttcatcttaactctatccccaatacactctctcacagagactgttcttttccttctgagaccctactccagcttgtagttctaaatctgtgattatgcactgtctgtcttcctcttgaggtcaggggccatttcttttgttctctgctatgctcaggacccagatcaaaggagctcagtaactatttacaggcgtacatcatatgtggaggacacttatgctgtgatggccccacacacagcttcctttggggtctgtcccctgctctccgttacccgcgtggtagccactgagcactggctcttcctggcttcactctctggcatcaaaacttatcagtcctacatctcagtcttttgcaaggtgacacttatctgattacctaattcacacgaaggtgttaatggtggtaatggcatagtatttattaccccaggggacccagaacggtggtatcaaaacatatcattccccagtggtttaaaactctggtagctttccagggagtccaagtggagtccagtctccttagctgagttcacagggccccgtctgcacgacttggcttctgtcggcttccctagccctgacttcccaagccttagtcatcaccctctctcccacccagggctcagcacagtacctggaacagtcaagccctcaataaatgtttactgagtgcattaaaaaaaaaaaaaagattttaatgagtcatgctttaactgaagattttagtgtaatcagtcattgggccttggatgccaaaggaatgacaaatggtgggaatttcaggcacagtgactgtgatagccccaaggaaaccaagagagaagtagctttatctgggtggaggggagtgggcctttcagagcctcgaaatcttcccacctgctgcgccactcccaccacataagcaccccacccttcttcccagggtgagatttctcagctctgctttctggggtgccagacaaggggagagccttgttgccatgccctcctgccctcctgccctcctgatgcagtctgtggtcacctgcaggcagagacagatgaagtccgtcattcggctgcgagtaatttctgatgggagaggggcttcccccggcccttcccgcctctctgagccttgccacggtcacttggtttgcccagcctaagtcactgcctgtcgctgtggttattgcatggacagggcctccctctgtccctccacttcccttccctgccccatactgttgccctcacccaccccaaagcctcacccttcccttccatagggatatggcctgatagaggaggagccatttgattttgactattgttgaaattgagtggggaattttgggtttgttttaggttttggaagggaggattatctgaggcttgaggcttctgtgatactgacatctggtgtggaaagtcatcctccctcacctaggtgactgggcctccaggtcatctccccgagcagcctccctggatctgctctcctctcccccccacccccccaccacctcccgcgctgtgcccagggtgatctttctaaaggacagatcttgcttcagcacctccctggttagaacccttccgtccagtggttcctagtgcttcggggataactcgccttgtcccttggggtctgcacagtgtcctccatctcctctcacttggccttgccctcgggggctccggtaagaagctttccaacctggcagctgcagactctgtgcggttgtattattgctgtaaatgggcagggattacgcatttgtggagtgactgatttcaagtacaactgccaccatgggagaggtctgtgaaaatcactggaattgaaaatgaccatgctttgcccaaaaaggttgagaatccccactctgatgatactagaagcctgcttgcctccccaccctgtgccaagccatttcttgcctccttgctttgcccataccagcctggaatgtcccaagcctattcaacttacttcctccaaaacgtagtcccatcttgatctccaggaagcagccttcagatgccccctcctcctggccactgcaaatgtgtccccccagctgctgagcatgcctaggtctgacacacaccacgatatgttgaaatcattggtttctgggttattcttctcacagtcccaggcagtgagccctcaaggacaggggctccatgggactggtctctgggtcggaggccaggacccaggtcactaagggcatgtcactcatctggaccacagctccctgccttgtggtgtggactctgttctctgcactgggctcgttctaaaacggagcatttggtccttgcagcctgccttgtggtttatgacttagtagattgaaaatgacagttgtgctctattttcatttggaaagaaaaaaaaaagtggaaaaccagagattgcactgatctggaggtagagagaaaactgtggagatcaaagaagatattatgtattatgaatgttacacagatcaaggcatgtttgaaataggcttaattttcctcaagttggcttttgtctcacaattgagttcttgttgacgaagaccagttattattcgtcttcgtgtctctggagtctagcacctagcacggtgcctgataaagcatggtcacttcacaaatacttgtcgaagaacgcatgggatgaatatgcatttgggtatttttaatgcttgatgattagaacattctcatggcttgttaacttgtaagacataattttcattgtaagttctttgtgtgtgcaaatgctttttgcgtggaatgcttgccatgcactgaaaaatgctttgtgatagcagttttgaaaaattgagtcattttgccctgattgaagctgggtgaccttgtgcaagtcactttaaccctctgggacttgtggccctcatctgtaaaatgggtagaaggtcagagtggacctcgtggcctgagaggctagtaccccatgctgcatgtaagtcttacatcctcctctttggtgattggatactgaccctctccccaggggttcctgcacagagctggaattctctctggtgtctttgcattccagtgggtggaatgccttgtttctcagtagcaatgagaaatgttaatgtgaggttatgaaagcaagccaagagccatggaataattaaaacacacacgcacacaaagaaggaaaagcgagagggggaaacacacttaatggacaagggatgagtaaaacccaatggactgagaaaaccccagagctgaacttcacatgaccccgcgtgctgcctgcagttgcgacacccgcgtgccccttacgctccgccggcctctcagtgatgtcagtgggccatgggccccacaggaagcaggggctgccatcagcctggtggagcgtgccagcccgctcctcctccacggcccacttcccacccacccgggtctccagataacatgaagccatagctcccaggctcgtcagcgggggaaaccaactcagtgcttctcagaaaatagaaccccagcccattagtgatgtccacgcaggcaagagatgaccaagaagaatgtttgccttttaggagttctctgcctgaaaccagcaggtttcctttagggatagggtgactgtgcttgctgaacacctctaggtcgtcagtgaatgaaataattcattctgtgcttgagtgtctaagacccagggggtttaggaataattaggatactggctgtacccttggagttctgtgctgcttgggggatacgactcaaactcacagacatctgtggctcaaatcaaggcatatagatgcagtgactcttggaacattcgagggagaatcaccacctctgctggtggaggaaaggccaggaactgcccacctagttttcccatgaccccagcctgtagcgggatatgtcagaagatttggatttagaggaacttgggtttgacaaaatagaagtgtatgtatataaacagagttgggagtgatgggggataggatgctgacagcaccttggtagtccctccccctacgtgacagtattgacttcatagtgttgttgtgaggcttgaagaagatacaagagggaagaggagcgttccttgccgtgcagatgcaaatgctcattgttacttgttctgcctctctgtgtctgtgacatccagccctgtgtgggctaccctggttgcaaagtgggcctcctgccgttgagcagctatggtccagtgggcaggtacaccacagtcatggaagcctagttaaatcattacataatagttagctctgtatgaccaatcttttctttaaagaaattcttccttttggaataatcgtagatacacagaaaaactgtacacagataatacagaaagttccagtgtacccctgacccagatgtccgtaatgttaacatcttgtattaccatggtacacatgtcaaaactcagaaacaacattggtacattactagtaacacaagtccagactttattcagtaaaccttttgaaaaataatagctttattggcatataattcatacaccataaatctgctcttttaagggatatgatttagtggtttttagtgtattaatggagttgtacaaccatcatcactatctaattttagaacattttcaacaccacaaaaagaaacctcatacccattaacagtcacttcctgcccatcccccttagccctggcaacttagtctactttctggttctctggatttgcctcttttggacatttcatgtagatgaaatcatacaatttgtggacttttgtgtttgacttctttcacttaacatattttcagggttcatccatttgtagcatgtgtcagtacttcattcctttttatggccaaatagtattccagtgtatggatataccacattttgtttgtcctttcttcagttgatagacatttgggttgttttcacttcttggctattgtaaataatgctgctacgaatatttgtgtacaagctttttttgtggaaatgtgttttcatttatcttgagtagatacctagaagtagaattatggggtcatttggtagctttgtttacctttttgagaaactgccaaattgttttccaaagtggttgtgtggttgtaccattttacagtctcaccaccaatgtatgagggttccagttctccccatccttgtcaacacttgttattgtctgttttattttagccattctagtggatgtgaggtggtatctcattatagttttgatttgcatttccctattggctaatgatattgatcatctctccttgtgctttttggcatttgtgttttttgtttgtttgtttttgagattgagtcttgctgggatgtccaggctggagtgcaatggtgccatctcggctcactgcagcctctgcttcctgggttcaagtgattctcctgcctcagcctcctgagtcactgggattacgggtgtgtgccaccacacctggctaatttttgtatttttagtagagacagggtttcaccatgatggccagcttggtcttgaactcctgacctcagatgatccacctgcctcagcctcccaaagtgttgggattacgggcatagccaccgcacctggccttccatttgtatatcttgtttggaggaacatctacaaatcctttagccatttctttttttttctttccttttttttttttttttttttttgagacagagttttgctcttgttgcccaggctggagtgcaatggcgccatctcagctcactgcaacctccgccacctaggttcaagcaattctcctgccttagcctcccaagtagctgggattacaggcgcccgccaccactcctggctaattttttgtattttttttttttttttagtagagatgaggtttcaccgtgttagccaggatggtctcgatctcttgacctcgtgatccacccatgtgggcctcccaaagtgctgggattacaggcataagccactgcgcccggccttaaaatatatttttcaaaatctacattgttcaaaaaaagaatctgtggtaactctcagaaatccaataattacaatagtaaatacaagtaaagatagacaaggaaattaggggagaagacaagaaaataggaaaataagatgacataagagttaatgttagtacaacaactaatatgttgtaaggtttgtgagattgttggaagtagcctgcacatttggccttgagctttctagcagccaagggtaaaatggaaatgtgactaatgacaagattaacacagatgtctgaaagattgtttaaaaaaatgtccccacctccaatattttcagggactgaaatataagcatatttctcccatagatcctaggaacctgagcttctcacgcacaggatcatttcatttgtgttagttctttccctttagacgaatagctctttgaggacagtaactgtgtcttatttccctcacatctccctgtagtgcttaggacaaagcatgggagatgcttacaaaatcttgattgaattctttttcaaattgggaatgtttattacattctttggcagcatttctgccaccaggttgaggttagttgggaccaatttggcggtggagaagtggcaggggctgccctcctggatgcattttagaagtgttttcttgcatcatgcttcctgagtgctggctaagcagtggaaacattgggcaggtggggttgtgtgcccttgccctgagagatggccatcactttggagtgaaggtaagcagcattgcttcactcatgtggaacccacccgccttcccacctcctcagcgctggagggtcctctctctcgcccactccctctgacatgcctctgagactgcctgcccgatggaaatatccagcatgtatgagggaggtcctggccaaaactgaacagcttctcatggaattgggcccctcatcacctacggttatgtgtggcgcacagatggccactctgcaaagaggcccacccagatagctccctcaccgggggcaaggaacaagccaccttcaactgattacatgtcatattgggtggacctcttcgtcccacacccaataaagggctttaccatttttcagtagcatcctttcttaagagaaacaaaaaatagatttgaataccagtctttaaaggggtagttgtcattacttcgcagttgacagatggggaaatggaggttcagggtgcgttacctgcctgctctaagtcatatggtgagtgggttgcgaagacctgactccaacccagagaatcttgactttgacttcatcctcccctccttccacctgccagtacccagtctttatctaaatttagggggcttgagaggccattctttctattttgggtaccttcaaacaggtaagcacagttttctttgaagttacctctgcctccatgtgggagagtatcaacaaacagttcccccttccccctccaaaagcactctctgcacagtcacccctaggccaggagcagccttgtaatatgccacacatgttgttactgcctgtggcttttcacacctcctgtctcaaatattggagcttttttggctacagccctgtgatgaaggcagtgtgggtgctgttgaccctatcttacccatatggacactacatcatctagggtcaccctgttggttgggatctggagtaagcccagaggccaggattctgacttctggtccagtgctctgccctaggccttgagcaaatgtgtatcaagttgcactgacaatctttgaattcctggaactcatgccatgagcacttccaggagcaccttagtgcttcattacaaagatgatgagacgtaggaaagtcttttttttttcccacggaagcagaatctcacccacacccgcagattttgttgtgtcccttcagcactgagctgtgttctcagaacagaacaggtagaatagagtcaaaatgcaaacagaatggcctccctccacagtctgctttgatggaaatgtgatgccaagcaaacagaaaagttgttttggctccatctctgaggtcatttagttgctatttccatctactttgaatccacatctgctgtgtgctcagagccgtgctggttgccaaagaatccaacaagaaaaaggcatggccccctttggggcgcttgggtcctctcgcagtgccccaagcccaggtgagagacatgccctctgggccgtgattccctcatcagtaaagcaaggaagataatgtctggttaaccaccctcctggagtcatggcaaggctgatacagattcagtggcattaactcatttgttcattcagcacattttactggcaacttatgctgtgctgggctctggatatagtagtgagcaaagaggaagcactcacaagggtaacactgcaaatgctaggagtcatgcatgagaagtccagggagcctgattccatttgagcaaggggtggtggtctgggaaggttcccccaaggaaaagacattggagccaagaccaaagggtgggtaggagtaatcagaagagcatgtctctcatctctggacttctgtagagagacttctgtaaccactgtaccctctggaagtgggtacagaagtccagagatgagagagatgtttaacaacagagagaaatccacccgaaggactttttacatctctctaacatctcctgttcagtttatctcagctggcctttgctgagcaccagttagttgccttgtgcatccttgggtgatggattatggagatggcagtggttgacactgtctgagagcagctcccagataaaccagcgcactgtggttgatgggctgcctccaggtagagagtgaggccctccaagcacatcctggccatccacatcttcacatttgcagtgcctagcacacagtggacaaaagggatatactggacacgttgtcctaggatgcagattcctaccaggccttcaaggcttgtagaaatcttccctaaaactgatcatgtggcctccggtaaggaatctaagcttttgaatcttggatccatctcgggcacagggataacggtggcgcccatctcacggggtgtgtggacgttgtctcaataatgactgacgtgctgagcaagtacctggctggagaagcgtgtggtaaaggggagcagctgtgattattatgggtatcattcctagtggttctgcaattagtcttgacagtaagtgctgcaggacttcagacaaggagaggctacaggtgtggaagtgctcctcaaagcctgtgggacctaaatgggcacagtgaaggagagtcttaggtggaagcaagaaaactgagcatcaggaagggagcaagacccttggtgatgggggtatctgttctgcatggaggatagatgacttctcagccattgggaaaccagctaaccagctttctgcttgatggttgtagtaaaatcccatgattagtgacaatggcatgccaggtttgaagagcaaaggtcaggaggtgagaaagcagataaatgcaatgtttatcttgaaagaagttgtcaactacttggaaatccccaagcttacttcctccaggaagccattctggactacttcacccagttctcatagctcccgggccctccatcttcccagcactgaaacacacactgaaaagggcatttttctaaatatgtctctgcctccccttgtggagggatgtggctccttgagatctggggtcacggctggcgtgtttcgtggagtagctagaaagagtaataatcctttttgaatgcacagcatttacagaggcctcacaggctgaaaatggtaattaggatacacaattgggtcttttgacctcaaatccaggcattttcccaccttgtgggcctcactcaaatgatgaccccaggttctgcctgtgatgaatgagcaggcatggttttgttctgttaggatatgacggtagaagagagctgtttgtcagaaccagcagtggcttcagatcttgaaagtccaactccttcattttacagaggaggaaacctgtgccccaaagcaggtccccccaagttccagcccagtgccaccccactgcacagagcagctgtctccttttgatcatgaggaagccaccaggtccctggtggagttcagcagatgtgccgggtgggcgactctggtgggtgtgaggatgtttcctttcctgctgggaagtcctccaagctcttgtgaaagagatgtggtttgtcgagcatggattttcaaactttctttatagagagctgttgttagcttaaaaatgcctggaaacatgatcaagtgtaatgttttaatgataacatagaagcacatagtactaagcacatgtaatgagaatgtacagaactctctagtaagagtctgaaatttggccgggtgcagtggctcatgcctgtaatcccagcactttgggaggccgaggcgggtggatcacctgaggtcaggagttcaagaccagcctggccaacgtggcaaaaccccgtctctgcccaaaatacaaaaattagccgggcgtggtgacgggtgcctgtaatcccagctactcaggaggctaagacaggagaattgcttgaaccttggaggtggaggttgcagtgggctgagatcgcaccgttgcattccagcctgggcaacagagtgagacaatgtctcaaaaaataaaaaagagagagtctgaaattcattctttcaacatgcttgtgttgggtgctgcctggcacagcaattggtgcccactaactcacagcgtcggggaagataggcacggaacaagtcatctggtgtggtccctgcagtgggggagcccagtgagggcctgtccagcccagctgagaggagactgagagaaggctaggtggcataagtaaagatatggatagcgctttcctcttcagagtgtttattaccagggttagataaagcagatctcatgtattttctgctactaagtagaagttcttgttttgtttgatttctggtgggctttgatattttccaaaaagataataactcattgtagagtaagatcaggactggggccagcagacttgggtccaaaggtgtgtcatttttataccagactagaatcgggtgaggggagatgtaaagagatcactattgtcacggaaggcgctggaaggagctctgcttagaaaaaatgcctttctctaggaggttttcatccagcatgggaacacaaaacaccagtttaaaatagctaggtaaggcttcacagtctctcaatgtgatgtgggtgtcctgagtcgtgaacatcccattgtgcaggataaaatgctggtttctgagctgtctttcaagacacaacccaaatgctgtctttgccatggtgccttccttgggaacccaagccaggtgaggtctgccttttctctgatgttgcctaacttttcctctttgtgtcccttgagctcagggacatgcatcccctgttgtacctagcacagaatcatgcacaagcaggtgcttgttaactgttggtgtgtaccaacaaacatttacggagcacctattagcaggagcacaggccaaggagctggatagatgagcgtggagtttgggggagaggtctgagctgagatatacatttgtgagtcatcattgtatggatgaggccgggctggggaggatatgagcgtagaatgagaaggtccagacctgcacctgaagaacagccccatttagggaatgcagggagagacagaggaaaagcaagatggtgcacagtgacattgaaggtgagtgacgagaccctgcagcaagaggaaaggagcagcagtgctagatgttgcagagaacccagaatggtaaggcctgaaaaccatgtgttttagattctgtaacctggaggccactaggtgaccttagcaagggcagtcatgatggagtgttggggctgaagcccattgcagggaggcccatagtcaatgggaggtgggcagtagacacagagagctgggttattcttgccacacagctgtgctggggccatggcgggggtgggggtgccacagagtgggagccagagagggacctgggtaagggctgaccgtgggtggggagcgcatggagtgctttcagaggccaagtgagtggaactgtctatgaagcagatggatggaaccctggctgaattatctcagacttgccaaagacattcataaaattcagacccgcacacactcgggaatgggaaaaatgaattattttgtaagaagcttatagtccaaaggtagaattgcccaagagagcttctgaaaggaaaaagtcatagcaagttgatatttttaaagtgaaataacataggttggatttttctagtaacttcaaggggtaaagactttgaattttttttttggagacagagtctcgctttgtcacccaagctggagtgcagtggtgcgatcacagctcactgcagccttgacctcccaggctcaagcaatcctcctgcctcagcccctcaggtagctgggattataggcacacgctaccacgcctggctattttttgtatattttgtggaggtggggtttcaccgtgttgcccaggctggtctcaaactcctgagctcaagcgatctgcccaccttggcctcccaaagtgctgggattaaaggcgtgagccactgtccctggccaagactctgggtttagtaagcctcttgcaactcactaggagtggatttctaggacctccccactttcttgcttgttgtttcttttgctagccgtaagtccctggagtacactgggtactttatgggaaaaagaggaacagtgtgggacagactttgccctgagctgcttaacgtgatgtggggaacagaggtgataagagcctgtggcagctcaggcagccctgccatgacctggagttggggaggggtatcaaggataacaagtcttatacacatgccatgctgtttctttggatcaatagatggataatttttaaaaccccctgtatgtatcaaactcactttggagatgtaaggcatggcctctgtcctggtgacagtatctgagtgggaggcctggtaaaatgtctgtgtttaggatgatgaacgccataatctaagactgctaagtgctgtggggtggtctagaagggcagatgggctagctgcgaggagggcagaggcactgtgcaatggtgttgcctgggaacactccgtggagagtgtgggaatctcaccctggccctaccaggtaagaaattgggcctgggaaattgggaagggaatttttcaagcttcatggctgctccaggacttgaactaagactttcctttagagcaagcttgtccaccctctggcccgtgggccgcatgtagcccaggagagctttgaatgcagcccaacacaaattcataaactttctgaaaacattgtaagattttttttttgcgattattttttagctcatcagctatcgttagttagcgtattttatgtgtggcccaagatgacgactcttccatcgtggcccagggaagccaaaacaccggacacccctgcttagagaaagtgcgttttctgttataaaaggaccttgaatccccatctcatatgttgggactttgtcttgcatgttttcaggcagggcatgattgtatctgtaacataataatatgtaagaatgtgtacttcttagcctttgcagagaggcgggaggcctgtttcctgcagcccccgccctgtcctggctgaggggtgggaggcagcttgctggccagccccgctgagtcaccctccggcgtggagcccggtggggatttccacgcggccccagtgttctcttctcctcgtttcctgttgggctgtgacgcaggctggctgccagcgggtgccggtgggcactcctgacacaggccactgccagccggccttgtgggtcctgagggcatcgtgggtggctctccccccacgagtgactgtgcctggcagggtgtgccccacatgtcagttgcactccgttctgggtgggcagctcccagaggccccggggagggctgcagatgggcggggggtggctgcctgagaggacgggaggttttgttgaagagagagcttgctcttggggcagtttgtactgggcgtttagggttataaaaacctagatttgctgaaaacggctctcttttatcttctgacaagaacatttgtgaagaaaacaaaacagaccttcagccatttagtctatacaccgagagaatggtttctacagtatgcctgatttctctgggtctttctaacacatccatgtatgtgcttgtcagcttctagtgcctccatttcttgatatgaggaaattttgcttaaaaaaaaatctctactgataggacctctgcatattcatgcatgtttttcctccagaactttgtgtcccaccactgtgctaggcagtttacaaatgccatctgatttcattcctgccacttcagtctaaggctatattgtccgatacctatccaccaccctcatgtggctatttaaatgttgggtcattaaaattaaatacaattacaaatgctgtccctcagtcacaccagccgcatttcaagtgcacgggtaggctagtggccatcagatcagctcatatagagcagcacgttttcatcaccaccaaaaattctattgggtagcactggtctaaggtccggacatatgtccccattttgtagatgaggaagctgagtcctacagaggttaagttgaccacttagaagaatgaacagatgaaaccttttcattttacacatgaggaaactgaaggttatactcccctttccttcttagaaaagagaaattgatctgtaggcttcagggactcttcagttagcctgggggtactgtgcgggtcagctcttttgctgttccccccagaccctgtcagctgtgggtggtggctggtttctcttggtttcctcaccagagtttgggaatgagcaagtcaggactgctttccgtacggtaatcctttggcccatttcctatcgggggatttatggagctggtgatctcttgggttttttggccatttgttagagccaaaagaggtcacaggaaatgatatactagtttcattgcccaaaatactgaggtccagagaggtgaggggatgctgagggtcttgcatctagctaagagctgagctggctcttaaacttgttttcaagccaggacttacctgactttcttaggaaagtaatcactccatagacaaggataggtttttttcacagagcaatgatgttccctgtggtccctatgtagggtggtaaggaatagggctttgggatcctacagaccagggttcaaatcctggccccaccacttgtaagttatgggacttcagacaaggacttaaacattctaagtcctcagtttcttcatctgtaaaacagggataaaatatctcagtgaatttgttttaaatacttgcgtccgggcatggtggctcatgcctgtaatcccagtactttgggaggctgaggtgggaggatcgcttgaggccagaagtttgagaccagactggccagcataacaagaacataacaagatctcatctctacaaaaaattaaaaatattagctgggcatggtggtgtgagcctgtggtctcagctactcgggaggctgcagtgtaaggttgcttgagccaggagttaaagtctgcagtgaactcgccactgtactctagcctgggcaacagagtgagaccctgtctcaaaaaaaaaaaaaaaaaaaaaatcagccaggcgcagtggctcacacctgtaatcccagcactttgggaggccgaggcgggtggatcacctgaggtcaggagtttgagaccagcctagctaaaacatggtgaaattccgtttctactgaaaatacaaaaaattagtcaggtgtggtggcacacgcccgtaatcccagctactcgggaggctaaggcaggagaatcgcttgaacccaggaggaggagtttgcagtgagccaagattgcgccatcgcactccagcttgggcaacaagagcaaaactccgtctcaaaaaaaaggaaaaaagaattctaacatgtttgagattgactgcaattcctagcatattacaagtgttagtaaatagtagccattaatattatgagcttatcatcaccttcagccagcattctaattttacagtatagaatccagtacataggaggcactcagatagacgggatgccccaaaattgggagacggacaaacttattttgaaatagtctttttttgacatttccaaagaatatactcaatgtttttctgcaaccctttgccttctttttaggtgaaggacctctacatttaaagcagtgggttcaactgctaacctgaaaagctataataaaacatcccagagtatccaaaaagcctggaaacaaagggaaaatagtgtgtcctgctttccaactttcggatatgctgtagaatagactgaaacaaatcactggaaaataggttgttgtcgattttatttagaagcttttgttcctttggattttcgtctcttatttttagacagagtctccctctgtcacccaggctggagtgccgtggtgcaatgatagcttactgcagcctcaaactcctgggctcaaatgatcctctagccttgatctcctgattagctgggactacagaagcaggccaccacgtctggctaatttttgtatttttctgttgagaagaggtcttgctatgatgggcaggctggtcttgaactcctggcctcaagtgatcctcccgcctcagcttcctgaagtggtaagattacaggcatatgccaccacacccagcttttttgttcctttgaaagaaggcattgctaatgattgccctgaggtgtctagatgacccggccagccatccacctctgcagtttacacagcttgttgatctccacagtgagaattaacttcacaacctgggtccaagaggctggaggattgtcagtctttagaaaaaaaaaaatctattatctttagagaagatggacttgttgaggaagaagagtagacaaatactttctggaaatattttcaaagggaattagaaaaagaaaaagattttggttgtcctttggtgaatgagaatattcatcagcagaatgcctcattaccacgtcacacagctgaccaaggcctcatctgagactgtgtttgaatagaaattaaacagggctgacagtgaagtttctgcttttaattagctttcaaaggtacacctctacctgtgatgttgaaacatcttgaaaaacctcactgctctgtgcctgaatgaggggcatctagagggcttggaagagaagatgtggcacagggcagccggggagaggctggtggccagaagatggacctgagcttggtgaatttacctggcatctgagcctggcctgaacaattcagaaacctcatttcatcagtcttggagtcagggctcctgtctcttagcaaaaagctaaagcatacatcaagcatatttattgacaagcgtaaccactgtgaggttataaccagggtgctctgtctgcttatgggcaccccacccgaccagccaaatggtcagagagctgggtgggtcggggaaagggagggagggagtcatgggaagcagttgtgttgaatggctacaggccctggtggctgggtgcatccccgtatgccatccaggcccacccactgctgggccggaccttcccctctggacagttcttgcttgggcactgactgggtttgctgctgaacctcctggcctggcagctctggttgctgatccacccgcttctttctttatagagattaagagcggctccagtgtgtgtacggagagcctctttgaagcgctgttgcctttctgtggctagatccacgatcttctctctgggatcaccccataggacatttgctttccaccttctccagtcccagtgaatgcatggacctctgtcctcattgttactggctgagccagatgtcagtcctgtgacctggcctcaggaccactcttgtagcccaccgtgggtggatgaagccggtgggaacagaatgataggagttaaccactttttaggcgttattgggccttttcactttaatagcttaacagagacatctgtgatggcttgcatccagagtgcgtggtgtttatttttgatttgaaatatgaaaagcatttttttaagacaactgactcctctgagtcatgcccaggggagcaaacggcctgaaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtaagagttatcttatttggcagggtgggttaggtgtggggtatttgtcactgagaagcagaaactgtatgctcgacacacactccctgagtccttagggaattgcgtagtttttttcttttcttttctgggttcatcttaccagcagtcgtgtttgagaatgtgcacagctcaccttcgttcagccctttacagtttacctccatagccttctttgcgtcttggcaccatcttgcgaggtgtcaggccaggtgttaggatgctctgtttacagatgaggagattgaggcatgagttgtgattgctcacaattgcctcctgagtggtggggccatgctggggcactgtgcccagactctagacttccaggggtccgggacctcctgctgccagtctcctagcccgttaccacagctgtctgtttcttggcctctccctagatttctaatggaactcttggggtacagtctggaaataggtattttaaacatgctttgcagtgattgttacagatcttcatgttcaggtggcccaggggctgaccctgctccaacttccccctcagacattaaacctgtaccacccactgagatggttttgattttctattctgcatttaaggcccatcttcaccccataaatgccagctccccaaggacagagccctttcctgtcttgtccacaccatgtcccagggccctggacggtggttggcacacagtaggcccttggtaaatgtttgtcggatgagtatgtctcttcctcagctctgtggttagctgggagagctccgacagtagagtctggcaggtctggttcaagcatccctttggtgtaacatggtgtgaatggtggggcctcactgaattgtggagtggggggcagtgtgtctccctacgacctcctggtgaggagaagatagtcaccacccacacaggcacactcttgaatattccaggacaaggtgggcactcattagagggcagctcttacggccactgcctggtatgttttggcgtgagcagtagggtcatcgtggtggtcagtttttccactgccatcaaatgggatccatttagctctcagacagacaaggtatagggctggactctgtgccgtgggctaaataccggccacctcgagcctcaaatcaagcccagacaccggcataaacccaggtggcccaagccgaggtcgctccccagggccaggctcatgaatggataagtaaatatttaccctgtctgaggtcgaatgtgaactgtctaccaggtgttttgtttttctgtctcctccctctgtttctgcagtgcctccccctgtaaaaaaggaaaccaagaggctgacaggttaagtgacgggcttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactcacctggcaattagtcatatgcaactcttatattgaccttacatgttccgtgtcttctgtgcccgtctctggagttcctgaagatgaagggctgtgtctgctgcaccttcagactttttgaaattgattggttggtttgtacatccatttattcaccccacccctcatcctactgtacacgcttatggtcagtctattctgtgtcgggctcagggcctttctccccaaagtgcgttcatgtccaaggctagagtggatggctagaggccagaggacagcttaggctgaaagtggtagggagactatcaatgaagctggggggagctgagcttctgaaacttgggaataaattttcagccttgctaatgtgttcctctgaaaaaatatcttatcaggccctcagatatccaccagttctccctttccaacttgcagcctgcacccttggccaggaagttcataggcaacaaaatagaatccaccttccctatcactcaccccttttaaaatgtgactaactctgagctaaccaagccttggccagacgtggatatggttatgcacggactccgttttgtggtttgtcatttctgacttgctgggaaatcctttgttgggggtggggatgggaagtagagcatctctggggctggagtttttctaagatgtgtaagatttagaggctgtcatactgcaaacagggagagcgggctgtctgcttggcttcatggtcagtggagaacagcctggacttggagtaagaacagctaggttcagatccctgcttttactcctgaccacttagtagccttggccgagtccctcaacctttttgcctcagtttccttatctgtaaaacatggggttcttgaaggattaaaagagctggtgtgtgtaaaacccaggaacatagttcctggtgtatagtgacttataatttcgaaaaccttaagattttattcataagattttttttttcaaggccaacttaagatttctaagagtttgtttttcaaagagctggggtcttgctttgtcgcccaggctggagtgcagtggtatgatcatagctcactgcagcctcaaacctctgggctcaagagatcgtcccacctcagactcctaagtagctgggactgcaggtgcacgccaccacacccagctagtttttaaatatattttttagtagagtgaacctcgccattttgccaagcctggtctggaactcctggcctcaagcgatcctcccacctctgcctccaaaagtgccaggattacaggcctgagccaccacgctcagccttctaaaagtattttggtgtgcaccattagcactgtgtcttaaaggcgatgtgcaccttgagcacagagtgttgagtgcgtggtggatggatgtcatttgcgttttacagatgcggcaacagaaactcaggcccagccacttacccgaggccacatagtcccaggtagagttggaatttggaataaagcctgctgactccaatcctagatgccttccacactcctgtccccctacctctacaccaggcgtccccaacccctgggacccctgggaagtgatgtgcacttagcacctcactatgggaaacataaagcaggaactaacaggactcctctctcaagaaggaatttcagtctacttggggaaagaataatagccaagcagtaactcaggttggtttagccttctagagcagtgttgccggatatcactgtagtgtgagctacagtgtatggtagcccccacttgttcttggttttgccttatgaggtttcagtcagctacagtctggaaataggtgaatatagtacagtcagatgtgttgagagaaagagaccacatttatataacttttatgatagtatattgttataattgttaatttcattattagttattgttgttaatctcttactgtgcctaatttataaattaaactttgtcttgggtgtacatgcacaggaaaaaacacagtgtctatagagtttggtactgtctctggtttcaggcatccactggtggtcttggaacgtattcccctcggataattgcaattacttctaaaatctaaaatcttctggccatgttaaaatgtaaagagagggtgaaattaattttaaatactatatcttgtttaatacagtatatcccaaaccatcatcactttagcatatactcaaatataaagattgttaacgagctatattacattcttctttatcatactgagtctgaagttgatgtgtcctttatacttgtggcacatctcagtttgcactgtccacatttcaagtgctgccatgtggctggtggccaccatattggacaccacagctacaggatttcttcgttaggtcagttgatgtcacctgcattttggagtggagtcattgagctcactggctgagttacacagctagtgaggagccgggtgggaccagagcttggtcttcttcccattaaggaagaagggaaacttgcatttgctgaatgtctactatgtcccaagtgctgtgctagatactctacctttgtcattccatttagttctcacagcagccttgcatggtggatgaatatcatgtgcattttacagatgaggcaacagaaactcagagaggcccagcaacttacccaaggccacgtagtcccaggtagagttagaatttggaatagggcctgctgactccggtactaggtgccttccactcacctgacctccttctcctacaccaggggtccccaaccccggggccgtggactgataccggtgtgcggcctgttaggaaccgggtctcgtagtagtaggtgagtggtgggcaagtgagcattacggccagagctccgcctcctgtcagataagcggctgcattagattctcataggagcgtgaaccctattgtgaactgcatattggagggatctaggttgcacactccatatcagaatctaatgcctgatgatctgaggtggaacagtttcgtcctgaaacatcccccccaaccctcatctctggtgccaaaaagattggggaccactgccctacacagagaaagagaatttgcacgtagcaacttaggcaaagtattcaaggaaagtgccaggggacaggaaggacaccatgggctggtggcctgttcagtaacagcttcagggtatcagttcagaaggcctaggcctgctttggttggggtggtgtatgtgtaaaagcagcattctgtctaatcacaggttctgcctgaaaggcagacacttttaacccttcggtggacagggttggtgatagctagtggggggtatgaggtgggggtgaggaggtggtggtgggcagcaattgcagaggccagagatcttggctgtgttctacctgccatgctgggaatgctaagtacttctcaagcctccaagcaactgagactttctgctcggggaatccccaaggatttggggaggctggaattgagcaagctcttgaatgcatgcatggattcatgcagtcactcactccacaaatattcacgtgctttgggccagaatgatttcggcaggaatatcttgtcctacatgctattgccatgttctctgaggacccgcggcttcgcatgtgtaaatctccctccagagtactcggcagattcccgaagctgactgaggctcagggagtgtcagtcccttgccacaggtcacatagtactgaatggaagatatgggacctcagaaccaagaggctttgactcatttgtccctctttctgtctgttttgccatcagccaggagatagtcgttgagttgtttctatttgccaggcatcgagctgtgttctcgggtttcattgttgttgttttcattttgagtgtgtttgttttgttttacttttaggagcaatcacagtgctcctgttgctgaatggtggctgatgtctgttgcatgccaagcactgcgcagggtgctggtcacagtttgctccagggattcctcccagtcccgctgtaaagaggaggaaactgatgctcagagacttggacctttctgaacatcatgaagctagggatttcagtcccagcctctctctcgagagccctaacttagccactatacctcactgcctctctgtgaccagggttgagtcctggtcctcaaatgaagcccgatttgccagaaccttcttttgaggccttacctggtcttcagttttaccacgtgttaattgggggcagggcagccagtccatcctcttctgcagaaatcaccctgtccaggagatgggtgcttcttcaggacactacctggctaagaacactgcattaacaggagatagagatccagtgtgtgtgaaccttgtgaaaacatctctgtctgttcctccaatctcccccttctgtcttatcatgcagggcaagctcaggttgttgtcctgtctctgttgggaggacccttgagtggtatctcctatgcccaagcagacctgcagagaaccctgtccaaactgatggtcatctgagacatggaacttcatgataggaaggtgtcttggaggataactagcaagtctttcactttatagagggggaaactgagtcctcagcgatcagccacatagattctgtgttgtagagacctgaggatgtgtctcatctccttatctgaacagcaagttcccatgctgcgaacgtctcaccctgaccctcaccgtattttttaggaagtgaatggggctttgagaaggacaacctcactgttttgcccatttctgagatggaaaatcaaggaacattgccccatctccaccccgggaatctatatgcccctcccataggcaagatggaagctagaccagaatgtgcagcttgtgcttcttgcgggaatggtgaggacagatgagggcagggagacagcattcctaaacccagccttttgacccaagaggcagggactccaaggctgtagaatgggaggaattgtgggaggaaaagcactgggcagaaggtctcagtcaaatgcacctgcagttattagctatgtgacttgggcataatgccacctgtgagcccccattttcctcactaggacagtgaactcaccaataggtttgagttgttgccctcccagaactgttgcatgaattgaatgaggtgccttgcttaactgtactgaatactggggaagcctgcttaaatggatgacaggctttttatcattagcaagctgccgcactccccactcatcactccaaggcagaccattgcattttctttcattctgataaactccttgagttgaacagaaatcagactccccgtaacttctgctccacagtttaaaacagcccaccatgaagccttatgtccttcaggacattctgccctgttcacttggatttctctcctccctgcaaagcatcatcagcttcctcctctgacccatgttttgcacttccttgcttgtcactcctctttaaacacttgtccaaactgtttgtggcccgtcctgtattacgcccagggcagatgcagtagcccagcccaagcagcagagaccatggcctccctgatgtggggtctgtgcctcttctccaggcaagtggctgtgacagtctaactttatggaagggtgaactcaatgacattggctgaactgctggtgaacacgggaaaagcccttctggacctcttatctctctctcctggccagaggaaaaccatgtcccatttgtcctgtttgagcactatcaggcctatagccataatcttttacaccgtaacataactttgccaatgccaatattatatgccctttttttttttctagaaaaacttaattgggattttaaatgcatttgggggatgggctgcgtttctgtttgcctctaaaaacaatgagaaggcaaacaaagtatgatcctatcgccagaaaaatggagccaaatctgaaattaatttacaaagtcattagtattttccatttgtgacccccaaaatgaatgtaggtgtagttccttgcaattaactgcaaattaggaaagggttgggaggatgtttcagggaccaacacacagaactgtagcagaagcagatgggggaatggaaccaagaattgccttggttttcactcaaggccgtggtttgggagagtagtgccgactcaaatattccccagaagagagcactttttcaacagtctgaaaagtggcagggacctttggaatgatctgttttaaccttttcattttctgaatgaggcaactgagagattcaggaagggtaagcgacttgcctaaagtcacatagccaggaaggtcagaaccaggaccagagctctgcttctgactccctggccagtgctccagctgccactgcccccctctctcctgggtgcttgtctgcttgtgcctttaatgttcagcacttgagatattttcacgtttagcaccttcacgtttagcagtactcctcattagaggaaaatgggatgatgtgggcagagtcacccacagagtcactccaggtttcagatgtgctggtgcttaccgagtgccacagggagaaagtggtggtttctcccttcccttaagaaacctggttatttccaaggctcaacccctgcaacgccccaccaagccagtcacccaccactgcacattgagaatctgctgctctgtgaatgaaattggcctggggttaatgagtggtgaatgtgtgtcagtgtttggtatttgcagcaggagctcttctgcgattccctaagctcagatgaacggggcctttaagatgccatccagccatcggagagatgcaggaaaggccttttgaaatgctgtttcccctgacctatttgaggtgaggccctgtgatgtcatttccccagtggtgtgtgtgagagagcaagcagcactaagaaaagccactgctgagagttcacagtccttgcttcagtgttgtcttacgctcggggtgccttaaagggcttacagcgaccctacctccagcttctccagctccctttccttggcaaacacttgacccatcccagccccttgggctttctttcctcctcctctgctaccacatactgtgggtgttgggaaattactaaaggcgcgactctggctctcaaagactctgaagtccaggatcgagaagaactgtgtttacacggagttgtcaaggatcattctgccaatgataacctattagcgtgcaactctgtgccaggtcctgctctgggagctttatgtgtgctgttgcccctcacactcacggcagaggtgagacagaatgctgagagatttctgcagacaaggaatctgaggtttaaagaggcaatgtttgatgagccactgaggggtggggctgggattggaaccgaagctggctgcccttcagcccccagggtcctgctggggagatgtacccagggggtcctgtgctgggagagtggaagcaggggtgtcactgggggctttgtcctgggagctgggcaggtgctagggacagagctggcctggttttggagccacaggagagaagatggccgggaagagctgtgtttggaaggttcctttctgtgccaggggtcagcaatctgggttctagcactgagaggggcaaaacgtgggtttgtaggggagagagggtgacccccagtgagggtaagaaagataagctccagtgagctcttctcaccctgggtcccagcctgtaccaaaaatccaggggcagcccccgggcccagcctgcccccttcacagtcccctgactgcttgaggctgtgggccagtggctttgccccttggaagcttggtttcctcatctgggacagaaaggggtcaaaacaccctttttcattgttaagattagataatttgagagccaaaacttcttgcagggtgcctggtaccaagtaggccctctctaaataaataaatgatagttttcattttcccttccacttaattgtttttttttttaaaaaaacttttcttccctgtaataacaaatttcagaagacaagttaatacattgctgtgtatactctcaggccaagaatttcctcagtgtttacataccagagcagtactttgaactttgattttctcctctgcctctgtgctggttcagacaccctctctaagatgccagaagcattgccctgccttggcctgttggtggtggggtatgtgtgtgtgttttcatcgtattataaaaacgtgaaacatttgaattacgggcaagtggtattctaccagatttaataaacgttaatattttccatattcacatcaggtatttgtaacatctctttctttactaaaaataaaaaccttctgctgaagacctcctgttactccaaccccttcccccttcttctcgctcccgtttcacaggtgtttactctcttttaaattggtgtgtgtccttcccagctagaattttgtagtgtattatttgtaaagccaaataaccccactgcaatgtgtttgaaccaccaaagcaaatgatcaccttttgggaaaagaaggctgaatatccaaggccagatcagtgattcgagatcacagaacaaacctaactgctctcaaattgaaatctcaaaattataaattcattgcctttgacttaaaacttggaactttcaaccctgcataattgcagatacattaaagattgtgccatcttgagctcccagggtcatctgaacctttcatgtgaggaaacacatcccagagtcagtcattcttttttttttttttttcttttcgagttggagtcttgctctgtcacccaggctggagtgcagtggtgcaatctcggctcactgcaacctccgccttccggattcaagcaattctgcttcagcctcctgagtagctggtattacaggcgtgcaccaccacacctggctaatttttgtattttttagtagagacagggtttcgccatgttggccaggctggtctcgaactcctgacctcaggtgatctgcccacctcagcctcccaaagtactgggattataggcatgagccactgcacccggcccagagtcagttattcttagagcaggtgttttggcttttgtctttaatgcttccctcccgactttaacataactgtaatatataattattgtggaaaatttagaacacatggagaagtaaagagtgaaattgctgactgccctattaccccaacctccaccctatagagatattttctccccatccccccaagggcagaggatggagatccctgggcttctccaggtggggagtggtaccatggtctcttcaggtttcgtagcagacaggccccattgaccataggatatgtgtccccaaggtggttagaggccatcacctgcctgaggtcagctcaatgggcagggctgggcatctcctggtggtctacccaccatgcctgttcatcaggctggggtctgacctctttctggtgtctggtgctgatctaggcaaggtgacaagtgctcaacagaggagtcctggttccttcaaggaagctgggaagtgtaagacggagcaggctgcgtttgtggtttttgccaaggcttgacttttgaccacttttctgaaaaaggacaagggtgtttttttgttttgtcattttttttcccagtagatgttcctatttggttcacagatataaacacttgaaccaggtgatatcagcactgcaagttgatttagtaccacagccattttctgtgtaccaatatgaagctgttccttcataagttcttccttttcgcttttttaaactgaaattattttcattaggatcactaccttcccatgtgcattttaccacaaaatttggttctgattctgttggcttgcttgctgttagtactcatgttagcttctgccattctttccaccattgtcctgggtaaaattttgcatatctgagttgttggattctttcatcagtttttggttagtgactttcatggtctgcagttttagttgctttcagttttattttgtgttgaagttttttctatgaggtttgattttttcagggtcagtttttaaatgtagcaaggagtgtgctttttcagtttgcttattattttcaacaaatgtttttggtgggtaattttacctttgttgatcaccagctttgtttggggtgcatcatttctctcaagccgaattttctctggtaatctggccagaaggcccatagggtcagaatggcaggtcaaaatgtcttggtgctttcttgaagagtttgaaacaagcttgcaaagtactgtcctccctttggatttctcctgtctgggtgttgccagggctcttctgttagcgacagagaaaataggaggtactagaattcggacttctaggaagggctgtattgtccttatcatcagaatccctccctcccgtccctgtgacctcccaacttcacaaacatgtcttgcctgcaccctaggcaaacgtggaaaggcgcagctctggtacaccggaaagcatggtggatggggaggtaggagccccgtgccgggacatgtcttttctctttcttgaactcgtctccccacccgtccacagggttgctggccagagatctgtcagagtttctccgggcttctctttctccgggtggggatgtggactcttaggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatctgcggaagagggttccagagtgtggggagagcgtgctggggaggggagctatttgttcctttccagtcatcgctgtactgagcggttccctgggacagttgaacccaggggaactgaattcatctgtgtaagtaaacatccatctccccttaaaggaaaagcccctgctcagcctctctgggcagctggaatgctgctctgtgggtctgggcatttgttccttctttctttcttcctttgatttcttgctgtctccttcaattaggcctgtgactgttttcacatggctatttgtatatacaagccatgccaggcatcataatttgtgtttgtctagatcaataagagcagctttaaccaaaaagtccagctgagaatttataaatacccctcacctcctcccctccctggaagatgtgaaaacaccatcccattaaccctccaaagcagttggttgacttgatcagggaagatgtgaaatataatttctttgaatgtgctttctctttactcttttagtggaatttgatcagtgtttaaggaactgtagccgattcccagcccacttcaaagcaaaagcccttcactgtgcctatttgcaaaattacctttgagagactgaagtgtcggaaatgcatttagacacagattgtgccttatattagctctccgttgccccataaaatgggcttgggcatatctgaggcagctaccaaaggaaacttaaaaacagattctggcggcagcgattcttgtgttctgtgctcactgtggaaaagaagggggctagagggatttaagtttacgtggatcttgaggattttaagaaccagatttcttctctttgctcacattaggggaaaaaaaataaacctcagatgccccgtgatatctcgttacgtcaggttttcctataaaatgtcaagacggcaatattaggtttcctggcttgcttttccccactgtgtctgctcttgccagaatttttattagggggaggggagcattctctacccctcctccctcaatgaaatcatttcttccctagcctttaaccctttaaagtttgggaagggaatactttgattttagggttaaatagaaaacttccttaatgactgtggctggaattaaggtgtacttaaagctgtagcagccctggtgggtcctgggctgactgggtgctagggtttggtatggaaagcagcttgcatcacctgcttttcttcccatgcctgtgccttccccaagctccccctcctaagccaggtacgattccagctatgttaaaaggccctgggaaatgttaactgatcaaaaatgctgggtaagtagaattattatttcaccctgaccagcttcagtcagattagcatatctgctgtcaccaggtatggcacaggcatgggtggaagctgtgcttggaaagtgaatgtgtttaggccaggtgtggtggttcatgcctgtaatcccagcactttgggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcaccctagcctgggcaacaagagtgaaactctgtctcaaaaaaaaaaagagaaagaaaagtgaatgtgtttgctggaagctgtgcttgattaagtgaatgtgtttgatccaagagggcaggggattctggaagagacattaagtacagattgatgagtgtcttgtctcaccgcaaaaacctcctttctctcttccttcctagtccccactgaaaatggagtggtgatagcttagttctcactttggtttcagccaagagaaatggtacccaggaggtagagttgagtagagactcctttagctctcttcttttttctaacttctctttattccaccgttctctctttacttctgcctaccttagcagcatgctgcagaataaactctgctaggaggaagtttgaaatctccaggctgagaaactatgcagagagcaaatgaccttctgagggctctgggtacagaatccttggtatgacaggtgggtctagagccggcagagactcaaggcagcctgacaggacagtgagagtgaaagggaacgctattaataatgacaccaggtcaacacatgcgaacccaactgtcctgaacaaacgggggtttgtggttgcgctacaaaacccaggcttcagtctcttcgagttctgttttgatttggaaggagtgacgccttcccctttggaagcttaggctagggttgcaagctgaggtgttcacagggacagacagagtgtgggaaatggggcctggtgtaaggaaacggagcagaacttggggttcattcatagtctaaagggggcattggcaagtcggcatcagacagtagcaacttgttgccagatcttctgagtttttttcaagagaagccaaaaatcaagatttacacacaaaatctcccagtttgtaaaagttggcaaccatttaaaaattttaaaaacgctctgcaggccaagcacaacatctgtgggcagtgggcagctgcctgtttttgacctccagcccagaccgatcaattgatggctgtcttctgggtctcccaattccggcaacgggaagtttcttaaggaagttgcctgggctgaccgcaagtgaggtggggaagtggaaagggagcttgacttggcttcgattgatcatttgcacaataaatatttattgagcacctgttatgttcaacgtactatctgtgttgtgccatgtttcctagtctacattttgggatgagctgtgtcttcctcatgcaggtggactctttatgccctgcacagggatggttccatgcttctccctgagattatggccaagatggatgcagtgggaggaacttcagtgggggaatgttggggaaagacctgggtccgattctcagaccctgtaaagttcattgtatttcagcttaacccagcagtagtccccaggatgagacagtcttcagctgaggaaagccctggggatttggaagctagagcagagagagtccagccagggacccttgtctggcagtccctgaaggctgtaccaggaccaggcggcaaaaatcacagaacagcctccattcagctccatacatggcagaactttctaacagagctctgtaccttgtggttgttggactagatgatctgtgagctgtttttcattacctggaaagtccgataccttgagtccaccccccatacacccattagactcctgagtcttaaatctgctctggttcatggcttacctcctgcagctgaacttggggttgagtgccccagaaaagccgatacaaactctaagttgaggccaactcagtttgcctggggatgaggtggggtggtatgggggaataaaggcttctctaatgctgtgaggtgtcattcatgttttccattctcctgctctccgaatttaaattagggtcaatcatacaaacctcacaggcttgttcagtcaacaaaggcacagagagcttaagtcacttgctcaaggccacgtagcgaggcagtgaagagctggggcctggaccagctcatctgtcatcccccgctcttttaccccctttcctaaactgttagattttaatttccttttggtatattcattcttttgtgtgtctcctccccacaccccccccaccattgtttctagaactgtcagtgttcaaatgtttaatagctaggttttttttttcccccgtacacttggccagaagtaggaattcatcaccatgtgtgaacatttactgtacctccatggtttgcgtggaattgtactagaaacactcaaccccggggctttgttggcaataaactaggtctttctgcagaacttttgaggacaaatcaccaatgggttggaaagcatttccttcaggaatggcgaaactctatttttcaccttgttaatgctgctcccacctttgtttctcccctagtgtcagtcttaagtgtgttaagtgcttttttctgctcagtgtcctagataagaggtttccaaatgatgtcccctgatctgtaccccacccccaattctcaggcttctggatagacagagaatggacatctggtttgttttggaatgacaggctagactagaggcgtccagaggcctggtaacggcagaggctgctggcatcttaagacattcaaaaaccactgtgctaaataacagtggagatatattgatctcaacatttcaaggagaaaagagcttgtgaaataggcttgtgatgtttgtgataagggccctgtggggcagctggtgggcaccccatgtagagctggaacacagggacatgatcccatgtgcaggagacagctccagcctctgcatacccgtcggctcactcctgggttggaacatcctcctcattttctctggcatgtccttttgctcaatgaatcattcccggccaggccagacgtccttgctggagagccagctctccgtgcaccagccctgtgattctctaatgccagcttgaaattcggtgacccaccttgggatgctttgcctgtcaaggtttttcaatgatgaatagttgttatgagcatgtcagccagaatggtacttttcaagtcattcagtaatggatctgtatgattattttttgcacaaagaactaaatagctaagatactattgtggcagatatgccataagtaccttttcagtgaaatctttagtgtacatatttgtcacactgtattagaacatattaaggcagctcattaatgttttagtatttagagtttgtcatacagtgagcaaaggcagacacctttgacacagtctattggagcaaaatatgtctaggcttttgcttgcttttttcattttcaaatccatatttccatcagaattttagagttgtttgtttggaggcagagtctcaccctgtagcccaggctggagtacagtggcctgatctcagctcactggaacctccgcctcccaggttcaagtgattctcatgcctcagcctcccaagtagctgggactacaggcatacaccactacgcctggctcatttttgtctttttagtagaaaccattttcaccatgttgaccaggctggtcttgaactcctggcctcaagtgatccacccacctcgacctcccaaagtggtgggattacaggcattagccactgtgcccagcctagggagtttttttgtttttgttttttgagatggagtctcgcactgtcgcctgggctagagtgcatagtgtgatctcggctcctgccgccacacacagatcataatgtgatctgcaacctccgcctcctgggttcacatgattctcctgcctcagcctcctgagtagctgggagtacagcctgctttggcctcccagagtgctgggattactggtatgagccactgtgccctgccttttttttttttctttaatgtttgtattgaggtataatatgcaataaaaggcacatatttaatgtgtacaatttgatgagtttgatatttgtatatgcccatgaaaccatcaccagtcaagataatgaacatgtccatcactcctctaaaactttcctcctgcctctttgcaatttcaccatcttgtttgcctgctgcccccatccctaggcatccactgatctgctgttattatacattagtttgcatttcctaaaattttatataaatggaatcatactatatgtatgacttttgtctgattttttttaatgcagcataattattttcagattcatccatctttttgcatgttttagtagtgactttttgtggttgggtgatatttctttttgtggatataaagggagggttgttgatcttcagggattatttattttcattttaaaagtttctcctgaagtagtattttgtttttgaaaatgtgctttgaaagaaatttgtttagaattcatttggccctaaaatccacgtaattaatgatttaatgagttaaatagtgatttaactatataaatatagtttgctaccatgtttgctatgtgccaggcttgatggtgcttgtagggcacagaagaggttcctgtcctagccagtggttgatgtgttcaggagggcctatcagtagtgcactagtgcaccatatcctacatgtgatagagctgccgtgttcttagacacaaagacagctgttatgctgtctttgcaaaaatgttgaggtcttgctttccacaggcttgtggcctgatgcacgtttccagttttgcacaatgtcacagcagatatgccttccacgcccttggtttttcacagccaggcatggggctggaatctcagagctgcggttgctgtggttctctgattcctgctcagaggattgcgtgatgggggctggagtgcaggcaggaagttagccttgtggattccctcatcctcacaaagccaggcgcacagggaggggttgggggtagggggttgccatgggaatttcttccccagccagagagccagggtggagtgtgttgctggggagttggaaatgtaccctcttttccatatccattgttcagtcacgttctcctgaaagaagtcttcttactgtgtgtaagaaaaatcagtaagcctctgataaatagtcaaagactgtcagaaaagggaccttggaaatatctggtccagcctgcccattttataggtgaggaagctgaggctcagcaagcaggagtgactcaggaataagcactcatagcacagctgggacttgggaaacccaggcactgctttagaccttcattttcacaatccacgaaggggggagtttgaagaaggcttggcaaaatttgatagacctgggaaagagattgttaatctctcattctgtgctcaaggatgctgtgccatttaaaaaacaaaaacaaaaaacagaaaagaaagacaaaataattctcccagatgatgtttctagaatgttctgacatcttacagtgtcctgaccttgcacaagcttgttccagtaataacgttaaaattcaggagtggatgttcggcaacatcattgggcaggattttctggttcgtgaatgaaaggttatgggtgacactgtatgtcagtgtggcgcttaccggtttatgaagggcctacatgtgcaatctctacaggaaccacttcccacatggcccctttataccaatgaggaaatgggcccccggagatgaggcacttgacctgaggtggcccaggtggtaaggagaggagccagctttccaatgcaagtcccaatttccagtctcctgttgtttccaccgtgtctccctgcaaggcggctggggcacgcagaacaacagcttgacacagtgggaagaagctgggctttaatgtttagagttcagagttcagctctgctcccctgcctgctgggtgaccttgtggaatactcctaacctctctgagcttcattgtcatcttttggaagatgaggccctgtcctacaggattaaagtatttaaatatagagtgcttaccataaaacttgcttctaggaagcaactggtcagtgttaactccttaatgaggctgaagtagacatggtaaaactagttgtggaaagagatcctataaagcaaaactgaggacacatttacatataccaaggggtgcccagccctgttcttcctgcacatagaatcttaaatgtttcctagattgagccattaatcttcgattttttgcaaaggaagttaagacagagataccaagtgccttgcacatagtaggcctgtagtaaacacagactggatgatcaactgctctttggaggagcagagagtatgcctacacatcatttgaataaaatgtgacagcctgccagagaccagactttgaaggttatagacccagggcacgtggccagagcagctgtcagtggaggtgcggcctagagcgggtagtgtggaggctggagggggctgttccatggcaccagggttgagtgggagtcagtgcagacttaggagagggaatgtgtgttcggggatggggagcggggagggacttctctcagacacttatatggaatctcaggtcatacagagacattgtctctgtgttttatattttcctttgaggacatctccatttaagtagctgatgcctgagcggggagagaagaatgagccttttccttctgttagagcctgtagctgcctcttcagggtcagactttaaggtgtatggggacaaagttgggtcagtgtttgtagaaaaaaggctctttctccatttctccctcctgcttaatccaaggagcagagaacaccagggaaactcggaagtagcggggttgatttgggagctagatggggcctgacatatgaagctgctacctggttacagccaggcagagttgaaagggtgtcctttggcggggtgagaagagagcagcctccaaagattcccctgcaccccgccaggccctgccaggggcccctcccacagttctttgctccttccacggagcctgtttgagaattcagtgattcacttcccgtcgtcaactcttgtttaacgttcccctccattgttaccaaacaatccaggccccagtgatgtgtggtgttctgagagtagaggagggaagagagagagagagccagaactgtttacagagcccgggagatgggcccaggcttgacagccgggccgacttgaaagacaggctgcagtggactgtggccccaacagctgggtgtgtgcagggtgggaaatgccaggcacagccgctcctccacagaaaccactctgttctttctgctcttgatggaagctcctgccctttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctctgatttttgaggtcagtaattctgcagcctccctcacctttctggtttaaagcaacctcctctctcaggaagttgtttgaaatcaatttaattcctttatatcccacatgacagctacgactgccactgtttagttgatgttggcgtcgggtttggggcttacttggcttttgtgtttgcttctaacctgcagaaagagtcaaagttctgaagttttctctctcatcctttctgtttgttgctccatgtacagtagggaagaggaatttttgttggtagtccacatttttgattacttatttgctctgctgctatattatgattcaggttttctccaaggccctaggtgcctaaaagcattgaaggaatgagaagtgtagacacagaacacctttaagccacttccccctgcaaattagtgtatttcacaggtatttggaatgctagaaggtactagaaggtgagaagacactagagatccgttgaacccatcattttttaaatgagataatccatacctaaagactcctccatgagtcggtagcacagccagagggagggccacacacacccctgtcatctaatgagcagccagggctccagtccatccccagtgtgggccatatatctgtgtgctttctcctctattaaatccaacacttgataaaaatctccagttaacaaatatttgttgagcaagtttattgcaaatcgctgtatttaatgtctgcctacaaccttagccacagatgactctctctccctggtatggcaagtgggcagagcttcctcattcaaaaacattttagcttcctgcacttccccgctggttgctttcgcctaactggcacctgtggctgtcattcccctgctgtttttaattgcacctctcaagaccagctgattgcttaaagaacatttctggtattgggcccatggcagtaatgtgcgtctgtggatccctttgctatgaggcttgacttcttgatcgggttcacaaggctggtgggcagcctgagatctttgcttatttcctacgtcttctgaaaggtactatgaagcttaccagttgctgatgcacgctatcagctaataattccattaccattactattttctgagcaaatgtgacctgcaagcccctcgctccatccaggatgcaggcaaagttaagctaggtttcctttccctcaaggagctcctggcacagttgggaagggaagtcagaaacacacagaagtcacttcatcataccaggcctttggtgctaaatgatgatgaatttgaagagtgtgggacagtggggatggtggactgtaagagttcgaggaggggaggatggagagaggtcattcttagcagagagccacagagtgggttactgtttgagctggaagataattggacctccaagggctctgtccccacctgcacctcagcgcactatgctggtggccaagagtgcaggagcctcacattcagatactgtggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaaccctttgcttgttcctgattgtagctgttttagggatgcagctttcagacaagggccacttagttgatgaggccggcttaatcgaggagggctgttgccaccctgacattgttaagtgtgggcctggcttctctgaagtcctcctttcttgcttgtgtggaattcctgttttcctgcccataggggttctttgctgtcttaggtgaattgccccaatgaaccagaacctttttttttttaggtacaataggaggtctgtacccttagacagaaaggaatgctaattggccacttaactgtcctcagggtacagatgccagaatatacagggcacccattctttgttaccatttgggatggaaactgcttatataagcttgtaaagctttggttcagaaagcaagagaatgtgtatggaacgttagcaattgctgtcatgcaaatgctgcattttttgcatgtaaaggtacctctttacctccatggtccttaaactaactttttcaagaaacatggtcatttcccacccttcctttacttccagctccccattcatacccaacagtggctaactgaaaggtttgcaaatcctgaaggctttggggcttcttttaaaaagaagagactgagttgtaaatgtcataagactgagatggttgtaaatgtcccaaccatactgtgtgacatttgctaggaattgttgtaaaatcactggagtgagcgcttgtcctgaggcactgcctctccgcgtgaatgtcactgagtcgcccggttgacccgttgcatgttatgcagcacttgtgacattgttttatctctctagccggtgactcataattaaggaagtcaaaactgtgcaattaacacaaaacctcctcatttgccctcttcacctctccccaacccccgcccccagtcaggaatgcccgcctgacattttctctaagtctttggaaactttaagatttgttttgatagaacaaggccgccagttatcatcgcctggttccacttgttttaccccaaaagtctgtgagaatcttttccaggaaaaaaaagaaagaaagaaagaaagtaaatcccacccccaagcgtgcagtctgcccacaggaagtgattcatggtgctccgattcgggcagacctgactgcaggaggcgggaggctgggaaccaggtctgggaaaagagggcagagagaggatacccagacctaatggcttctgctctgtggaagaaagtgaaaaacagaatgactaagagtcctgtaataagaattgtttgttttgtgaagttgaactaatagtgaggtttgccggcagataagacttgagaaattgcagttgtcaggggaggggacttttccatgtcctgctttttttttttttttttttttattaagagagcaaagctatttctcagtcttttttttttttttttttttttttttgagatggagtctctctctgtcgcccaggctagagtgcagtggcacaatctcggctcactgcaacctccacctcccaggttcaagtgattctcttgcctcagcctccccagtagctgggattacaggtgcccaccaccatgcctggctaatttttttgtatttttagtagagacggggtttcaccatgttggccaggttggtcttggaactcctgacctcaggtgatctgcccaccttggctacccagagtgctgggattacagacgtgagccaccacgccaggccttatatctcagtcttaagacattcatatattagtggaaggcccagatttgtgtttcagttctaccttgccacctctaagcctgttttcttttctttggagaagagggtctaagatgagaccattatctcacagtctccaatagctctttctccccattttcccttttatttatttatttatttatttattttgagacggagtctctctctgttgcccaggctggagtgcagtggcacaatctcggctcactgcaacctccacctcctgggttcaagcgattctcctgcctcagcctcctgagtagctgggactacaggcttgcgccaccatgcccggctaatttttgtatttttagtagagacagggtttcactatgttggccaggctggtctcgaactcctgaccttgtaatccacccacctcagcctcgcaaagtgctgggattacaagcatgagccattgcacccaggctattttccctttttcctttccctctaaagttagagtttttgaaaaatatttgatttttttaaattgacaaataattgtccatattcatgggatacatagtgatgttttgatacatattaatgtcattatggtgatcacatcaggttaattagcatctccatcctgtcaagcatttatcatttctttgggttggaagcattcaatatcctccttctatttgaaactatgtaatatatgaatgttactatgtatgttactatataagcattcaatattctcctatttgaaactatgtaatatatgattatacatagtaacaatcatatattacataataattgtaaactatgtaataataatattgtaatatatgattgctagatatttgaagctatataatatattattgttaagtataatcatcctacagtggtttaggacactagaactgatttttcctctttagctgtaattttgagacctttaacaaatttctccccatccctctgttccctttacacttttcagcctctagtatcttctattctgtttttacaaagttagagttttggggctgataaatgtttttacctaaatactcatttttgtttccaccaaatggaacatcatgttgtcgtagaatgaaggaatcctttctgtcctatgggttattttcttctccctcaaactgacaatgcaaattaatttgattccccaaagtagtttggaaacagagaagactctaagtgttggctacatgaacaggcctgctgccgagcgagaggcccagatcacccagaatgagaagatgggtctaaacacacctggctttgtgacttactccatttcaagcttcctgtattgttggaggtcagcttttgggggtgagggattttaatgaaagctgaggtgaagtccactgttgccttaagcccatcagaacgttgccaagggctgtgagtatgctgaatgggtccatgagtgatctcttaaaaaaacataaaccattgtcaggcctaattttcagcagagtgaaatggccacccagaagattctgtgaagcctggcaacttttccctttcttccagtagtcacagaccaacccagatctttgtagcatcttttatttgtgacttgaaagttctatgatcctgctgacactcaagaaaaagcaatccccatcaacttggtgcttggagaaaaaagtttgtgaagaccaaagctattaaatagaaaagccctaaacactctcctcctcctcctccttcaatatttaaccgtcttctttgcatgggggaagggaggggctctcaccacagccaaaagagaatctctgctgatttaaacccagtgtgctttgtagtcatagagaactgagtttggagtgtaacatctaggttcaagcccaggcactgttccttgctgggtgactttgggcaagtcactcagcatcaaaaatttttcatctgtaaaatgggagtgatgagatactcagcctgcaggatccctttatccagtgagttactgagtgagaagtgctgggtaaacgcttgctctgaggtgtaaattgcttctgtttggccaggtgcagtggctcacgcctgtaatccaagcactttgggaggctggggcaggtggatcacctgaggtcaggcgtttgagaccagcctggccaatattgtgaaaccccgtctctactaaacatgcaaaaattagccaggcgtggtggtgcatgcctgtaatcccagctacgcagaaggctgaggcaggagaatcacctgaactggaggttgcagtgagccaagatcactccgctgtactccagcctgggcaacaagagcaaaactccgtcttggggggcgggcgggggggattccttctgttttcccgcatcttgctcatctcagagcatttccttagcccagggggatctcaaggggagggaagagagcagatttgccccccaggggacatttggcaatgtttagaggtattttttttcagttgtcacagctgcaggtgggtcacagctaccggcatccagtgtgagggagccagacatgctgttaagcattctatatctgtctctacacaggacagccccccagccccaacaaagattagcccaaaacatcagtagtgccaacgttgagaaactctgggcctcgccaaatccatagcctgatgttgaaaagttcttggtgtctgcgtgctttacagataattatcatcaggctgaactttctccagtaaccaaccttcttcttttccagaaagtacaaattctgtgcccacccatggcccttgggaggtgggatagcccaaggtctaggcgatctttgtgtgtttccagtggagtccagccctcccaaggataaggcaaggtgtttcttggcttccccctccaaggatctgcccaggagccttctgcaacctctgtggctcctgcccaggttgccccatctgcctggggcacttgtcatggacctgagccggctgctctggagaactagcagagggaaagagaggactaaatataatgggaagaagtgaagaagaggccagctgctggtctggaggatggcatagggggctgcagcctggcattttatttggtttccccctagactggcagcattcatgcccaaagcactagatattgtccatttataagttcagatgaaaattgagttgttcttggtggaaatgttttagtgactggtatcaagggttatgaaatcctgttttcagctcttcatgtccaatctaaactggaacattcaaaaacatgcttagcacacttacagaacttgttgagaacactcaggaaactcagctacaggcagagcacatggtcactgtggtagaacttgcagtgagacctcaattatctagaacctggccaaccacatacttgacctcactagatgtctttgtggcaccaaatgaaaagaacaggctaatgttggaaatggagtttaaataaacaacaacagttttaaaaatctttgaaaatgccagggtgtagtatattcagtgtacatcctgagttctgtttgtaactctttgattccaagcttcagaaaattacaattataggctaattttttatactactactaatcgtaatataatcaaattatatgtctttcaaccagagtcaacaactgctcagtccctttttttaaaaaaaaattaaaaacacttgtcatcttaaagaccttcagacaacttaagattcaatacaacaaagaaaaaattgtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcagagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacaagcagaatttttttctgccttcccagaaggtccgatggaatgagcacttcacccaaacttgaagtcactcaagtcttgcttttattttgaaccagaaaaaaagaaaaggaaaacccacgtagaatgcaaaatttaagtaaagatttttgggccagtcgcggtggctcacgcctgtaatcccagcactttgggaggctgagttgggttgatcacaggtcaggagttcaagaccagcctggccaacacggtgaaaccccatctctactaaaaatacaaaaatttagccgggtgtggtggtgcgcacctataatcccagctactcaggaggctgaggcaggagaatcgcttgaacccgggggcagaggttgcagtgagccaagatcgtgccattgcactccagcttgggtgacaagagcgaaactccatctcaaaaaaaaaaaaaatgtaattgcaggtgagtgaacacggggatagtagggtagcttgattgctgttcaaagggaaagagatggggaggatatgaaactctgagggcagatgggcatatatctgctgcagcatgtatgttctgggaacatgtgtgtatgtaccagtgtgggttcagggcattcattggcaaccccaagatctaaaacagctcctttttgtccattaaacatagcagatgggaaatgtaaagatacagaataaatggaggtgaaatgtatgccgtaggtttggtttttgagttattaatgtgctacttggggctacttcaaaaaatgaatattagaggagtatttgggggtaagttcacattttatgcaaattgactctaaggcctctaggtaggttgtccttctgaaatggttaagtcttatccagcttcaagatctgggcataggggtatgccccatttagaattagggaaaagaatctgagtcatgcagcctagcttcactttatattaactctgggaaaagttaggaaagttgggtaacctctcaggtgctctgtttctcaatccatgtatggagataatgatacctgcaagttaattgggaaaactggtggtggagtcagtgcatcagtcagctagtgttgcgtaacaaagcactctaaaaacccagcagcttaaatccattgtttatgctcactcatgcttctgtggtggcttacctgggcttggttccttgctacagatttggtttaggtctgctccacatgttttcatttctgggcccagcctatggggcagtagctgcctgggggtgggcgggtgggagagggaagtcccatgatgatggcagaggtacgagaggacaggcagagacatacaatggcagtctgtcccttctgctcacattccactggccaatgcaagtcaatagtctaccccaaagtcacgggacaagaaaatacatgccactcatggtaggaggagtggcagagccacagagcaaaaagtgtggctgcagagaggggtgactaattcactctgtcacagtcatcaagtggccaacacagtacctggcacatagcagcagtcacttccacctctgttgttactattactactcaatgggcaagttgaaaaagaaagtttgtctgaaagtgactagaaagttcggtattaagagcatgtgtgtgtattcaataaaataggtttcaactgaagtgtgataatgttaacaaatttactctttgttcacttctatggcccagttaactggcacagttcttgggatatggtaggtattcaataactatgctgtgattgatgaatggtcacttttaataatggtgatgcagcatgggatgacagaaaaagcgctgttcatccaacctgcccctatctcccatgtatcagccctggtctgggtttgaatcctggctctgccatttacaagttatatgaccttgggcaagcctcctgagttctctgagctgggcgagggtcctgggggtgttgccgtttctgcgtgctcacatagcagtcgtgtgcctggcacgtagttcatgctgaatggatcttggcatgtttctggaacttatgtgctgtgctcctcaccttctccccagcctctgtgttgtcccacagatggctgtgagtggctgatcggtggaagtgcagacgtgagtagcacttggcatgaggtgggccccagccccaccctctctccttggggtacactctggcaggcttcaccttcaccatcggctttgggctctgccatggccacatccttggctgtggctctcaccaccattttgggacactttacgggtcccgcttgaagccaatgggaggaaacctaatttcctgccacaggaaattgttctgctagggaagaatatatttaaggattaaaaccttctgtcagaggaacttgagggagttgctagagaaagacctttgggggtctctcatcaggaagccagtgggtgtgggagagatctcagtcataaatggggaggaggcccaacggcaggttcctgagactgtactcctaatgctagcagctggtcttgggctgggaggaagggctgggccagggagaagagtgggtcataaatagaccattttctgcaaccaagcatatttatggtaacatcagctcagaattaagacttatttattggatttacttaatgggcccagtgccctataaggcctgggagagtgtgttctggacacatcagctatattaaatccagcagctgaaactcccaattcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttgggaattgcatggcacagagaagcaggggcatggtccagatgacttttagaaaatactgccaagccagactggcggtcgtgtgctcacaagctggagagtgagaggtgcctgtctccttgctatcagaacccagcctgacagccaggagtcctggccacttggcatggccctgatacagactgctgtgtgatcctgcgacatgcactttgcctctccaaggtatgggtgtatggtgaggtgggaccattgtaagatgtgccttattatccacacggcattgtggtgagaatgatctgagataaggaacacagaagccttgtgaacattcaaagcaccagacagacatgaggactcactgtgaccctcctgactgtgcacccagatggccaaggcagggaaagagatgtgttgttgaggacctaccgtgttccttactttgccggccactatcatagtaagcaggcagtaatagttacatgacaatactgacaatagattcctgccactttctggaatatctttctgggtagtgtctgttcaaatcatatatctctttttttaaaaaaattggattgttaatactgagtgttcttactaatatttcattaaaaaaatttttttaatccctctgggggaaaagaatttttttttttttgagacagattctcactctgtcacccaggctggagtgctctggtgcaatcacagctcactgcagcctcaacctgctgggttcaagcaatcctcccatctcagcctcccgagttgctgggactataggcatgggtcaccacgcccagctaatttttatattttttgtagagatggggtttcaccatgttggccaggctggtcttgaattcctgggatcaagtgatccacctgccttggcttctcaaaatgctgggattacaagtgtgagccaccacgtccagtcagtgttttagatgaaaaatattaagaccaagacactaagtgatttttttcaactttgtacagttagcaagtactgaaccattatttaaactgaggcttattaagtccattgcctttttttggaatggtggtataatttataaataataagccttgcatatttaaagtgtgcagtatgacaaatgatgatatatgtatatacctatgaaaccaccatagcagtaagagaatatacataacctttactcccaaaaaagtttccaagtgcaccttggtaattgctccctccaatccctactccctccctgtaactccctctgtccccaggcaatgactgatccctgctttctgtcactagattaagattagtgtgccttttactttagtttaaattaccttataattttacacgaacagaatcatgcctggcttctttcacgcagcatcattaatttagattcattcatagcgttgcatgtatcagtagttgatccttttttgttactgagttgtatttctttgtatggatatgttatggctcattcatctgttaatacatgtggagtagttttcaatttggggctattacattcatgcacaagtctttggacataggcttttatttctcttgggtaaatactttgaagtggaatggtggatcatatggtaggcttatggttttttagctttttaagaaacttccaaatgtttgagggatgaatatcccaattacccagatttgatcattacacattgtatgcttgtatcaaaatatcgcaagtaccctataaatatgtatagctactgtgtatcccccaaaataaaatattttagaaaggaacttccaagctgttttccaaaatagttgtaccattttacatttgcaccagcagtggaagggagttccagttgttccacatccttgccaatacatggcatgatcaggctttttaattgtagccattctaataagtatgtagtcctatctcattgtagttttaatttgtgcttctctaatgatcaacattgtcaagcatcttttcatatgcttgttgtcttcatatctttctgggtagtgtctgttcaaatcatgtatctcttttttaaaagattgaattgttggctgggcgcagtggctcacgcctgtaatcccagtactttgggaggccgaggcaggcggatcacgaggtcaggagttcgagaccatcctggttaacacatgaaaccccgtctctactaaaaatacgaaaaattagccgggcgcggtgccaggcgcctgtagtcccagttgctcgggaggctgaggcaggagaatggcgtgaccccaggaggtggagcttgcagtaagccaaggttgtgccactgcactccagcctgggcgacagagcgagactccatctcaaaaaaaaaaaaaaaaaaaaaaaaaaaaaaaaaaaaaaaaagaagattgaattgttaatattgagttttcagagttctagaaacaggtctattatcaaatatacgctttgcaaatattttctcttagttagtgcttgcctttttattcctttaacagtgtctttcaaagaccagaggcttaaatcttgatgcggtctgattttttttttattattattaagtgctttttggtgtggtatctgagaaatcattgtctatcccaaaaagtcacaaagattttctcctgttttcttctagacattttagagtttaagtttcacttcagtttgtttttgtatagggttacaatgtgtagtttgaagattatcttttttacatatccagttgttacatcaccatttgttgaagactgtccttgctccactaaattgtctttggacctttgttgaagccagtcgtccatatatatgtaactatttctggactctgttaggttccattgatccgtttgtcagtccttgtgccattaccatactgccttgattattgtagctcccttgtttttaaaagtttaattaatatccaagtgattcatgtatgattaatattactactaaggcaagagggccacccacttctatcacctagatggagcttacctccacagccccattctcccccgctgctggcatgagcttttctccaaggccttctcttgcagaggaggctatgatgtccagctggcccttttttgggagttttgtcaaacaccgaagagcaaatacggccacttccctaatctgtgggcacccagtggctttgcaggagaaggagaacagctgaataattctctattcccactcaccacttcccactctcccttttactcctgttcaacctccagctcaccctacttatccagggctgggtttggggagtatctgctgtgatagagaataataacgctaatttgtgggtgtttatgaagcactttcaaatggaaaccaagcttcaggaggtcggggggcagaataccccattttatagatgagaaaactgagtgtcctaggaagctcatgagctgcccagtgtctcccagctaggagagtagaaccctcctttaccccaggtcttatggctccacatccgccagtcctccttttatacctcagggacgagtcccaggctgtcttctcgatctgcctggtaattactgtttttcagctgtagggcttccttgttctggggccccaagggaggaaggtaattacatccttcaagatgcccttagtcagcagctccaggtcagttcctgtgaccaagcccagctatgacctttgtctgtcctttccccttcccaggccagtggcttggagagtgtgattggatccctctgtttctctctttggttggtgctgttggtggcatctggccagcccttccttcacagagtgcccatgaattctctgtattcaggcaaatgggtgccctcggtcataagaaggcacagagggaaagcttgcaaatgtctcactgccagccctgccagctattagaaaaattatggcactgactggcagggtcctaggatgggcctccttgaagaaaaagcagtcctgcctcttaatagggtacctgtgactcatgagcatccatctcatctgctccccacttctatccctgctacccgcaatctgttggtcacacgtagccagagttccacagggcctgtctctttcacacgtatgcacagcccacttacacatctcagaggctacatactgcttttagaaaacaggagaagcctttatcatggcctttggggccctgcagagtacccctgcctgcctccccggcctcgtctcaagccagctctctctcatgatcccctctccagtccttctggccttcattctgttcttccgacctcaccatgttttccactttccacagggcctttgtgtgtgcctttccctctgcttgtactgcccttctcccgcacccctttgcctggttagttcttacttaccctttaggccttcaggtcaaccatcacctcctctgagatgccctgtccagtccttcagcaaagtggggtgccatggtcatacactcttggggttccttgttattttcgttcaggacactttcattgtgtgtaattgtaggtttctgtgatgatgatgatgatgatgatgatgatgatgatgatgatttgaaacggagtcttgctctgtcgcccaggctggagtgcagtggcacaatcttggctcactgcaacctccccctcccaggttcaagtgattctcctgcctcagcctcctgagtagctgggattacaggcgcccgccaccatgcctggctgatttttgtacttttagtagagacagggtttcaccatgttggccaggctggttttgaactcctggcctcaagcgatccacccgcctcggcctcccaaagtggttttggtgattatttgattaatgccggtcttgcccagtggaatggagggtccctgcagacagggaccactttgctggccttttctcatagtgaagtctctttccttaccactgtatccttagtgtcacacataataggtgctcattaaatatgtgttaaataagggactccattttagtggcacctcctcacctgtctaataccagacactatctgaagttttacgtccctccagaagccttctgcctcccagccttgcctgtagctgacaatgcttttgccgccccaagctccccagtcctttcctgtaagccacccagactctcatcatccagatcacctggggatttcacaaagggaaagattctgatttagtaggttggggtaggcgctgagaatgtacatttttaacaaacttccctgaacctctgctgctggtcagggaccacactttggcctggcttgagaggtaagggcaccgggtcatagctgcttggccaaatcaccatagaagacatggttcacacagggtcatggcactggccaattgtaagtaggcacagtagtgtgcccctgcagtcccagctacttgggaagctgagctgggaggatcacttgagcctgggaggcggaggttgcagtgagccgagatcatgccactgcactccagcctgagtgacagagcaacaccctgtatcaaaagtaaaaaaaaaaaaaaaaaaaaaaaatccctttaatttccgtctttcactccctgctcaccacaaataactaaaaaagaaaggaggggccaggcacggtggttcacgcctgaaatcccagcactttgggaggctgaggcgggcagatcacgaggttaggagatcgagaccatcctggctcacacagtgaaaccacgtctctactaaaaatacaaaaacaaaattagctgggcgtagtggcgggtgcctgtggtcccagctactcaggaggctgaggcgggagaatggcatgaacccgggaggcagagcttgcagtgagccgagatggcgccactacactccagcctgggcaacagagcgagactccgtctcagaaaaaaaaaaaaaaaaaaaaaaaaaaaaagaggaggaaaggcaagttttctttttttcccctgactttctaatgtgcaagggaagacctgagtgaatgaggggagacagcctttgtactttgtcactcttctttggatcactgtagtcctcatatctgtgcctaaagaactctcattgtcttccccagccctgtcccctctccacacctctgggctgagtaggaagccgatgagtggctcctggaccttttccaagcacaactgaagtgactgaagtgcgggcccttcccatggaatgccactccctgaagagcagtacaaagttggggaacccaccggggactggtgggtgaggcccgctctgccagctgggagtcctcacggggcctttgttgtcttctcctgagatccctcccagcactctcagctagcagtgctctgatctcctggacctctggatctgggagaaatgaggggagagagagctttccaagtgtctgaaagtaggaggccggactctgcagaaagcaagcacaatccacatttccctctctttctgcccctccccgtcctggcaggtccctggatggccggttgcaggtgtcccatcggaaggggctccctcatgtcatctactgccgcctgtggcgatggccagacctgcacagccaccacgagctgcgggccatggagctgtgtgagttcgccttcaatatgaagaaggacgaggtctgcgtgaatccctaccactaccagagagtagagacaccaggtatgctgcctggcctgcctgtggggacagcaggtgccaggggtcatcacctctccccggctccccatccccccgagggtctgcggtgcacttgggggtgcggggactttggtgctggtctggcatcgacactgagccacctctgctctgtctcccccggacagttctacctcctgtgttggtgccacgccacacagagatcccggccgagttccccccactggacgactacagccattccatccccgaaaacactaacttccccgcaggcatcgagccccagagcaatattccaggtaggcacgtgggcggcacaggctggcctgggaggcaggggcagcggtcagccccgacatcagtcctgtggccccaatctctgccccctggccgtcccccgctcaccccctctttgcgcacagctctggcctgagggcccctgactcagaaccgcatccctgttgggagaggacccatgacctcagctcccccctcactagtgatgcttttcttggcatagaggagcagcgtgacccttccgcccggccttggtgcagtcatttattttggaagcggaaatagcaacactgtttctctcaccgcccttgaggcccggactggtgttcagtcccaatagactgggggtctgcagaggcggggagtgagctgagggccaggcagcaagtgcggagagctggctctgtaaattcgcctgggcatcaggcctcggtgaggggctccaacctgggtgggaattgaagtgactttgagttttcactctgcagggagaaatgggctttgccgtcaaagactgcaaatgtttttagaagcccctcatttacatgcaaataacgtgtgaatcaccagcactttcagactccaggaaagctgtgcttggcagcacttgggctagtcacttttgcttgctggggcagtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgattagcagctggtgggttcatcccttccatcccttcctcttcgccctctccctccctcccttctatctctctctccagtatttgtagagcaaccgcgatgtgcaaggggcagggcatagaagagggtccgagctgctcacagatgatgggggagattgacaggacagtcagtagtcactgggccatctcgtgtatgccctgatggaagatgccgcatggcaccaggcacacagcagggccacttcacccggtctggggaggagcagcaccttgcagtccaggtttttccccaggttgagtcttggtgatgtgtaagtgttagccaagctgttagagtgggcaaggggtgtgccaggcagagtcatgggggttgggcaggacagcctggtgcattctggggacagtaagagctcagtgtgtctggagtccagagagtgtctagcccagggagctcagcgtggctggaggatacactctctccagtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccatgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcccagacagagtctccctctgttgcccaggctggcgtgtagtagcgcgatctcagcttactgcaacctctgcctcctgggttcaagctattatcctgcctcagcctcccaagtagctgggattacaggcaatgcagcaccacgcccggctcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatctgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgcgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatccccctttgcatttggggttacaggggagaaggagaaatccgtggttcttcccttgccctcaaggaggttacagctgagttggggcaaaagaagagattcccacaaacagcgcaaggcagcattcacttgaggccagatgctggacccagtctcaggactgatagatttcatggggtggaattagaccccatagggtggttaacaaatagtctccttttttatttttattttttgaaacagtctcactgctgcccaggctggtgtgcagtggtgcaaacacagctcgctgcagcctccatctcctaggctcaagtaattgtccagcctcagccttcaccacttacggcttatttttttttttttttttttctgtagagacagggtctccctatatcacccaggctggtctcaaactcctgggctcaagtgatcccccagtctcagcctctcaaagtgctgggattacagatgtgagccattgcacccggcctccgcagccttcttgatagaggaacagaggagcggggacgagcaggatgctgctctggaaaagtgtccactgttttatttttgaaggctgataccatgtgagttctttttttctggaggtgagaggtgtagagaacataatagagtaagaattgggtagattgagactttttcccacgtgcatcatcatcttttgcataaagtgtttgtctggttgctgagttgcagggtttctgaggcaggtttgtgagtttcctgaaattgatctttccagcacctgagctgctgcagcctctgaccaaggtcggtggctggtgatgctggggaggcctcaagccctgcctgtgtgggagggctggcctcctgcttcctgggtctttgcagcttgggagaagggcttccctgctcctctcattttcctgagggcatagttaatagggcaggtggtgtaagctaaagaaaaaatgtgtcacttattctagttgagaatttagcagccctgagctgggagtcttggttaggatcataaaactatctgagacctctgagatcataatcataagagacctctgagatcatccactcaatgcattcattccagacaagaaattggggcccagggagggaaagtagaggcaagggtatgggctaggccttctcctgggacccctcagtccagggttttctttctgctgtgttgggctacccctccttgatatgtaagtgtttagtaacttggctctccaggccaagaatcttttgtgaagtctcacaacttgtctcacctcgcaggttctccaaacctatccccgaatccgatgtccccagcacataataacttgggtgagtatctccttgtgcacacaactggaaccccctctagctgcagccctggcgagtcgccagtgtggggagggggccctgaaggtaaggctctcccccgacccctaccatcagcccagctcagcccatcaggtttctggttacggtgatgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatatacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttccaagactcaattttctaacccagtagggtccttcagttctccagcttgggataggctttggcatggaacctgccaaagggcttcaaacaaatgaaatatccatttagtttttattgaggggagatttttatattctggtctggtagttttagaaaatgtaagttggattttgtttggaactttattgctgaggcttaatttgtggctcaggaaaagaaatagttaatatttcttggcgaatcaaagtggattggactggtttttgtgcccatttgcttccagaccttgactgacagcgtcagatgaagaaactcatcatttggaatattaggagatgcttgaaaccctttagaacaggctgacctgggcagtgtgggatgtgactttgggagatctgttttaacatttttgtaaaataatatcaccatgagtgccgggctttgcagagggaaggtcagattcctgatatgaaaggactgagttattaaaaacaaactgaaggctagaagcgaagttaacacttgagaaattaaaggccatgatggtgaacttgactccgggctttcagcttttgagattggctgctttagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaaacatttcttgagagtttgctgtttactgttattcggagtgcttcctgcatgttaacctgatctttataactttataaggcagaagcgttgtgatttttcattttacagattaggaaaccggggaacacattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgccgttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtccatgtccacctgtaatgcgttgtgccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggaggttttctgatgacagcttcataaagattaatctggccactgtgtggaatctaaattctaggggaaattactggaggcaaaacaaaacaaaacaaaacaaaaacccacttagacagctcttcctctggaggaggctgagataaatgctttcgagaaatggtagcagagctgggagaatgcatttgagagggaatcatgggcctgaatgagcagggtttgttgaccagcgttaagtgggatgatggtgatgcccccatcgaggctggacacccaggaagtggaatgggttgggggtgaaagatggtggtgggttgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggcggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcaggggttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaataaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcttgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgttgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgagtgtggacggcggcccagggcagaggcccaacccagttccaggcatcttcatgctgctgcccaaggctcttttacaatgcagcctctggctccggtcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggagactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaacgtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctcctgcctcagcctccagagtagctgggattacaggcacccgtcaccacacccagctaatttttgtatttttagtagagacggggtttcgccaggttggccaggctggtctcgaaatcctgacctcaagtgatctgcctgccttggcctcccaaagtgcttgggattacaggtatgaaccactgcatatggtctgtttttttgtttttttttttgttaaggaaaaatgtgccattgaaggcagaacccacaggtggtgaccatactttctggtctgccactcctcttgcacaagttctgggaggaagcagctgaggcatggtgggcgggagggacctagaaaggagggaaatcacggctggcttttagttgtttgcagagaatagaaagcgcatggctggggtgctgctctggctcagtcccgcttctgaacacagggcagcttgtccaaacagcactctctgaaatggcagcctgcagactttgccactggcctgatttcactgctccctcaaacaagcatcttcttaatgatgtgtcaggttcctagtgtccggggttttccacaacactgtccggtgtgtgtctgtgagttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggatttttttttttttaagtttccaaagcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtctgtgcctgagccaagattgacctccagtctgtctggaggatggctttatagcttgtgccccatgatccagttaaatatctagggcaatggttttcaactggaggccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcaccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctcaggaggaaccctcagccccatgctgagggttaaagcgagggaggagagatgtcagcctgggccctgggacctcatggtcaagttggacagtcaggatgctcacagagaggcacacccttagtaactgcgtcgcttcgggtatatttaagagccagagggacttcagaggcaggctgaagctttgagatggaagagcgagaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggaggccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataaataaaaagagaaatcaatggccctttacacacaaggctgatggaatctcctccagacacctgagcatcttgttctggtggctcttgccagttttatacgataaaaggcatggggtagggagattataatccctctgaaatgcggggaaatggttttccagagtgtccatgggaccccatcgagggagcatggggcttgggacacccaatgacccagtagcccaccctgtgtccacagacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggtatggggtggctccattccccgcccccccaccctgcccctgccactctatcccacccccagccccaggcctgaacacacagcctctgaagggaaccttgcgtccatccttagctgtgctctgcctcctgctgggcatgggggaagactcactgccccagcaagtcccctacactctctgttgccctgtttaggggccagacaggtagtgttcaggccacttgatcattcccactcaaagatataatctcagaaaatctggaagccacagaggaaaatagttcatctaagggatcaagaagggaacgtctatgagaaaggcaacatatgaaatctattttttttttttttttggagacagagtcttgctttatccaggctggagtgcaatggcacaatcttgcctcactgcaacctctgcctcctgggttcaagcgattctcctgcctcagcttcccaagtagctgggattacaggcacccaaccaccacgcccagctaatttttgtgtttttagtagagacggggtttctccatgttggccaggctggtctcgaactcctgacctcaggtgatccacctgccttggcctcccaaagtgctgggattacaggcgtgagccaccgtgcctggctgaaatcctctaaataaaaatactctgaaagtacagatggataggttgataagtaggcagtcattgttggaagagtgatcttctcttattttcatgtatcattattctaaacaatttagaaaaggtagaaaagaattgtccactatccaaacaccactactgtgaaccttctgccttctagcccccagaacataagtaaaagatgactttgtgagtttaaggaagatgaagctgtgttacgcatcacttggtttgcttatgaagttatcaagcttagaggattttacgatccagaatcacaactgtcagaacttagaagggctgtagagagatggcagagtgaggttttctcagaccttgtcctggagccccaagggttggcaaagggttcctgcggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattctcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacaatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggagagagtccacctttctcaccttttctgctcactcatgattgcgttgtcaatctggaggtgattggattaggttttctctatgcccacagatctaactgtgctttccctgaacttccagggagcagatgtagcatctgataggtctgcctttaacctgtgggtacctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggaggagaaacatccggatcctgaaggataggtaggcactaggcacagggagggcattctagacagggggagcagcccaggcaaagggcctgaggtaatggagggcaggacatggatgggtagctctctggctggaggagggtcatgtatgagaccgtcaggggaaatgtttcaaaagcacaacagcatgaggccgtggaaggacaccagagagtttgactctagggaactgctgagggttttctgagtgagcctgaaaaatcccacctgtaccccaagaagaggtgtcaggctgcacccccgagagtggtttggacagggccacgcctggacagcaagatcaggcaggtggctgatcccatctaaggcctctttcctcaggaaaccaaggcagaaagccccagccaaagtccacttttcacaggacgtgcagccactgtgtaggcagcccacagaacatggcctgtgacagactagtggagcaggtaacctggccaggccattgcctgtggcacgtgtgtggcatgccccttcctgcccactgagtagcagatggtagtggagaagtggtagaccacaggcaggggaaactttagaatgcagaaagtctgaaatgataatagcacaccaggtttccagagcattttgtggttgcatttatagagtacattccgatcgttgacctcatttagtcctcaccagttattctctggctctataagtaaggagacgctttgagagacaagttcagagagtttcagccacctgcccaagcgcacacagctagtaagtggccaagccgggatggggcctagggctgatggactctcaagtttggtgctcttctgcttcttggctctgctgggggtcagggcccaggttcagccctgttccaccacccttgtccttggagagaatgaagaagaggaagctcagtgacgctcttggccttctgcctcttccattccccggccccacccccatcttttgggtgagggctgagttggctgtggtgttgtttgtcagctcatagaatgtcagagctggaaggacctctgaggccagcccttcattatacagagacacagggtccccaagagaaagcgaccagctcagagtcacacagcaagaacaggagcctgctgttggctcattcataagcgtcaccccggctcaccttttggctatttccagcatgtgcttttgtctttatttttctggttgacacattcctggcactcaggcagtaagacttcaaacgacatttattttaaactttatttgtgactgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggtgactctggacagcagagcaggcagggctcctcagagatgagctaggccagccctagcgtcaagagcagaaagaccaaagatcagagagaggccaaggcctggcaggcaggaggggccgggccaacagcagatgatgaggaattgcagaacgatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttcttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtggagaagggaaatatttaaagatggactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacctctcacctccagctggcaccagcgactccagcctcagcagatagcctttgctcagtggaggcctttgggagcctgcctgcaagctgcgtcatcaactagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcagacttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctgattcttgctgctgtctctgggtggagagaagatttaaaagggagccgaggcgggggtcccagggacttcagggctcaggaggaccagaggaaaatgtctgtaagcccagatataccttgaccaatgatgtaccaggccacattctgctgtggtcctcatgtaatacccagctgccctcattcactcaccaagggcaacatgcagtgccagcagaagcccctgggccatctgcacaaaggtcaaaagtttctcaatgggtgtatctcgctattccgcaaacctaaacaccatgtgtcccactgatgctatctctgcagtgccattttatattttacttcctctgtaccccgaggcctttggcaaatgaatgacaccaacccaacctcaagccctgccacctcttgcctctgctagtccctcctagcctgattcctccatattgtcagggtgtcttaaatgccaccagatttgtcttcccacaggcatggaggttcacaagtaactaacttggtttccacatctgccagctcagatgactgttagcacctgtgaaaattcattttgaattcaaaacacccaaggagaaagggacttcaaagttgtttccttggctagatcttacactgaccccagaagatgtggataaagaatggataaagaaaaacgctgattaaaatgtaaactgttggccaggcgtggtggctcaacacctgtaattccagcactttgggaggcagagacaggcagatcactcgaggtcaggagtttgagaccagcctagccaacatggcgaaaccccgtctctaccaaaaaatacaaaaattagctgggtgtggtggtgcacgcctgtagtcccagctacttgggaggctgagatgggagaatcgcttgaacccaggaggtggaggttgcagtgctcataccactgcactccagcctgggcaacagagtgagacactgtctgtctcaaaaaaaaaaaaaaaaaaaagaagtaaaatgccttttggtttttaagagtctgaataagcagagttcgggggagaaggatgaaatgggttggagtaatcatctggtgtgaccacatctgcagcagtcctcctaaggacctccccagcatcatctaaacacctcccttaccaagaggaggcaggttgcaccgtaagggcctatagatttggcctctgagaactgcaacaaattcctgcctttatgatgatttggttggttcttccaccttcctacccccttaacagctttcctcaagggtttatgtagctgtttgggtcaacagctgacccaaacccgtccttttaacccaacctgttccttgagatgcacgattttaaaattccagctatttgttagacgtgatccaaaacacagcgcccccaaactgaatcatcttcccacctcacttgagccagctcccttttatgcttccccagattttatcagtagcctcttcactcccattttccaagcccagagcagcttgacgcatttcttttccttgccctccatcacctctctgctgctgccatctcccttttggaaaggtcctactccctgaacttcccggttctccctggccctctcgtacaatctgctctttttcttgggcctacacctcttctgcctgcttccttgttggtattcccagaccactgttctgctgactcctccctaagtgatctcatctaccctgatgatttcaagccacataaacgctaatgactcccaaatcagtacttacagcccagactttaatcccgagcttcagactcatgtccagctgactgctggctgctggcacacggaggggccacaagtacctcaaactcacaatcaaataaacagaattcatggtttctcttaaaaccatcctctggccttcagccctgttttagacatgaccattgacccaacctacatccacagaagccacagcagtccaccagtcctctgctccccacctccacacagtcccgcttctccaatctctctgctctagtcccacttgcaccgccctaaactgcaggtcttctagtgcctggacaactgcaccagcatcataacaggtctcctagcctccagatggctttcctataaaggcacccttcatactgcccccagtaaccaatctgaccatagatgcttcccctagtccactgcacacattctaaggtctttgccctggagcatttggccctcctttgcccttacctagcattcactgctccctgccttaacctctacaatccggcaacttgcagtcctcatggatcatccttgtcttcatggctgcttgtgcttagaacatcaacttctccctggcccagcccctgctccccagcacaccaccagttcgcctggctaacttttactaatgctttgtgcctccattcagacatctcctccaggaagcctctcataaacatctatctctgttgccacagtcccctctctaggctgtgagttccttgagagcagagtttacattttattctcttatccctggcttctttttggccaccacatatttttgccgagtaaatgaatcagtgtccatatctagtaaattctatcttagcagtatattttatatacatttccacagtgcttacagcaagtccttatatatgactgaaggaatatagttcctgattacctgctatcacagctattccaaaattctaatctgtgtctctgcagtccagggatagcaaatatatggcaaaattcccctcttctctatttctatccatggcaaaaaccactcgtcaccgggttgggtccatcctcagcctcagactctttctcaacacagctaattggttagacagaaaaactgctaatactgctgccacgttttcctggaatgtaattatggttagatgccttttctgctcaaaacctttggctcctcacttacctccagagtaggcacagactctacaaggtcccctccagcatcaccccatcctcatct

SEQ ID NO: 12542 - DNA, 173787 bp, Human
tctgattacttttctactttctcatacagcttaacacctggaaacaactgtactggagccaccttcccgaaaggtgccagctgtttcctttgtcttaagcacaaacagaactaatgtcacatttccagagaagggtaaggatgaaataaggcgactacaaaccagctttcagaaatgcgaagtcagtcaacgttttcctctctgataaccccttatttgtggagcaacaggagaattacaacacattttggaaaataatttctattggaccaactcctcacttcgctggaagtagtcggatccaagacttaatttcaacacagtgttcgacttattgcttgaagctaccgcagcataaaactcgtcttcgaatggaaaatttgaccaacttctatgaggtaaatgaatagtgaaagtacgggtgggcgggagagacatacaagttttttcggttttttgttttttgggggaagaaagggcgcatacgaaaaaagtcctaagcaagcacagaactgtgtctcttaggatgtaaaaggatgttataccagagagctcaaaagctcccagggtcacggctcccctaaccgagggacttggggtttcactgctaccaggcacccggggaaccccggccttggataaaaagagggtaactggagtaaagccgtgcttctgaacgacccagcgcccaggaccccctgccagaccccgcctttcccgggaccccctcgggagcgcccccgaccgccccgcacgggtcggaggaggaggcagagaggtcccgcgcggacccaggcgcctcccgggccagtcgaggatcaaccaccccggggacccctgccgaggccagcgcaggataaactccccgaccccgaactctgcctgccgcttctcggcgctgggcctcagccacgggttcgaccgtcctcctcaccgcggctcccgcctacctcgcgcctcccggccccgcgacctccccgccgccggccgggccccgccgaggctgcgcttcccgtaaactccccgccccgcgcatccccctcctcgcctcggccccgcccccgcgggaccctgggcggcgcgtgattggcccggccgcgccgtcactctccggccgcgtcgcctccctcgctttccaccgccccaagaccggcagtgagattagtgctcgcggggccgcggcggagtgtaccgtgctgctctactcgctgccattcgcccgcaggtcggcgcgctcgcccacctgagccgcgccggggctgcgggaccgtgggacagcgcgctcagcccagcctaggaaagaggcagcagtctcagcgcggagatggggagcgggcgaagttgacgagtctcccgcccacgctgcgcccctcctgcccagaggtgcgctgcccctccccgaggtgctcgcgcgctgccctgaccccttcctgcgcgggacacccctcccctacccacgggacctgataacttcaccccaagtccagagagtgggctgcgagggcggtgcccggactggacaggactctgcttaaggggagcggtcctggaggctcgccaggagtcggagggcggagacccgctggaaactttatcatcgccgtaattactacgttttactgtttctctccccgcaggggctgcagccagcggtctgtcgcgcgtgcctgtgtgcccgaggagccgccccggggagaagacccggcgcggagttgttcccccagggaggatccgcagcccagccgagggggtcgggcggcctggctacgcaggacccagccccgcagccgcggactcccagcggcggcgaagtttggctgctgagcggcgcggcgccggaccactggacagcgggagcgatgcccgtggggggcctgttgccgctcttcagcagccccgcgggcggcgtcctgggcggggggctcggcggcggcggtggcaggaaggggtcgggccccgccgccctccgcctgacggagaagttcgtgctgctgctggtattcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagaggtgagtgggccgcgccagaaatccctcccgaccggccgtgtttttcagggagaaacggcaagcctttgaaactctgaagactgcaacaatgcaatgtatggggagatggaggtttgccccttccaccaggtgctgtgtcaaaagctctttcttttcctgtttccaatatagtagtagatgtgtccagtaagatctaaggtcaaatctcgttgcttttaatttgcatgctcttgctctggtgaccacaagccacacgaggtgggtataaatacatgggcaggtaatacgcaaacctcattctctggccgctacacggttaatcgccccaccagtaacagcgacggcactgatcagccccctggtaaggattggggacgtggctttaaagtgagtcttcacgcgtggtaaagctagccagcataccccgggttcagctgtgtggcccttgtctgccaggtggcattctgtgtgtactttcagactataaaggtgaaacctgagaacttcccatcatcgagggatactattgtttacttttttaaaaaatgaaaatataaaaagccagtcggctgcctcttgtatttctaatgcacagccagaaatagggtattccatgtgatgcaacaggtttgcctccacagcagcacaatggtgacaaagttaatccaggataaacatggactttgatacatctttcctaatttccttctcgtaattttcagttagaacttgaaacatgtgattaggtcaggaccagcttaaagctgaagggggccgtaaaaagtcctttcaggctgtcattttcaagatgaagatcgaagggcccagagctctagaacccgttagtgatgagtcaggacttgaagcccgaggtccgaacttcccccagtcacctgtcaccacgcggtctgtggacatgcctcctctctgagctacttccctgtgtgaaacggtgccagcctgcgttttacatagaaaagctgtaggaaccacattaaaagcatgtcattccaaatcttggttcaattttctaaaatatgaatggaagtaatatttttgccatttaaaaaataatacgatctgtgaaaataaatattgtattttcatattgggtaggtaatcaggagaggaagtccctgatcccattttcagagagtaaacagatttttgaggtggttgagaggtgtttagcttaagtggctgcagaatgaaggcagcaggattgtcatgggatttgtgactttgtattataagatcagctgaatttggttaagctgtaattgagcaagttaaagtggacttggatccctttcggtttaggaagaatgtcttcatccttcctatgcagatagcttccttccacagtccatcagcatatctgcttttctgagacccctcctcagggacagaaccctcccatacttgggggaatggattctactttccagaacaactgtctagcagtttcctttctccatgaaatcctgcctgtgctaccaaatcaggaaggtggaacaaagctctacctcttaccaaatcctcccagactccttaataatatccaaccaaaaccataggaaattaacccaaatgatctgtatctgcctgtgtttctgttaaatttgaacggtgtaattcatacatttcatgcctccaaagtcatacgagctgccagttagctagtacaaaaatcacagttgtccgaggaaaagattttaatacgaaagatacatagatgttaagctgttggtactgaccaagagtgattacaagtgcattcagagcagaaccagtggggcagtagcagtctcagactcaggacaacatattaacagtgtgcatatccatccagtagatccatgttgtctgtatgcctaaatcacaaggtcttaattaaccgtgtaaacgagatttacgtagtctctgtctaacatcttagcacctagatgttttgaaaccgctcagtcttgcataaagcagtggaactaaatgtgttctttaaaattccttgttgctgtgagaacccaaaagagccagcataattagctttagtgtttagtcaaaggctaatgggaagaaatggattatgattttccatcagattagttcaggcagatatattcctttgtaaaccaaaagaaaaaaaaaagaaattatgatgctgttctaaaaactgtgctgtaaatatttggctttagagaggcaagagtggttgcccattgtaaatagggcactggactttaactttacgtatttggattcagtttcaggcaccactgtggacattttgttatcaaccagtagatctttgccttagtttttttctttaccattgtgttttcttttctttctttttggagacagagtctggctctgttgcccaggctggagtgcagtggggtgatctcagctcactccaacctctgcctcctgggttcaagcaattctcctgcctcagcctcccaagtagctgggattacaggcacgtgccaccacacccagctaatttttgtatttttagtagagacggggtttcaccatgttggccaggctggtcacgaacttgacctcaagtgatcgacctgcctggcctctcaaagtgctgggattacaggtatgagccaccatgcctgacctgttcctgtattttctaattctctttatacttaggttctctatcacacctgaatgcaccaacacttatagttaaaatttagaaagtgcactcaagtctaacatgttggaagactggattgtaatttgagtcaacctgttattttgtacttggttcaaagtcagtcaatactattttttatatctatggcacatttatgttactagtactgcagtagatttttaacaacttcgtgtcttaggggagatactctgttaatttcaaataggtcattgtacagaatgcttcacaaaaaatgttaaatgctttccactactgatttgatggatgatgaatctttgatgtaaaacttcaaaatagaattaagatcttcctcccttcacctctgttaaaattttgtaaattaaccctgggatttctctgagatttatgatacatacatagtgtatatttattttcatgagtttgatcttaaaattgtactcaggttgtccttagctttaaaaagcagtgttagaataatgaagcacaaaagttaaaatagcagcatggaagttttagaaaaatagtccatttacttttttttttaatcagaaatcatttttagcttcccttctcccccgctccgcccccccctcaacctctcccattttctcaattagcctgtgctgtcctttaggattagaaccttaatccaatttggaggatgactttttttttcgtttttctgaaattaaggggagacctgagtaataggggctggggctaaagacagtcaggttgtcagaggggactcctttcttctcaggctggaatcctcaccaacctaagtgggggttaggggtatgtgcagactggcagccttagatttgtcatgtaaggctttaggaccctgcacctgtggggtcacagttttcttctctcagttctaaaacaagactttagtattttattccagacctatttgtgtaatcatgaatttaaagaacattttcatattgatggctagtagttaaaattcacatttattatactttatgctagccttaggcatatagcctataatttatattaactattgacagtttatacccttttggtaaagatcagatgtgagaataatctgccttggcaggttaaaacaaaacacttttattttgacacttaactttccagtttatttttatgggtagttctggggtggaaaataatatttacaaaataataaaagccatgatttggagacctgacccaagaagcttcaacatccttaggttgcttgcctgtgccactgtgccgtgacacattccctactgaacataggctagtgtgggattgctccacccagaggcccttccccagagcagggaggacatggagtgtttgtgaaggtttttctctccttaacaagtaggttagttttcaacagtttaagtactggagtaggtgctgactgttaatatacaaaagcaaaaaaatacatatatacagtaatgggtagttaattatgttcagcttcattttctgtaagctgttgatagtttctcctagaatattctgtcttcctcttatcaaggcaactgggattcatataaaggagcttcttatgtatatgggacttagaaactagttaaaagtgtgaaaagaggttttaaaaaatattttcaaacaaatgcatctatctgtacttcttaggtgagctaatgaactaaaccatcttgaaaaatttatcttagtattacacaaaatgcatttgtatgagatctgaattggttggaattcattgaagaacttacatatttgaatcagattatttcataagctgtggtggtacaaatttttcattgaagagaattttaagcatgtgtccgaaggtcagaggggaggaatgcctgcagatccgtgtgagggatgagggctgaatacacagggtagatcagaattgcactggaacctggttatacctcctaacccagtcaagcacctgtggtcttttaaatttctttctttataatcttgtgtatgttggtcaaagaagggtttgattagtcaaaataggaacagccactgtgggctccagagatactgtgaaacgagtggcaaaacaacctccccgccaagtagacgaaaataataaacaagatacctgtttggtagtttagggaagagattccctctttgaggaaataagtcttgacttttccctcagtattcttagcctagttccttgcttggtgttcagtgattgaactatatcttatccccacccccaacctctcaatctgttaaaaggccctttacacaaactctgcaaattatgccatgataactttaaatctcagattttaaaactaagtgtatgctccgagtcgtaaggtattgcatctgaatgagatctgagaggtagctcattcattttacagtagaggcaaccaagacacaaagatcattctggaaatcacatcaccagctagtggcagagttgagttgcagagggaagccccagtcttctgtgagtgttgcgcattgtctcccacatggtttgtctcctaaataaaaccccaaagaattgtataaattatccgtgcttactatttgcagaccctaatagagagtacagaaaacatacaattctgcattattataaatttgaccttatactaagttggtggtttttctttttttttttttcagccaacgatggatcaaagtagtttttaagtcaattatagtaatttttaaaaatcttaccagtggcatggtttagaaatcttcttctttgtaaagacacccggggaaagcttgataggacatcttgttttctttataaagatctctccaagaagcacaggcatttgtaatcattcagttaaacattctttatgaggaaaagtggggaagaagaaggaagggagagaagaagagagtgagttactgtatatacaaagggtgaaaggggatcacccagagaagggacatgtgatgactagaagggctgctttaaaattataaatgtgtgtgctcttctgatattgcaccatggataatagaagaatgacagctaacctaaaggatgattgttttaaaagtagacatgtaaaaatcacaccaatctatgggcaattctctccacccaagtaggttctggcgattctcttttgggatgcacttacctgtctctgatccatccatttgaagcaatgtagtggttagaagggtggatctggactcagataacgtgggtctgaatctggcctctaccattctcttgctttgtgaccgtctgcaaattacttaatctctcagaactttagtttcctcatttgtaaaatgaggttaatagtacccactttgttggatcctgaggcttaaatgtgatagtaaagcacttagaatggtatcagacatgaagtgggcacacaacaaatgctgcttgtgattattgctgttactggtcaccacctaaagccatcaagccaagattgcattgatccatatgctgtttaataactcaggaaagtggataatgaagtttcaaaagggtatcaaaaatagttaaaattgagttttagtgcttaaagggatacatttccagttcatcaaaaagatcttccatacctataattttattttgctacggtcaactctgattttctttgatttttaccaaattccaaaaaaacttaagtatctttagaatgatatacttactgcatatacatcttcagcttcttcagaatatatgttaaagaattaatttgtctctttctcatagtcaaatatgcctattcccgcagataccatctttcagagtagtcacagtcgagttatcttaatttctcttttttctaataaataatttttttatttacacaatgcagatcgggtctcactatatttcccgggctggtttcaaagtcctgagctgaagcagtcctcccacctcggcaccccaaagtgttgggattacaggtgtgagccaccatgccttggctgagttatctatcttaagtattgaagttattcttctaaatagagagagagatcgagtaaagtgaatttcaatctgtttcatcttggaggaatgtttttaagaagtgagaattattattttaggcttggcaaaaattatataattatgataaattctataatcagagctcagtccatcacttagtagtcaaagttagcataaatcagttttattttgtagctcagagagtttggtctttttgagaccttcacattgaatttagatttattaggattccagacccactactcattttacacatgagaaataaggcctgtgagctgtgacttcctgagattcccccagtgtacaaacaatagctgagaattgcttcttaggtgttgagaagtactgagaaccaggccccactccacctgggataatcttgactctaatgagaacgtgtgctttggtgactggctgaccaggccctccctcctcctcagccctaaatggcaggccaactgccagaagccccactgagaccatcctagagggaggtgggacgtctttgctgggtaggggattgcctaagaaagcaatactggctaattcctttgctccggagaatgtggcagcagtgccccgcccccactgagttttgataaagacttctgtgatcattaggtacttgaaaaaaaaccaaatgagattaaggcttaagagcatttaaaagtcacagccctcatttctgtcatgaatactctggtagttgctttaggtactttagagctgagcagtcctgcagataatccagaacagagataataaaattgaaaagtacacgtatccttcctgtttacttgacttttgtgactagaatgactccttctcgctcgtgtttctcagtctgctcatctccctggctcttaagtttatcaaaagcccagttcctgatttgctctgctgctttctcatcactcttgctctacatcgttcattcaagtgacactcagaacatattatattaacttttcatttgcattgttcatgtttttatgtgggtcactaattagatcgtcctgtcttgtgtgggagtgtttagtattagcaacttagtatgagagagggcatggagatgaggggataaaaacctgatgaaggacaccaagttctgaaagggtggtttaataacacagcattgctaccctctgaaacaacctttgttgctggtgcctgtttgtctgtgctaggagtttatgagaaagggggtggcagtaattggtgtccgaaggcctgtgaatgactatggccaagacgtgaactcaagccatccatagactacaagctattgctagtgtctccatttctgccaaatccttcctcattaaatggtcttctcaaggtcccttcagaacactcaattcttctaagtgacaggatgatctcagaaataggacaggaggccagggatcctagcctacactgggggtggcatgtccagcttcctgagctgatgtttaggtcatgattgtctgtccctagttcctctttcacgggaatacatgctggagctatgtactaaaaggggagtgtgtttcctcactgtatctctctctgtcggggcataagacaagagaacagacctgtggaatgattagggaagctcaggggtatctacccagtctcaaaatctcattcccagctgccagaaattcaccaccagtgtttcctttttactgtttttgttttgtttttgtttttgagatggagtcttgctctgttgccaaggctggagtgcagtggtgcaatcttgtcttgctgcaacctccgcctcctaggttcaggcgattctcctgcctcagcctcctgagtagctgggattacagacacctgccaccatgcttggctaatttttgtatttttggtagaggcaaggtttccccacattggccaggctagtctcaaattcctgatctcaagtgatccacccaccttggcctcccaaagtgctgggattataggcatgagccaccatgcgtgtccatttattgattcttaaaggcttgctttagaaatagatggataaagttgctcagcagaattattaatattatactttgagatttgtcttatcaaaggatagaataggtttgttgaagcaagtatcttccattgtcttatttcgctttataaactcatgtctgcttgggaaagaaaaatttgaaagcacactagagtagaaaaaaaaaaacaaatccttcatagttttatcagtcactaagtagtgtcaatgatgctcctccctaaccccaatatgtaagttcgttcccaccccccgacgccgggttataaccacactatatatactttttgtttttcattttctttgcaagtgtcattttatgttggcacagtatatccatgtcaaaacatgatactttatttaaccagtcccttggacctgaacatttagattatttccacttttttgtttttattaaaaatgctgagacagacagctttgtccagtaaatttgtgtctcactttttattgcacacaccctggtaagtgggattttctcttaaattcttaagaggggaaataaattggccaacagatagtacattttgagggataactttccagaaaccatttatactcccatgtgtcatataatgaatggagtctgttgattctttgtgaatttcataagtgatgaagcagtatatggcattttcagtttgcttttctttgatcaacactttctcctgtgttgatcatttgcatttcttccttgtgagttgtatagatagaacaaggaaattttgaaaggaggaagatagagaagatggcagagcttggaggcctaaggagtgaaatccaccaggggagatggatctggcaagccggctcaatgaacgtggactcctgtgggaggcaaagtcctgaaggcgagagttaggattttataaagcaaagttgcaagaaaaaaaatttttcccctagattgcacacttagaataaaatatcctttattgataggagctcttaccaggcacttgggacagcccacatccttcagctgagacctagccagctttaccagcgcatcttcatttttaagtgacagttgggattttgcctcagatacttgaggaaggtattgacctctctggagatctgcggaaggatctttctccttttggaatgaatcaggatgcttttctaatagttgaagatcaaaagtagtccaaatagaatttcagaagtgattttaatgatgccagaaaatggcaagtcttacacagctgaattcttaaagaagaaaaattaaccaaaaggaaatcatgagatttcctagaaatatttgttcttatgtgtgaagaggcaggctaatcttttgtatgtgagaggccttcagtgttgtaaataggataaatatgcattttgtcaaagatattttatttttaaagaaaagcatgatattttgtgtgtgaagtttgggcttttttttttccaccctaaatccttcaaatgtttttagtcatgttttttaagatagtgaagagctgcatatttcaaaatgtatttatattctgaccttggttcataaaagtctgccaagcgccagaactatttaaatttggctataacactgtgttaacgtgatgaataacgattgacataaatgtactatattatttttataaattgtggttagacatgatagtaattttagaatatttacagtgctatttttggagactttttttttttttttagtcaactagcagtgttgaatgttttatctagccaactacaggttttcagctcataattagaaatgcctgagaagtccatattgtgatttaaggagttattagcccaagtcagcaattttataaggcattcttattaggaagtataaaatgaactttatgtagtaaaaaacgtattttataattggcatatatctaatgcattgtatacattcactcatattaagcattttggttagtcttcattatttaatcctcctgtggttacttaacatagaatgtgtaatgaagaactcagtagctttaaaggtggggtggttgaggagaatagaaaatgaaggtgatttattaactactgttgaaagctgctttagcagttagggtgaataaaaatgatgatttattaagtattccatcagtaataagataaagccacagtgtagggttggaagtacttctgttttccctaactcccaagaatacagaatttctatgacattggctctttgcagtcgtccgtcccttccagaactatcatattgagggcaggagaaagagcttcccctattcatccatgtgtccaacagatcagttagctctgggccctgcccataatagggcccagtatgtatttgttgaatgaatatgctctttgaaataaacatgcctacaggagttactcaggttaagtgtgatttcgcgctaagtaatctggtattccagaagtggtgtccgctcatctttgaagtcctttctaatgtatatactcatgggctacaagtctttgtctttttgattttttttttttacaacagtcagaagtcatttagaatcagacctagtgaataaagagactaatgaatataggaaatgccttttccagttttcaagttgttttccagaatgatttataaaatgaaaactgcattcattttcttatatgactgtaaactggtgaaagtggtgccaaaaacaaaaaaaaatcttttgaccaaatacaacactgctgaaataaatgtagatgattgtgagattcctttaaaggtcaacactcgaatataaagattctgttattttattgaaaagtgtttatatctacagccagtattttttttttagatatgttatttttaaagtaggtagagtcttcatttattttctttattacctagaatactggacagtatttaataagggttgccatttttcttgtatttcaattttatacaggatatacctagagttggttttgttttgtttccattttggcaaaattttttgagagataaaggtgtcttaatgagtaatgcttacagtaccacactaaaatgaaaagtcataggttagctattattttccactagagaaatcagaattacataaacatgttcctccctaagaaggtgtgatattttgagaaagagaaagaagcttggttttctatttcccaatttcatattgtttctcctgaaaagtgctgtgtcatataaataattgcatggtagaggctcaatgaattttatgcatttgtcagtggtcccttttgcagtttattctacagatgactattaatattcctaaaacatcacttctctcgtattgcccaactcaggttttaatggtcctccatttcctataaagtaatgattcagacttcaacatgcatcagaatcacctggagggcatgttaaaacagattgctggtgccgggcgcagtggctcacacctgtaatcccagcactttgggaggccgaagggaggatcacttgaggccaggaattcaagaccagcctggccaacgtggtaaaaccctgtctctacgaaaaatacaaaaactagccaggtgtggtggcgtgagcctgtagtcccagctactcgggaggctgaggcagaagaatcacttgaacccaggaggcggaggttgcagtgaaccgagattgtgccactgcactccagcctgggtgacagagtgagactctgtctcaaaaaaaataataataaaaaaattttgaaagcctggagtttctgattcagtaggcctgggtgggccccagaatttgcatttttagcatgttgctaggtgatactgatgcttctggtccagtgacttcagctagaaaaacattttgctctagaatgaagtcacagtgaagtcacaaatgtttagcttggcatccgtagtcttctgtaaatctgcatcagtttatttgttgagttgtatctctgttacttcccaggaaggactgtgcttccacaaaacttacatagttactatctccagaacacatgtcgtttaggatttcaccttgtttactttatggttctcaaaaggagagtcttctcacttgctcaaaatccatgtcctcatgaagccctctctacactctcaaccttcactgatttctcccttctccaaattcccatgttattgattatttctatctttggcctgtgtgtcactgattttgtgtgcatatatgttatctttcaagtagatttcagacaccctagaagtggggacaccttttttatctcataggtccgtggcccagaatttgacaataaaaggcaattcatcctaaatgtaacccagattaagtatatcaacaaaatgttttataaatgtgaggcagtatggcagagtagaaacacttctgtcctccctttccacgcctttgaaatggagttaataattcctctttttcagagttgttgtaagaattaaaatagaaaatgtatgtgaatctctcagcgcaatgcctggcatgtatcattcattattcaatacatagtatgtacttactagcagctaggaattggtaggagtgataaggaaaggggttggtaggtaaattggattcagaaagtcatttccaggaaagaaaagtatgttttggctgcagtattgctgtattgaccaatagcttctattttctattgttgcctccccttttagttgttgttgccaaatttctcacttcctatggcaggaaagtaagcattattttgccttgttagaattgttattacacagaagggatgctcatcctcaggaaaaccatagagagggtgttgaatggagtggttcctcattcattcatcagtgtccagttacttctgacttctgggcctgctgtcacacaacactcagatatgtggggaggaaagaaagccagggataaagaaatctggagaaataccttcagggcatagaaagaaataatttttgtgagctgaaaagctgaaaatgtttcattcagagataactacatgtgtaaatttagctcaataattaggcatatggtgctttcattttaggatgtatccaccctttgtgataatatccgttgattattagagctgctgcagctttaactacattggcagcagagattcctagtgcatttaagacaagaattcaagagtgaaatggaaaactgaattaataatttgttcttgggtggttttaatctgctccttaaatgtagtttatgcctggaggattagatttggaaacagaacaccaactaatgttctaaaagtttacttccttttattggaacattatactcttaaagattttcagaagaacattttggctgttttagtcttaacatacgaggtacacttaagttcttatgattcaacctaaaacaatagaaagcttttaatctatgatataatttttaacttttaaagtatttcatgttagacttcaaggcaggaattgtttaataaaaaccaactaataaaaggaaagatattctttgttgggcacgaggatatttgggtctcttttcccaagctttttaaaatccccctaggtctatatttttcaatcttagaatttaaaatctgcttgctgttgatggtaaagaaaataggaaaattaaaatcaaaggttatttctgtttacttcccataccttgtcaaatgtttctaaaattgatcgaaaataaaccattgtaattttataaattgaaaaaagagttatattccaagatatagcatagtaggatgagctgaaataggaagtttaaaacaggtgtctttgggagagttggggatggtgatgctttccatctgcttcttgcttaaagctttaactacggtcctattagaatatacctgagagtctgggaagtcagtgtatttgcttctgtggttgtagttctccacccacctgtgatctgaagaattacaccctaggtttttataaggtaaaggcactagaatttagacatttagaagggacttctttgaaaactaggaagaagatgggcaaagtataataccaggtattggtctgagttaaccaggagtagattatttattagaaaactagtctgaatttatgtattcttgataaatacaggttttgacagaaattctccacttttgactgatctggtaatagaggttgaggattttatagccagatatgctgcaggtaatcaggtgttagttctagcttaataattagcttaatttagtattagctgtctttttctgtggtactttacccatgctcttaatcatcttccatccttcagtgtgttctgctggagagaggcggtactaatggtgcaaaggcagacatcaggagagttgcagaagtggtattatatatgttacacacgtcagaagactagtcaccttaatactcagtaattgactatgattggcagcagggaatgagcagccctctcgcttcctggaaccttgagaggtgaattccatacattaccactggtgttcagaaggatcacctttttctgacctgtgggcactcactcctaccttttagaattcctgagggaggaagctgtctagttatatgattagttagcatatttgtggacctttaattatcaatagaattgctcgaaagctgtcttaggaagtaatgcctttgattgatttgaaatctcatgcatcacccgtgttgctagtgttttccaaaacactgagggatttttgcagacagcattttcaggggctgatttgaaggtaataaaccaaactggcagggagggagggttcttcctccacctcagggtgagatctctgctcctttactttactctggagtgccctgtcttcacaaaccccgggggcacacaacacattagtagccataagtgtctgttgtgtgttatgcagcccggagtcttccactggtatataccaagtccccaagttagatatttctcttttaaaaagaattttgccttcatatttaaaataaaaattatattcctcaattggctttttttttttttttcttgagatggagttttgctcttgtcgcccaggctggagtgcagtggcatgatctcagctcactgcagcctcagcctctggagtagctgggattacaggtgcccgccaccacgcccagctaatttttgtatttttggtagagaccaggtttcaccatgttggccaggctggtctccaactcctgacctcaggtgatcctcccaccttggcctcccaaagcgctgggattacaggcgtgagccaccgtgcccggccagttggctcttaaacctcagctattaatttccaagtatttttggtttatgaataacaacagcaataatagcaatgtctgataattttctctttttctctaggtttaaaacagaggcaacagttaaaactatacttttaataaaaagtgcagcttctcagttatactccatcatgtattccctttttctcctaatagaatgtgtttgttattcttcctgttctgagagtggctccttaattgattttataccatcagttagtgttattatatataattaaggaaatcaataatgagatttttaaaatatcatcttggcatagattttgtctcctttatctgcagttttaattctggaatggtgaaaagtatgccagtaactacaggataccatttgttgagtgttcacttcctattagatactatgctcaccactttatgtacatattctcattaaattctcagaacaacaagtatttggtttttctcagaatatgggtatttgacattattctcctcattttatacataggaaattgaagccaggaaggggcaagcaaattgcccagggtcgagcagctcctgcgaggttgaaatccaggtctgtctggtccctgcccccaccctcttcttgtgcactcatctctgctgggttccccatatcccctggggccttggcaggctcagatcttacccaccttgaataaagaatcaggactcctgttgcagtcactcctctgcctgagaaggaagtaaagggaagtgaggtgaggactggcacaatttccaccccagcttgtggcagacaacatgctttaattctgaaagcaacaccaatgctcagtttgtttggaaaagcctctcaagagtaatattgtgctcaacttaacaactatatttactagtatgtgttcatgtatgtttatatccccttgattatatatatatatatatatatatatatatatgcataatatgtacatggttatgtgcgtgtatataattatctaaaataataccttaagcattaatgaaagttattgggggttctggaaagttgtttaaatcaagagaaaaacaattgtcactggaagaaacaaatctaaatttgcttcctttattctccctcatcttggggcaactatgactcctaaagtttaggatacataatgttacaattatttaatttttaagcaagagattctataaagtgtgaccacattaacaaaaatgcagtatgaattttaaattcacagtgaggtatatcaccaaaaagaattctatgagtcaaaataatatgttgttactgacttgacagtcaagttgtatatagaagtgacaacaaaggctctgtttaattgatcttaagagatccggacagtataactctttctgcaaatggggcgatacagttatcattcaaacccaaataatttttttttaattttaatattttcctttaataaatcagattaagaatcacttccaacaaccctcctacaaatatttagaagtaccaccctgtgcaaggcactggagagatgacagtaaacaagaccattatcaccactgcccacatggagcccaaaggggtagagagtaaggaggccctgtgacaagtaccctgggaggggcctagagttactatgggaacctggagtagaacataactctggcagattagggggttcaggaacactttctaaatgaagtaaagtattagacctgaggatgagtgggaattagccggttgcaggcaagatgaagagggccgcaggataggaatggaatgtatgaaggtccccagggcagccagaggactgagccagagtagtagtgctgagaagaggaagtgggccacagaaatgaagcagagaaggcgtctgaccaggtgtttagactttatcctgagatcatcaggaaccatgggagggtttcaagttgcagaaataatatcaaatctgcatttttggataagactggagtccaggacatgtgttagaaggctcggcagtaatccaggtgagagatgaggatggcctaaatgcataaaggggtagtgaagatagagaaagtgaacagatccttgagatacttaaaaccggaatttatagaactttgtgggcacttaaaaatggagagtgagagaggaaatggagataaagaggttcttgggttcctgattgggtcacgggttttctgatggttggaatcgtcaggagagagagaggagtggagaggggtaatggatgtggtttaggatatgtggcattagaggagaaagatgtccaattggaggtctcttgtgagcagttggatgtatacaacaagcactgcaaagagaagtctaggctagagatgccaatcttgaggccatcaaactatggaaataaataagatctattagggataatgtgtcctgtacaaagagtcaagggcttagaagcccaaggaacatcaacatttacaggatgtgcagagtaagtggtgacagagaaggagcaatcagagagatgcaggaagaaaactggcagagtgtggcactctggagcatttttagatattcagtatttgaaggagtgagtctcagcagtgtcaaatgctgctgagagtcaagataaggactaagaagtgttctgtggatttggtaagaagcaggtagaagatgacccttactggggctgattcagtgcagtattcagggtagcagctgtattgcagtggagctaaggaagggcacagactattctttcaagaaggtaactgtgaacgaggccagagaggtggggtggtagctgcaggatgacaaggggcaatgagaaggctgagtaaagaaacagaatacttgctgggcactgctgagcacacagttggagccggcagctggccccctctgctcactcgtttgatttttccttagcgggattcaaccactctgccatatttggacaaggcaaacaagtagattgacctatcaaggaagacacatgttcccaagtgcttttttgagaatctgatacaagagatcatttgttagtaagaatgtaaatccacttaatttggagtcagtgggtgggggggggatatttattataaaaaggaatctctcatggatttaggtgaagacctcacagaacctggaattacaaatgtgaaggtacagggaaccaagactgctattcctcatttcttactctgggctacttagtcttttgtcttcagtcatacatgctttattctttcctctgcagacaggctgtcttatgaatcagtactcaagtttacatagccaataagtttaaacactaatagactttgtaataagcatctcagaggctcaattccaaattcccagaatggagaatctgacccagctttagttaagtgtctaatcatctatggccaggggggtggagtattgatttttagtgcaaatgtaggcatggcacagagcctcctaagtgacagaaagaagaggattgcctggctgcacagaggttttctggcatctctgctgcatccagacatctgctttgctgtatttatcttattgaaaatttctctgttgtgggcctacttgtcagaggcaagttgtccagagttctgctatatattcattatggaaggttttaccttattgaaatgacagttccccacctttagcattttatattgttccattaactgtcatacaaacattcctgcaaaatatcagttcaggaaccaaacttactttccctgagatggtaaccgtttcacagcctctcatattgctgcttcattatgtgatgaagtctaaacacgtaaatggtgaccagttaaaacacacacctgcacacatcaaatcaagaatttgattccaaatttacaaaataatcaggtcttatcttttgaaatcctacctgtctatcaagacccaatttaaatcttattcattccataaattcttgcctgttcttatcccctgaacagcagaaaattatttttctctgtttttatgactcactttgttttaacctacttactactttcttagtgttaaaggcagcacacacaaaggcactgagatgagagagcttgtggctttgccacttattaacagtccaaccctgtgaagatatacagtgcatttgagctttatctcttacctgtgagagtgatgataatgcctacctttcctggatgtgaggagccagcaagtgagcggatgcacaactgtttgcatgctaggaaacctttgcagatattgattacttaaggaaatagttttggggtttgaagaccgggtttctaaatccctgtctgccacttggtaattcatggtgtggcagtgggtgacttactgttcttcttgggcatgttgtgtggtgtgttttctttcattgctctaacaaattatcacagagtgacttaaaacaatacaaattaatatcttacagttctaggtcagagtcagagtggccttgtttggtttctctgcactgagtctcataaggccaaaaatgagctgtcagctggcccaggctcttctctggctctgggggagaatctgttttacaagctcattcaggttgttggcaaaattcagttccttgccaactgtagaactaaggtccccatttccttgctgtcagtcgactctcagtttctgaaggccacctgcattcttcgtcagtttgctcccttcattttcttttcattcattcattcatttagacaaaaattgtatatatttatggtgtacacatttcaaaatatgtaaccattgtggaatggccaaattcagctaatcaccatatctgttacctcacatacttaccatttcttttggtgggagcacttaaaatttactttcttagcagttttcaagtatacagtacagtgttcttagctatagtcaccatgttttactaccatcttaaaaatatggaatgtagcctggccaacatggtgaaaccccatctctattaaaaatacaaaaattagccagacatggtggtgcatgcctgtaatcccagctccttgggaggatgaggcaggagaatcgcctgaacccacgaggtggagattgcagtgagccaagattgagccactgcactccagcctgggcgacagagcgagaccctgtctcaaaaaaaaaaaaaaaacaaaaaaaaaaaacggaatgcttcataaatttgcacatgatccttgcggaggggccgtgctaatcttctctgtgttgttccagtgttcatacatgttgacaaagcaagaactgaacactcctttttcaaaccagcaacatcacatggagtcctgttcagctgaatctctgactttccattctgctgcatctcttctgcccccagctgaagaatgttctttgcatttaagggcccacttattagattgggcccacctggataatccaggttgctctttaagggcaacttaattgttcttaagtaactttcatcatacctgccaactccctttgccatgtgaaataacatgtgcacaggtctggggattacagcatggaaatatttggggtagggtggtcattcactctgcttaccacttttggtactatgtatgtgtacagtgtgtgaagtcaagcacagtcacttgcatacgtagagctactcaacagtcagtggtaaatcatgtggtcttgatatggttaggctttgtgtcctcacccatatctcatttgaattgtaatccccataatccccacaatccccacgtgtcaagggagaggccaggtggaggtaattgaatcacggaggcagtttcccccatgctgtgctcttgatagtgagttctcacaagatctgatggttttataaggggctcttccttccctgccttgcttcaccttccaccatgattgtaagtttcctgtggcctccccagccatgctgaactgtgagtccatgagccctctttcctttgtaaattacctagtctccagaagttgtttataacagtgtgaaaacagactaatagaggtataatgtacatggatgcactttggtcaagagtaggccaaggcaggcatccgagcctgcatgactcagtgagtttagggcacaggtgcatactccatttgttataaccggtttgtgtaagtttgtacttggttctggaccactattgtctgtaaaaggtataactgtcctgctgacgctatacaggtgctcgtgcccagagaaagagagagctagagctgtccgtcttttccgtctttgcagacggacagtgaggagccaggacacagctcggcctgcttatgtccagagagagaaagagttaagctgctgaccctgaaggcagggagagccacccacacaggtatacgtgggagcagccggctcaagcagccgagacagagcagaaagtgtaagagagatgctgaataaagctgtatttcacctatctacggcccctgagtgttctttcagctatctgccattcatccacccactcccctcggacctcagcatgggctggaacctgaccctggacctaacaacaggtctgttgctgtgatttatgttcaacaaacataaactgttacccaagagatattttgtgcctcaggttgctggtaggagtaatgcaaatcaaaagaagctaggttgatagtcatacagtagttcctttgtatagtaacttctagtatatgcaaatagagaaggcaagcaaacatgctgtatccacatgtagggaatattgatcaataggaagaatattccatttttttcttaggacttttgttgaagcctttgacaaactatcttatttcaattccattattgttcgtattctgggctcaataggggtatttaaagtacccagtgttgtaagactactgaaaatccacatccccctgcccccggcgacggagtattgttctgtcacgttggggtgcagtggtgcaatctcaactcactgtaacctctgcctcctgggttcaagcgattctcctgcctcagcctcctgagtagctgggattacaggtgcatgccaccacacctggctaatttttgtatttttattagagacggggcttcacatgttagccaggctggtctcaaacttctgacctcaagtgatccacccacctcggcctcccaaagtgctgggattataggtgtgagccaccatgtcttgccagactactgaaaatcttgaatgaaaaataattctaatttttgtttattcaccctgcatcttagcaggtatagtgtaaaagttaggagcaaaaactctagagccagactccctaattctgatttcccgctctttgatgtgtccagtgaacttgggcaagttacttaacctccctatacctcagttttgtcatctgttaaggtaaatataggcccaactttgtggagttattattgaggattaaattaaatgtgttgatatatgtaaagtgtctggaattgtaactactatatagtgctgtgtgagtcttaggattattattttaattgaataatatgctttaaccattggctctaaactaaggctgttttgcttcccagggtacatttgccagtgtctggagataagggttgtcacatctgttggggtgagatacagacatctagtgtatacaggccagggacaccactctgcgtccaaaaatgcacaaggctgccctccccaaccccccaaacacaggcttatccagcccgaatttcagtagtgtcaagattaaaagccccagtttaaaccagtggccttttatttttttagtaacaacttcattgtcaaataaaatattcatgtatcatgagtgacttttaacaatgaggaaattcatgactgagagccatagggctctgagttctacaataaagtgaaaagtagaaaataattgttctggtgattataaaaagagatatcacaggaaaagagtgtgcttaacttctagaatatataattaagggtaagaaatactctgatcctgtgaatcattgaatgggagttctcattttctaattttccagtgaggttcttctggagattataaggatgaaattacaggtgacccttgaacaatgcagggattggggcaccaacccctcatgcagttgaaaacctgcgtataactttcgattcccccccaaacttaactaccaatagcctactgctgaccggaagccttactgactaaacataagcagtcagttaacacgtattttgtatgttatatgtatgatatactgtattattatggcaaagtaagctatagaaaagaaaatgttatttaaaaaattgttagaaaatatatttattcaggtggaagtgagtcatcataaatgtcttcattccttgtcttcgtgttgagtaggctgaggaggaggaagaggagaggtgttcatgctgtctcaggcagaggtggaagaaaatccaagtataaacagactcccacagttcaaacccatgttgttcaagggtcagctgtacttggatttggaaacttgctgttactgtgtatgttgaaacacagtgagagttaagataactatgcattacagttgcttatgtggaatttacctatattgtagtagtggtaaattttgcaagtccccaaatgtttttgccactgttatttttatttctgaatattatataaggcttatgtgtttgctctcttcactccgtctcatcccgtaggtatattgaataatttagaatttagggtattcttcaactacttttttctccaccacctctcctatcaattttagctatttgatttgtccatacaagattctgtaggactatctgagactctgttcattcttgtggttacagaatttgtccttttgatgataggtcacttaatcatcaacacttgcatgaccacagggtgcagaagctgttgagactgacatcctggatcatgtaggaaagaacctgggcacattcccataccttccactctgttaacctacttggagaaactgaaaatcacaagacacaaacaaaaataacctgcagttgttcatcattaagattaagcagaacactgatatgttgggcatcaactaagtgctaaaaatacttgataattgattacatgatacaattgctaagtattggttaaaaaaaatatgagattgtgatcatattagaaatacatttgtctcatggtatttaacaaatttgtggcttacatcaatatggcaaaaggaaggtgttaattgcagcgaggatgataaccactgcatcatttttgggtcattgtattacaactttgaatctataggcataaagggaaacacactgactccttatttaaaaggaagaaacaaaacctttttgattcagatcatgtctgccatatttttaaattagggctagaacctgggaaaagcagcttacagcagaactacattttataatgcgatcttttgttcaatttgactagtttgtttttctgacactctctaaagtggtgtaacagtgataagtacttcttcacagactttgtaattaagagagatcagccttaaatataattggcacctttcaagggtttgggcaaagtccagccagtgtcctgtgatgtcagggtattagaacagagaacgtcttctgtcagccaccaccttgctgtgggctcagttatgtgctgagcaccacatcaaagacccagctacgtagcggttgaaaactagttaaggccttccttctactttgaaatgattgttacccacagcttggtttgctacttcctaattcagagccttatgctgaagacatttttggaaaaaactcaacagttttatcagtgaaatatggggaaatacttaagtgtcttcatcaataattagttgatctggggaaaagagacggattaaacactggggaagagagacttggattatagtgaatcagtgtctatgtatattatataatttctataaataggactggccgagtagtagcaaatagcacacacaggaccatgtttcttgcctcgtttcggtgtacatagtggcattttattgtggtactctggaccagtgactagagggtcccaaagactagagctcatactaggaagacaattcctttacaataggtggttaccattagttctgcgaatagaacggagatctgagtctggattccaaagaatactggcaaggcatatcatagtagtaattggtctaagctgagcagggcccagtactgagagggtcaagcctaggagaagaaaaaaagcagaaatggaaccagaatgacaacacttagtaatgtggataagatcatcacagacatacagctgtacaccagtgagctccttgtggacaggaattgaatgcagtataggccatgtagctgtgggtgctcaagatgattgtggaaggaatgaatggttctgcctggcacaaaggaacatgggaatggcatttggtctggagagtccagtactaggacaggttccaccctgctgcccaactgaatctcttagggaatttgctttctgcctggctcaggaagctgtgatctccttccttctctgtgagttctataggagtgggccactgttatggagggctgcggcccctggaacatttttaccattgctcaaagtaaacatttgcagggccggggcggtggctcatgcctgtaatcccagcactttgggaggctgaggtgggtggatcccttgaggttaggagttcaagaccagtctggccaacatgtcaaaatcctgtccctactaaaaatactaaaaattagcgaggcatggtggtacatgcctgtagtcccacctacttgggaggctgaggcaggagaattgcttgagcccaggaggttgaggctgcggtgagctgagattgtgccactgtactccagcctgggagacagagcaagaccctgtctcaaaaaaaaaaaaaaaaaaattgcaggccatgtagtcaatccactagatttcaggaccttggttctttgtcagtaaaattcaaaggtgagtagttagttgttgggaaggtgaccttctgagacaggaccaaggaagcaggcgagagggacagatccttcataaatcctgacagaggatcctgtagaaggtaaaatatccttctggtttggaggagcattttacacaaggatattttaaatcaagttagagagtcctaagccaaggacagcattttatattcagtactgggaaggtattttctgtcaatggtagaaggtcatacttctctgtttggaacaacagtcttgtttccagaaatgaaggatatggaattctaatattgttcaaacattgaaaagaaaacagtgtgagagagtcagtttatatggaaatcgatagtagaagatcacaagtatactgacctattttaaataagatttcatgtagttacagtaaaactttggggagaaagttgtattctttcacgtatacatatttgagagtccaaaattttacatttgagaaagagaaattgtaattcagctatgataccctgtaaaattaggtaaaaattaaacatttcaaatagtattatcagttttgctgactagaaacgtagtatttaatgcaagtactattataaaatattttttaacaagacccccttttcacaaagctgaagctgtttaatgttattaacagagtggtatgtaattattggggtaattcagtttttactagcactacagataaattgtattatagaagatgccttaatatttgaggtttataccaagaaatatagccttctttgataacaatatttacttgaataatttatttgattttggtcaaatattttacttttttcaaagaaagtggagaaaaactcctcaaattattccatgatgttgctgttttctgagtgaatcctggaaccccgaccacatacctctttttttttttgtttttaaccgtttgtgccttcccccaagcccacatcagtctttaaaacttaatcagaggacttggctactgtaatttttttggtaaatcatactatttattattacacagttgtcactgtcaaacctttagagtagtttcagctgccaaataatatgaaaaatactgcagagaaaaacttctgttttctcaaattggggcaatagtacatagcccagttttgagctgatcactctagttttaaaaaaacaaccagagtataactacttaaatgctaaatgccttagtgattggtggtggttcaaactttagtttgaactttaaacacaactggctgacccatccttaagagaagatactggccgggcacagtggctcatgcctgtaatcccagcactttgggaggcggaggcaggcagatcacgaggtaaagagtctgagaccagcctggccaacatagtgaaacctcgtctgtactaaaaatacaaaaattagccaggcgtggtggtgagcgcctgtagtcccagccacttgggaggctgaagcagaagaatcacttgaacccaggaggcagaggttgcactgagccaagattgtgccactgcactccaccctggggacacagcaagactccgtctcttaaaaaaaaaaagaagataccactgcagttctcctggcttttaattcatttatgacagcagaacaaccactgcgacagcatatctgcatgtgccacaccttttttcaaggcagaaggaagagggaaagcaaagatacccattgaccttgacaaaagtcccattggctggaactttgaccaatagccacttctagctgtgaagaggccaggaaagaacattaggcttttacagttgtcagtttcagcaagaagcaaaggaaaaagaggtttggttgtggggtaaatatatctatattatctgcagtaggtctaatatatattcatatttttattattgttttgcagctttgtgtagtcttttggaataataaaacaatttcacctctgctgacaaacttgacatttcttttacttcctaaatttatggcggtctttgcccaatttttaagccataaaatagctgaagaaaattggaagtcattgcattcaaagctcatattaagtaatgcagtctattttaacaggttgctgaatctggcatatatttattgctggccacttgccatccatcaacaatagaatgaatgatgatgatgatgatgattattattattattattattattattatttttaccattttgaagaaaaaaaatcaggctctatcagattttaaaaccctaccagaagggttagagtaatgcatttgcaggcccaggaaatatttgccatcacttacaaaatacctcagatgatcttcagtccatagaaaatatgattttagggtggtaatgatacaggcatattagatgttagtgcttgccttaaagatggtactgtatcacatatagtctaaaataatcatttgccatttttagtgataatcttagtaatgtagaagtctagatgaaaccatagaagagagctttgaaaaataatccatatctcagtactttttttctgcatgtgtttaatgagaaatctgatattgccatttagtggcaatgtttagagtattattgacattcaagctagtaatattgagcaatatgtctcttttcagtaacacaaaatgaaattattagggtgttcttttggtgatgaaatacaatcctcaatgaaaccaagactcatggtgatgaaagaacccgtgtaggatgcccaagtagaggtgaacagatacctttcaaaggaaagaacttttagctattaaaatgtatgtaaagcaaagttctgtttcagtatatgtcaggtaactttttccctacagggtacagaagtaagagatactcatattttcacttttttaatatagcagtacatttaatgctttccctgtatctgcaaggttttcaaaaaaagaaagattggaagttggttttgcatgtcatgtttctgaaagcctcactcttaaacataatgtaaatttttccagaataatgagataagtaacagaaacatacaaagatatatatcaacagcacatgagtaacactttatttggaagccaagtttcccccagattgcatgggtcacacatttggctcaggacagtgtacaaggtaatatatgttaggcttcagactcaatctgagttcatagccaacctccaccaccaagatctgatgttgggaaaattactttacctcttgatttcttcatctgtgcaatgggactctctctggggagactaccttccttgcagagttgttgtaagggatgagcggagaaatgctttacatacttcctgatgtgtaagtgttcagtaaatgctatttctgtgacaaggatgatgataagaaaatacatttttgggacacaccaattatggattttaagtcttgtggaatcactagttgctactccaagattatccttaggaaccagcatttctggtagtattacatttcataagtaaagtccttttatacatttttattattgttatgcccagataataatttgtaaaactgttatcagcagtatgaaaggattactttcagaatcttacaagatcatggattctagatgacaacggatattccacttattaataatggacaattttaaggacagttacttcagaaggttttttttgttttttttttaggaaaaacaaattttcctataatatgtgacattttatggccaatctatttttatgaattctaccttcaaataataataacttacagaattacaattcataatcctttaattaagaaaatagtgatttctggccttaattcaaaaaggaaatgcttatactgtgcaagtctcttctttaacagctttattcataattgccaaaacttggaagcaacaaagatgttcctcaataggtaaatggataattaaactgcagtatatccagacaatggaatattattcagcactaaaaagaaatattattcaacactaaaaagaaatgagccatcaagcaataaaagggcatggaggtaccttaaatgcatgttgctaagtgaaagaagtaacatggctacaatataaaaggctacgtattttgtgattccaattatattttggatgaaacaaaactatgcagacagtaaattactggggattggagagagggatgaataagcacaacatagaggattttcatggcagtgaaaatactctatgatactatggtagtaaatacatgccattatacattgtcaaaaccattgaaatatacaacactaagagtgagccttaatgtaaatcatggactttgggtggtaatgatgtgtcagtgtaggtccatcagttgtaataagcgtacgattctcgtgcgtaatgttgatagtgaggaggttgtgcctttggggtacagaggatatataggaactttgtactttccactcagttttgctgtgcatctaaaacttctgtttaaaaaaaagtctgttttagaaaacatacacacacaaaagaaaggataaaagggaaatacttgtgccctacaattctcctcttgctaactgaagaatggggcttgactctagggatagcttgtttcaaaaaaaaaaaaaaagaataataataataaaaaaatgtaatttaaaaaggtaactatatctgactttgctcattttaatgaaattcaagctaattcattttcatcgatcactaaataattagtaactttattaactactagtaatactagtgataacctcatagtatttgtaaagtttaaaaaaggaatctaaaagaaaaagcttagtctttataaggttgacaaatctataaacaaatcttttaaagatagcacatttcaattttaaaaatcattttgtcactgctgcaaaaattaaaatgtgaaaatttgaagttgtggaatgatatatgtatgagttagaatgtttgggcttacctttttattacaagtattaaaaaaaaacttttgagattagacattacatgaaaatagtatttgttttctatggcacacttttttagctctccttaggatattaagggagcatctgtgatatcccagcaaggaatacctttttttggctgggcatggtggctcactcctgtaatcccagcattttgggaggccaaggtgggcagatcacctgagctcaggagttcgagaccagcctggctaacatggcgaaaccccgtctctactaaaaatacaaaaattagccaggcacctgtaattccagctgctcaggaggctgaggcaggacaatcgcttgaacgcgggaggtggagattgcagtgagccaagatcgcgccactgcattccagcctgggcaacaagagcaaaactccatctcaaaaaaaaaaaaaaaaaaacccacaaaaatgaatatctttttctcttgatcactaaagatctgtagttgctgatgcttcccatgttgggaaagccctgtaagatcttggcctggggaccaagtgagggagatcacctgtcaccacaggcctgcaaggggtcacttgctggcctcacattgaccacagaggtcttagcacagctaatctaatgaattcaaagtttccgtgttaattaaaaatctgccgaataaacagaccaaaaaccctgaggttaaacctttaaacacaaagtgacaacttctgaactcagtgacagcttctgcctggagaccatagtcatcaaccacaagacagatatttttgataaggaaataactacaaatggtagaccctaagctgatgccaaactgttctatgtaaggaaagtgttctcagcaatagtgcttccttccaaaaaggaatggactagatattcacctatgaataagcccttttctgacctctaacttttgagttgctaaattataatcccttagaatgttttagagaaatggacttatattttggtcaagtatttctttattctttttcttttcccctgtaccctctgccatttggtaacagcacaagagtttttataaaataatgtcaaaatttggccataaaaaaagagaaccattaaatgcatatgatccaatttttttagctagaactggaaacactgggttttccttaggagaacgagatacttcttagaaacagaacaatctgtccattacaagtagtgattactagaattctcattttttaaaactggctttatcagtcattctgactctttttctaaagaaattgctattgctaaccacgctttcatttcactggggaattaatgctcagtggcacattagaattcatgcaatagcattaaataattactgtttctttatatatctcctgccaacttagaagtacattaaaattggctgtaggagaattcaggacacctcaatctgaagaaaatccccatccatatatatatattctccactcagtagataagaggcaacctcgagtacctggcaacaaacgaattgcacacatagcaacaagaagtcgagtaatacagaaagaggaaagagaagctggtccacattagctcccgtggtggtagtaaacttcagaaaatatcagagctgtagacagcagcttggcatgaggagaggaattcatggttttccataaatctagtgacaggccaggtcgaataggacaacaccatcttgtctgccccagtagcatacagggcaggaggagaaaagttaggtacagagctggagctgagagccgaagtggaggaggaggaaggctgtgagaattgaaggatgtagggcaggcaaggaaaggtggtgctgtgagggtcttcagttgagccagctcccagtcctgattcggcatgtgtcattttggtgccaggcctggccacagcttctcagaccccagatagagctgccttctgtgcatggaggagcaggagggctcagaggcctcagatgactgtctgaggtttgcaagcagcaaaaaagtgagggctctgttcagtgtatagtggagaaaatcagcgtgagagagtttccagccttgctcttctctacactaccttgggcctcagcttcatatgtaaaacagggataataataccccagagagggtgttgtaaggattggatgtgttaaattatatcaaattcccctcacagtgcagtgtggtagctgtttgacaaagttaattcacttcctcctttacagcctcggcctccataacccatgatgacgacagctcctacagtttgatttgtagaacaaaataatacttctaaaatgtgaaactactgctcatccagtgaaagaattgttgagaagcttacacataatgctttatgcacctcagatctcaaagacttttgctaatttgtggcaaagagatagcacatatgttgctaccagagcagtccgggaagctggccctgaagggcagcctatgctagaagtggaatagaagctcctcacagagctatgggaaccagggctggtgggaagccacatgcccacagacctaaaaacagagtggttagttctagacgcgtgcctgtaaagtagaggttgcagtgcaaactgctgggctgtgggctaactgtggctcacggatttttttttttaacccttagccagcgtagttttgattttttttttttttttaaatagctttagtgaggggcttgactctcgttttgtcacgtttcccattcacttctagttgccctagacctggtggttctgttcctgtctggcccttcaaatgttctgacccctttttcgagcctaccacagaacagggcacaaaccagagagcagacagtggactcagaaccaggaactgaatgtgtcctatcccattgtcctagggttgccagatgaaatatagcactttcagttaaatttgaatttcagataaacaactttttttttttttagtataagtaggttctgtgtaatatttccatttcctaaatctggcagtactgctttattcccatttataattctcatcctcgcaaccgtagctactaagtagtgattgtcattgtaacattggggtaaagaatcttgaaaatagaacaccttgacagcctttgggaaagagagaaggggatacatttatttcagcatttgaaagagcaaagcatgtgaatgagtatttgaatttcatatggggtaaaattggaaactatcatggctagagggctttttttcacatactgggtgatgacagctagaaggtgactggaggtggccctcgctcactgaggaatgatgtgaggacaaggatcattcctaagactgtcttgggtggcatcttgatacctgttgcatgagagggtgctaaatactttcagatgtaattgtggtagactccaggcaggcagtctttgtgaaggcggagtcacatcaggctctgcactgtcacctcttggtgacattagcctcttttctttcctttcccgtaattgctctgcccactctgagttcagctaaaggtcaaagcatcaaaggaaggagaacttccttcctaagttctcccttatctgtttaacctcctgaagcctaggaggactctgaggaggtggcgtgagtggataaaggtcagccaggctcattgagtgtcttctagtcaggtgccctgtcacacctgatctcctcactgtgctgtaagggagataatacttacttttttagtaagctgtattttctgagcagttttaggcttgtagcaaaattgaacagaaagtatagagagttcccatatacaccctgtccccacacaggcacaacctcgcagtctcagcacctcaacccacagtggtgcatttgttaaaatgggttattctttttgaaagatgagagaactaaggggtagaagggcagaccctgaggcagctggcctcaggcttatccactgtgacctgctctgccatgtggctgtgatagaccggccttagtatcaggtctcttgctgcccagttgtccttctggccctccagatcttcattcccataaggaaatgtaggtggtggggatagcattagataagcggtggaaggggtggttagattgccgtcttttcttgatccatggagaaattctcttccaatggataagtgaaggtttggagaaattgtgaattaatttcccccaagttgctttttatctgtgtctctccgttctgttttccagttccaccaaagattgaaagaaataaggttaattcaatgaccctaaaaatattttatctgaaagctctagaagttacttttatatgacagccaagtaattttaagcaaagtttgatggaaattgctgtcaggcttttaaaatcactgtttttcaaagcatcaaccctaagtgtagttttaagagaaatggcacatcactttcaggtttaacaatcagtgagttagattgctcttccacctcagaccttgcctgaatcagacacagccccttgtgtccccaagaacagcagggacatgagtatcactggaccacagaacttcttccctttcatgacaaacagcggactgttatataagtgagccaaacatggcctctgtctgttggtctctaggttatttcctcactgcaggctgagacccgttaattcaagagcccgccaacaccaaactaatttttaatacatctaattattttaaaaatagcccgaacaagcagatttttagcatttagagcctgccttacacgttctgtgaaaccttacctagcatctgttggccattgataagatagagctttgtggttttaagacaccgagctgctactgcccttcaaggtcttctgataatagagttactccatcatgctgcaaagtgacatcacttagtcctaagccctcattccgatgcacctctcccttgggagttcctttgtcctcctccccttctgcatggtgacctcctcaccctaagcctctggatgccctcccatgcaaccctgtacaaagcaccactcattaaagcttgttgtgtgttaactgcctctgtggtcctgtctttttcccagatcaacctcaaatccctcgaacaaacccccactacacagcagtaccttggcacaactaagattttatgaaagctagtgtatgaacctgcatagctaaagattaccccacattgccttacacctggagaggacctttctactcttcctttcttcctccatcttttggataccaaatagttgtgtatatttttaaatgtatatattgataaagagcttgtgtacaatgtaagtttgcctggtttcacatatatttgtccctcctatttatgtgttatactaggaaaaattatgaagctcttttagattgcaaagatcacagacattcttaggtttttaataaaagtaattataatgcctaaaatgcattgagcacttaatgtgtgtcgggcaacatgttaaactctttacatgccttgttttatttaatcatcaccacaaccagtgaggtgtttttattcacattttgtgtgtgcagaaagtgggctcagagagattaattgccttgcttagagtcacactgacgatggcagagctcagatatggacccagtttctcatatgcgttcgcccgtgacccgcttttacgccttactcctcagtaaatgagaagcttttctacaagtacacatagggaagtaaacaaacagtctcagcaggcaaagaggaaaagggaagatgattcaccaacattcaggactccacagcattgttgatagttctatagctgctgtacaggcctaacacagttccactggggaaccatccaagtggcaaaatcatctgtacctcagcctcctcttaacttttttctccttgcctttcttgtcttctttctcatggcttttactgcttcacagccctttctcctgtgtatttgtacttctctgtttctgtgtcactctctggcctctaggttctctctgaatgtttcccagttacacttccctaggtagagtggatggttgggttgactcatcccatccattagtgagaactacacaccagggcgccccacgttggaggctcatggctagctctcagcaatctgcctttgagttgggcaccaggccctggttcattcagctgggccagcatcacatcctacaaactacggaaattttatgtaagaacccatagaaggaggccataagtgggacttgaacttgtaggcttcagtgaaatagggcaatgaaagcccaaagttttcctgagatctgtctggaaaaatcatgtaattttcaaagacttttgatgtgtctaatataaaaatttaaagattatgtgtttaaaacttcagcaaatggaagtatttgctaagagtagttctagcaataaatatgcaagatatgaagtctatgcatactagggaaattccaacgtatttctttcttcagcgtgcttgattagatcaggacattaaacttaatttgttagaaacaacaatagagttgtatacaacatttaattagttttcttactcttctatattcacaaacatttactgagtatgtaaacaggcagtatcttatgtttccatacattatcaatgagatagtaaatgagacagcatcctgtatacttcccttttagtcctttagaatcttttcatagtgtagcagatactcaataaatgacctggcctaattaatgagccctgatgccaattaagaagaaagtacaaatcaaagaatcttttcttataagcatggagtcaaggggaagtaatactatttctttaatgccttatacccaatttaatattttctgggttaaaataatgggttgcaattatgaaattttggtcctttgtttcctttcacacagcgtgtcagctctacctttcaccaggagcaaatatacgtattcaggaagaaaacatctttggcttgctttcagtttatctttttttgtgagggtttcactactgcatttgaaatttgggcccattttacttctacgtggaatgtcaggctttagaaccctaattaagttaatgaaagactacaaaagaaacctaaggagcctgtgaagagaggtgatcaattctgtccttgttagtagttaacttttagaagtgacttccttgtcctgccagctcatgagaactgggtctagagaaattaaatgactttatcctcatcgccactcagctgggtaatggcttaatactacaaaattaaaagctggtagccttttgatgtttcaaatatttgtgtaagtcgtaaatctgagttaacaagttgattttatatgtgacttttaaattgaagcttatagttattctatgcatgtgtacacacacactcacacaatgtcttacagttagctttaatgtggtaaatcatttccagaagtgatcagctggtggaattggttaacaatatgactgttcctctttataattgctggataaacccctcccagtgctttgttcagggcattttgaccacatcattttcgtcttttctaactttaactcatagaaatcccatgggatcaggaacccattttgagaaatatgtcagcaacttttgaaatgtaggaaactaaccaattagtgtcagcttttcccttgagggaagaagataggaaaagttaatatatactacagaggttactttaggagatcctttactagtggtacattgtataagtgatcatttttgacaaagctgaaacaaattatcgtaacttttttttctgttttgatgttcagtatattccaaaagcttttgaatttataaagtatctttggaaatttacaggaatgaagaatttactaaatgtagtacatttaatggaaaaaccaaataaaatcaaatataatctctaggtgttctgtagattttttatatacctagtctttcagaggctcattggtttctatttttctgtgatgtgaatttaattagttttaatatagatttaaaatttaataaacgtgattacctgccatctgtcaagcagtatgcaaggtgcaaaaacatataccacgatcatgtattccttacatgcatcctgtaaggaattatcccaaattttcagataagagtcacaaaaactgtgactcatccttaagtatgtgactcatcagtggcgttgtagggattataaatcaagtcatgtgaccctcaaatctgttttacttctcaacaaaattaatgtataagaaaaaaatcctgaaaacactaccatatacacattcttttgattgttgaaagatcaacaatctgattcagtaaaggaagattttttttgctgactcattaaaggaaggtgatgcaatgtgttggttaatgccatgggctttggagtcaggctagcttggagatgaaccctggcaccttgtctgtggaaaaatgtggtgactgagtaaagttgttttttaacttccaaacctcagtttcttcatctccctaacaatggtaataaaacatatttcatagggttgtagcaagaattggttacaatactaaagttatagcatttagcagagtacttagcagatagtactgattcttggtaactgttggtagtaatagtggtgagttaggaaggtaatttacaagttggttaaagatgctgattgttgtgttcaggaacatatgaaaactttgttattaataaaatgatactgatctcaatgaagattttgagtggtaaatggcccgtaaataatatctataactttgtgtgatgctttaagatactctaaaatatggagcctgattggaacctttttcaattatgtccatattttgattactgagttctagacagttgaagagtcccaatccttttaaaaaatatgcatacaaaaataattatatgtgttctttgagtcattgaaaaaagtttatacaactaatttatggcagagggatttggcttttaaaaccattattggtgtgtagactctgaattaggaatatactggatcaatcttcagttacatacatatacacacatgtatccaattaaagattgattacattaaaataaacaagtttttccaaaatctaggcataatcacagtgttattttttatttcctgtaaatattttaaaatacttctccatatagtcttcgtcaggaaacatcaaagtggtttaaagggataacctgaatatttgtctgtatgctgtgaggccaacaaagtaagaagaactttgtgcagaaatataaattttaaagatagtctttgcagatttaatctgttatgaaaatgaactagataaatgtagacatggttcatgcttttaagataagctaaattcctgttgttgggaactgacttttgaaaatggtatttgcattaaataggattaaatggactcaaaaacgaaaacttcccatttgtaaacataaaagggtagtgtgtatgtgtaccagcatgtttgtatgagcatgtgtgttctggtttatataatcataattcttttacttagtcatccttttaactaatgaattttaatgttttagcctttgctcttcaatatattacctattttgtagcaaaaacatctccattcaaattataatcctgtttttattttttttttcagatgatgaaacatgcttggaataattataaaggttatgcctggggattaaatgaactcaaacctatatcaaaaggaggccattcaagcagtttgtttggtgagtagatgtgctttggtttcttagtgacgataacttctccccaattgcttgagcttatggatggtggagaagtctgtgtaacatggccctccaggccatttggttaggaaacttgcacacctgatggaattagataaggattgtgcatagtgtgtccttcagctagagtagtggctatgtgttcgaataacctgctggaataacctgcgtaactttaaagagtactgacgcctggggcatacttctaaagattctcacttaatggttatagggtgcagtatcataaattttagcctctggggtgattcctagcatagaagcacttggtgggctgcactaactgcttcctgttaggtaaaagctgtgcctttatagataatctgggcaaggcagccagccatggtgatcttcactgtatctcaattttggctataggtttctcctgtttgtaccatggaagagaaagtgaggatggattaggttaattgaacttccatttatccacttttgcaagctttattgcatttggttcccacagcagccctctgtgactggtagtgtgggtattaataacattccattgtggaagtaaggaagctaagtaacacaagggtgtcatggattctttgggtcacagagctgcccagtatcctcctactgcacttgatttctttctaatcctcaaaatttgtctgtaagtaacaggatgaagggaatacagtgttactctggaacttctgaattcaacaatagaacactttctatactttaactgaaaatgttaaataatagcaattcacataataacagtttcagcacacatttattgagcacttactgtgtgccaagtgccattcatgcattatcttatttagcctcattaaaatatacattttataggtgagaaaaatgaggcccagagaatagttttcccagagatagccacctactaactggcagagctgggacttgaaccctggtgtggctaacattagagtccatgctcttaattctgacattttgcttttccatttatttagaaccttccatgtgtttggctttacttgtagcactggtgataatgaaaataatacgagtctttgcacaggtctttacacaagtctttgcctagtacacagcatataatatgtaaatagtgatttatcaatgcgccaggtggttcaatatatacttccatgaaattctgaggaaccagtaggacctcaggttgggagaaaggcattgcagggtttgcaagaacaggtagaaagagctgggaaaagtagaagaaaagagactgttggtctatcagagtgacacagttttgagatgaagagcacctatacctgaagtagaggcagtagaagtaattccagacacttctaaagtagtgtttttaggacccagctaccagttaacatgggtaaggggaggtatgaattgaagagagaaactctgaaacctcatgcagagccagaggcctttattttttcattgtttattacaacattttttgaaaaaattataactccattttgcttttatctctataaaagtctttggtaccattaagaaatcagttaatgtgttaaattgccataatctttatcagagggactatttggttctctgttaaaacatttatgattttaaaatttgttattgaacattaaaaatatactaggtctcttaggcctgacgtttgctttttggttttcattggctttttcggtaaaaaacacttttcataatcaagaacttgctcttagaaaaagagcttcaggtattagcataaggaaatgaaatattaataattcaaatggtatttaatctcattccatcttcaaattaaaataagatacataatgattttcttattatagaaataccaatacaatggaacttgttacaaagacatacaaagttttcatttttatggatgagaaatgatttctttagcccacttctcagccaaatttcttatctgtgtaatatgtagtcccgtatattcgctcagcaaaccagggagaggataggaaaatgtaagttctttaccacctggcttcttaggaaatagtttttagtttgagctaagttattttgagtcttgaccctaaaaacaacctttttggagaaagtattaggcattatgaatcttttcccagttattagccgttggggagctcttcaggtctgcttccttctcatggttgtttctcaccagctatgttgaagcatccatctttttcctagacagagtaagactggttccttcctaaacaactttaatgaatataaaaaaaatcttaagtattcatgatctcccaattccatcttaagcaggaaactagaactatttatttcaagatttcagtggtacaaaagatttcaagttaaactgtacctcaaagagaggtattttgtgcttgaccaattatactcatttaaagctaaaatacaagaaatacaaatattaacttaaggctcttaataacttagaaatgaaatgtcaatgaaaatatgaagctgatatatttcaaaatgcccactttaaaatattccctccagtgtctctctgaatccatagttctagcttcaaaaaatttaaaggaaattggattacagtaaaacatttcacaaaatgcaagggtcttcaggtttctttctcattattattagataagatttacaacttttatcttttttgaaaatcaagtgttttaatattctattatttatagtttcctaatgataacttcttaacttggcatttgaaaggcatgtgccagtgaaataattttcacttatatttatagatttggtcttggatcgtccagagtgctaattacatataggaagtgtagtgcccagtctttcagcagcaattcattgtgctcctgagtgcaggatcggctgcctgccacttgcacagccaataacaaggatgaagttcagtgaaaggaaaatgacttttatttccaaagctaggagtggcaggcttactcctctagaaactgcttcagacttgaggctgggaagagggtcttaaaaatgggacttggactgggaggcatatgggaagggtgcctgagtataagatctgcatgtcttgttctggtggctgtatctagctgtagtctacctggagtgcggctgacatatcaacaatagctgggttgctgactaactgccttgaggtagtctctgaagttttgcagctgggtctccatgcttgatctgtcacaagattagcccctggaacttcttagtaagcacatattagatccaagtatacagttacgtaaatgttcatggggtgaaggagtgcatagtgggaaaggggagtgaagtttcaaagcatgtttcaaggggatattttaagactaaggaaaaaggtttctacagtttgtttcaaggttacatcttgagactggaagaaaggacaaagaaaaacattttaaactgcgttttgaagctaaactactcaattacaattgggcatcattgtcacaattccacaggacaccataaggaatctggagataagacatgacttgtttgttctaagtttataggctaagtgcatgcctcatgactctaattctagtactctggaaggccaaagtgggaggattgcttgaggccaggagtttgagaccagcctgagccacatagcaagactcatctgtacaaaaaaaattttaaaattagccaggcatggtggcacacacgtataatcccagctacacaggaagctgaggcaggagaatcacttgtgcctaggagtttggggctgcagtgagctatgattgcaccactgtactccaccctgggggacagagcaagaccctgtctcaaaagaaaaaaaaagtttatagactaaaagatgcacacgtgtaattttaatacaagatagaaggtgttgaatgccagggcaacaggaagtctccatgtcattggaattcagaggaaataaaccacagaggtcaggacttgtaggggatggagggtagttagcatcagtcagaattcatacgggggtgaaatttcattttagagtaatgtcttcttagaactatcactaaacaattttagatctaattatatttaaagttttgcacaggtgcactttgatgtaattacatcagtcttaaaaagtctgttgctccttggttttaggcctattcttttcttgctagagaatgcaatcacaggccgggtatggtggctcacacctgtaatctcagcactttgggaggcctaggtgggtggattatgaggtcgagagattgagaccattctggccaacatggtgaaaccccgtctctactaaaaacacaaaaattagccaggcgtggtggcatgcgcctatagtcccagctactcaggaggctaaggtaggagaatcacttgaacccgggaggtggaggttgcaatttgctgagatcgcgccactgcactccagcctgggcaacagaatgagactccatctcaaaaaaaaaaaaagagagagaatgcaatcactaatgaaatttctaagagaagtttctgagacatttatttttataactcagaagaaactttaaagattagtatatcagtcgatagcccgtgataatttttagtttggtgctgttttatactttcattgaaagaattttagactatgtttaatattattgcttattaataaatccagcattaccctctccctttcttagttatggtcaatttacatatattttatctaggcaaagtattttatcaaatatttttctgatcttttcaggtaacatcaaaggagcaactatagtagatgccctggatacactttttattatggaaatgaaacatgaatttgaagaagcaaaatcatgggttgaagaaaatttagattttaatgtggtaagttaaataagaatttctaattcagtccttaaatttcagttaacatggataaattctgtagtgggccctattattgtattataatgtaccctaacaaaaatattgcaactttaggtagtacaaatactattatcttatactatattcttaaattgtcctcactacacaaatgtgtgtctttgttttttggcaaatgaagagtaagagaaaagaagttagtatttattgagacctacatgtgcctagtattcttgttcagtcccactgcaactctatgagatgggcattaatttcacacctttgtatattaaacatcttaacctcagaggcttactccagattgcacagctggttgtgtgtcaagagctgtgattctgatgtaggtccatggggctccagtgcttatgcttttacactgtgtcatggtgtatccagcagtagcagcagcattcattttcccgtaaagaaagattcaaattttgtggatcttattcatctctcagtaaaaataaattgattatatatgtgatatattttttaaattctgtatgctatcattcttagcaaatatttcatggcccattgtatactgagggaaagaatcagaattaaggatagtgaatacttctaatacttcttgataattttgactggggaggactacgtcttatcagctctaatttgatagtcattgttttactttataatgatattgacaaagaacttatactaagagaagaaagcatgtaggccatggaagtttttagtcgttcacttcagtgtgtgttatcagtattatttctaatctgagactactttgcagaaattctcgtaaagtctcttgtctttcgggtaagcatttgatagtttctgtaaatcccagtcaccacgcacaagtaacatgctgtgtgttgaaagtggacaaagagaatttccctgctgttgcctctgctttgtggcactcttgttctctcagagaccaaatgaggacaccagtgttaggtagaatattaaggatcagtaaagctaagtctttcccccatctatttcaattaaaaacttatataaattaaaagtttaatattttgtttctactcccctaattaattgctatatataccgcatttgggagacctaaaagacaggcagatgagtctgtgtttaatttgcctaataattgaatctagaatataaaggagagaatattccgatcaatattaagggaccttggggatcaatgtgttaaacccttctattttaaacatgagagagcaggcataaggagctagtgatttgctcaaggttatggagctatttgattagaatgacctgtggtagtgctgatattgatagagctaaatatgaaaaattaaagcactggaaaaaaacggtttcattttggaggcttgctttcttaataatacttctgtggaccgggcgtggtggctcacacctgtaatcccagcactttgggaggtcgaggcagttggatcacgatgtcaggagtttgagaccagcctggccaacatggtgaaaccccgtctctactaaaaatacaaaaaatagccaggcatggtggtgtgtgcctgtaatcccagctactcaggaggctgaggcaggaggatcgcttgaacccaggaggcggatgttgcagtgagccgtgattgcaccactgcactccagcctgggcagtagagcaagacgccgtctcaaaaaaaaaaaacaaaaacaaaacaaaacaaaaaaacttcagttctaccttcttattaaaatcagctcctaccttcaaaaacctgcaggcttttctttagctatgtatgaaaccgactgatatctgtcttttcaagaaagggtaggggaataataactaaattcctctgaaacactaatgatggaaaactggaaagcatactttagtaacacttgacttatgaatagtgtccaagtttcttactgaatcttgggttggtccatctggtaattgtagcattgttgccccaaacctcctcaaatataatagcggtttttttcttttcacgacctgtgcaacctgtggtagtctgaggagctctggacttggggccagaggttggggttggtggaggatgaggagcagttttatttaaaatgactaagtgcaaaggtaacagacaagatgttactgtaacagaaggcagttggctgtcctcagaccaccacaggatgccttgaatgtgttccatgggtcctggagacttgggagaaggaaagatgaatttagtaggggatatcagactatgtagaagagaagaatttactgggcttccttacttgtaaggtgaaaggattagactaacattgagttattgctaagatactgaactttgaagttttctttatttaaatttttattttagtttttaataaaattttactcaattagtatgcagacttttgcatatatattttaggcctgttaatgatagttttgggttatacctttcaagatataattttaaaatatatacaactgttatgtattcataaaaattaaatatacatatttcaaaaaattacagccatatttctcaaatgtctttattatactattttcttaatataagaggtcttgaaaaatatttgttgcaggtctctttgggtattaccatgttttccttttaaaaaatatgttgtcaacaatatccaaacaataatgtttcccatattaaaaatagtaacatacaaattctggagaggtatattgacttacttttctaatcattacattgtgaagttttccagcttactgtattctagttggttttaatatgtcacattagaatttgtcttatattcacccattctatccagaaatccaaatgattatttttaaaattacaggatttttcttcaaaaaacattgagaaatttttctcatttatatgaagaaaggagaaattgaaaaagccttagcaaaaaaaaaagaaaaattatactaaataacatgtagtatcattctagcttataaatattattacttatattttagttaacactttttcctgataaggtattctaattgacagtgtaagggtattatttaaaaagttggccaggcgcagtggctcactcctgtaatcccagcattttgggaggccgaggcgggtggatcatgaggtcaggagattaagaccatcctggctaacatggcgaaaccccgtctctactgaaaatacaaaaaatttcccaggcatggtggcacacgcctgtagtcccagctacttggggggctgaggcaggagaatagcttgaacctgggaggcaggggttgcagtgagctgagattgcaccactgcactccagcttgggcaacagagtgagactcagactcaaaaaaaaaaaaaaagaaaagttaatgcatctaaatttattgcaaagggaaaataaaaatgaaacaaacattattgttgagagtttgtttatcctatggtgctcctaagtataaacaaattttacactcaagaataaatttgttaatgtgaaatatccaatttatatcactgaaaagtataaaataaatgttttgtattggtttatactgtaattaactaaaactcatttccttttcattagggcataggaagtcgattcattttgcatacttggtagcacaaagttcaaatgactttaatatctggcttaaaataagttgggataatatgttctggggagtaaggaacaaggacttcacagaaggagcttgtattcagttcaagtatctgtagaggcacatagatattagcagaaaaccctaagtattgactccatgaatgcattttctaattttaactcaaagtaatcttaggacaaaggatctaaaactgattcttggttagtcactcttcattcactcatgtgttatttactaagtatcttctaaggatcaggcatttacccttatggagcatttagtctagcaggaaaagtagtcagagaaccctagctaagccaggctatctcaggagggaagaaatgaaaagaggtcaactactatttggccaggcgtggtggctcacacctgtaatcccaacactttgggaggcccaggctggtggatttcttgaacccagaagttcaagagcagcctgggcaacagagtaaaaccctccccaccgccgccatctctatttaaaaaacaaaacaaaacaaaaaaactccagcctgggcgacagagcgagactccatctcaaaaaaaaaaaaaaaaaaaaaaggaaactatttagtaatatgtgatacataccaagtattatgataggtgatttttttcatgggtgtatcgtgtttaatctttgtgacaagcatacagagtagtaactggtatttttccctatatttatagatgaataggtggttaattaggctgtcccaaattatgcagcaagatctctggtttgaacacagtctgcctaactcaatgaccttgtgtttttttaattggagaagaaatgcaaagagttgagaaatatatacgcagtcagagaatttgagtcctctgaggttaggcatgtcatcttaatattagattactaattagagtttattgttcaatagtgatttgataaatatttgttaaatgaatgagaagttaagccatcttatcctacttcctgacagtctgtgctatactcagctggaagaaaagctcaggtgcaagggtagctgtattgtgtcatctgtttatatagttacagatgatctggagttcaagtcacttggtctacctgttattacctaacctatttccagaacagatttgtagtggcccctgataacaggaagatcagttgcataagaacaaatgatcaagggtttcctatttgggcatttctaatttcaattgtgttcttttactggcacttaaaacattattggttacctagaacctcacatgagaaatattgaaaactatcttctgtaatgaattttatggaatatgtagaatttttctccagataacaatttcttatattaaccctctgtaaaagctaaagctgtgttaaaattttccttaaagctgtatttctggactgcagtaaagcgatatctcagtatgagaggcagagccttgagaatggcaaaggatagatgatcagcctgctgtggacactaactagcaacaccctgtaattgtgatctttggcaagcatctggatcatgcctttagttgtaatgaacactttgtgttttggagaacagaagttctggtggcaacagtgactttttttttttctttaatgttaagatccagattgtttgcatacccagttggaatgccctcctacttttcaagaaagtaagttgtagggttccctgtcaggaggatatatgttgacttcaagaagcaactttggatcttctcaaatgcatgactgagtactggcttaggtccagagttccatgccatagagtatgaaagaagttacttttgccttagtgttgctcctgagaaaggtctgttttagagccacattacatcctgatgggcgcagataactaagttaattatcctgttaaatgaagttattgagtgtgttccatctgaatgctagggaatacctaccaagagtgatgatttgggttttggttttcagaggatactgtgctgttctctctgatggtaattaggactgctgcttgagagcctctggacctgcatggtaaaaccagtctattaacatagagaagagaggtatttgcatatctttgtggcccacagaacttggactttgttagcagtcttaagagatttgtcacgttgcttaaataggaaaccaaaggctgccaggacacactgtgacagactgacttacactgtgaaatattgcaatttaatcgtttaaaggagttgtatacttttaatcctcaaagtgttaatccagcacacactttgaagtatcatttataaataaaggtgtatgctaagcctaaacataggcaaggcttattggtagttaccagtctttaatcaatggttttgaaaagtctcatgttgcttctaacaaagccattgattaaagtatcgttatcatgtgttagtaatggagcagttgttatttacattggattttggtgaaacagttaatattaaacagaaatattgcattggtatgtagtgggcagttattaaagcttgcttgattctcatgtatgataatagtcccgtaccccaggctcataattcactaagtagaaagctgatacagagtttggaggaatagctagcaaaagagtagtctctgattgtagagatcggagaattgtccttttaaaaacaaaaactattacacttttagttcactctgaaaatcaaacactcagaatagaatttaaatatgtctgataagttcttttccaagaaatatttttccatttaatgcaatcaatcagatctgtcatgctgtatggaatcataagataataaggagaattctaatataagtgtgactctaaataaacatcataaggcttgaagatccaaagaaacaatttattatctgttcctcgagcttgcatctcgatatagctcctcaagcaaaaggaaactggctgaatctgctccaaaactaaaatttgttattttcattgtcaagcctgttatttcacttagtgaaatctattaaaatacgtcatcgtatagctaattttggtgaataagttgcctataaaaatatcaaatttcagagttgtttaaagtgctgtcttgtctagtgtgaagaggttggtctttcaggtactcatttggaaacagattttgacgtgttcattttctctgttgcctagatggggttagatacttcctgtccatgatctcatggtatgttggtttagaaaaagcctttctgtgcagagagatggagcatgatgttaggattgaaggagggaagcatacaaaataatttatatattagactctctttttcatgttagcagtctttgtcactttatctcgtaaatttacatacatgtatagtaaatgagtagacaaaaacatatggaaaagggatagatctaaggtggaagttatcaatctcaaacacccaagacaataatagagattagtactgaggcataattttttcatgatttgtaatactcatctcttgattttaggtgtaaatttaggcataccatgtattttattcaatttatatgaattcaatttagatgaatctggtttagtgtgttctttgattaagtggtcattgctataagtaaatcaaaatgaaagaacaatttctccaattctgatttttttattggttggtcttaaccaaaaacttccaatctcctcttgcttatcagttgacattaactaataggtacatggaatttaaataaaagacgggatgtacttcttaaactgccactgatgtaagactgtgtactagaagccactgaatacatggggcatactggaatgcaatcctaaagatttaaaagggaagttacttttattttaaaacaaactcagataggtagactgcaaaattcacattaattgttaggataaatctcacaagatttagtgttacaggctgctttgtctgcctactgtcttccccctgctgcaaataccccctctgtcattagggtaagtcggtagaaaacttttagaacattatgactattaataagaatgtattcatttaaatttattatttaatggaaattagaatcagaagtttataaaaatggcctgagaccctcatttgtagaaattcacttttgaaaatccagatttcatacaaaatatatcaagccccaaaggaagttggtcaacttctatatttcaaaagaggatttttaagcccttgagaaataagacctcatatgggccaaagaagatgagtatttatgattctaaagtttctgattttccagtgaccctgggaaggtaggttttagttcgtttaggctgagctgcacagtggtagtggcaacagctgtctattgagtgtctgatgagtgcgttaccagctattgtgtacattgctttacatcatggaggaattcattgtccctttctacgtatgacaaaaccaagactcagaataaattagttatctgggacctcaaactcagatggcttccaaatcagccttcaatcccaggtctttctgatttctgcaggatagccaaccaatttggtgtggtgggagaatttttatcttcttagtccttttcatctacgaatctataaagagttaactaaagggtctaaatttcaatcttttggcctaaaaacataatacaacctagaatactgaaagagacctcaaattaaggtttctaaattatttaaacttaactttgaaaaggagagagaaagaattatatgttggaaattcgaatgtggttctggttttcaaacagagaagatggtgacttgagaactagtgatggtggtggtgtgatgttccagagcaagatttattaaagacaaggacatagcagtcactggtatccttcatggattaactaacaaaccagatttgcttcttaaacaggctcactggacagactattagatccatgaaatccaaagccatagcaagtgaccttgagtatggcaccttgcagggtcatttctcaatatcgtacagtacaagataaatagaatttaggttttagaatatgtaattggatcaataactggttgaataactgcatccaacagttgattgatgtctagctgaagatatatttctggcagtgtttgacatgactcagaccttcaccttggaataatttttatcggatgtctacataaaggtcttgattatccaaaattttcacggcaggaagagaaaatgcattatgtcaagaacctatagccagaataagaatataagatcatcttaacagtcttcaataggcagaaatgtgggaaactgttaccaggtttaaaaactgaaaaacacaagtactaattgagaggaatatgatttgagggtttaagtttattagattttattattagatattattactcttaaacataggaaacgtagtcacgtgaaccaaactaaatacatgggttagcttcgcttttccttatcagtaattttgtagaatattaaagcctttgccaatatttatgtaaaattcattcagagtgatagacctcaaagttaaattacacctatatatagtacttttaatcagattatatcaggtgcacattacaaattataaaatacagttaaacacaccagtcttattttgtgatgtttttgcctaactttgacttagtaattctgtctcctaacttgttttcataattgtccttttataggaatttttttgaatttttttaacttaagcaattacttgactttaattgttagattcttaaacctttttacagagagcatgtaaggataaaattaatacatacctccttttttttctggaaatattttatcccactaaaatgtagactcaagtgagcttgaggaccttatcagtccttattgccatttccctatcacctaggacagggtctggcacatagtagttgcttaataaatgcttgttaaaggaaataatatcccatgattttgactaagtttatttgccagatattgactccatatattataaattgctgtgagtcccatgattattagtgaatggtttgatgttaggcaaaagtgcagtaggcccaatgaacatgaaaagaagctaactaaagcttgaaatgtgctttataatctaaatagtaggttagctattctaacttacctagtaacagaatgtaagacagatctatttactaatcaagtataaaatattagcagtaattactaattatatgaccatgaataaagagacttggtgcattatcctgtgaggtatatagaagtcagaatagcagagccctgaatcaggagccacagtactcaagttcaaatcctgcttctaccaattattagttgtctgaacttcaaaaagtcacattaaccactataagtctcagcttcaacattttaaaatggatataagaatagtaattaattcataaggtcattgtgaggactaaaagagtctatataaagacattagcacaggacctggcacgttgtaaataataaaagcaagctattattggtgtaaataagggctatttcagcatggtataacatacatgattattatcatgtcctttatgcgaagatgaaatatcttctcagagatgagaagaacaatcccaagccaaaggcaaaaagttggaaaccagcactagaacccaggtcctcagacttcaaatcctatttgcagtccagttgtgcatcatgatgaaaagattcctagactaatgttgaagtaccagcctaagtataggctgaatagcctttcaggaagaaaaagcagacaaatgaataaaataaaggagaatgcagagcagaaaaaaaaaatgccctggccccattatgtttacacaaatagagaatatcaaatattgtatctgctgttgaagagagaggaaagaactttatttgacaaatatttttgtaattttgtttaggagtcaaaattatttttatctcttgcattagtccgttttcacactgctgataaagacatacctgagactgggaagaaaaagaggtttaatggatttaacagtttcacatggctggggaggcctcacaatcatggcggaaggctaggagcaagtcataacttacatggatggcaacaggcaaagagagaaagagcttgtgcagggaaactccctttttaaaaccatcagatcttgtgagacttattcactatcacaagaacagcacaggaaagacccctccccatgattcagttatctcccaccgggtccatcccacaacatgtgtgaattatgtgagctacaagatgagatttgggtggggacacagagacaaaccgtatcatttattttaagtatgttttttcctttatttttaaaaattgtcatataatgattgtacgtattttgggggtccgttagtgatgtttcgatacgtataatgcacagtgatatttaataccttaattttaaaagggagaacatttccccctgtatataaacttctctgggcaagcataagatttgaacaaaatttaagtatttagtataatttatcacaataatggttttctgaattgtgtactatcatcatgtttgaattttttttttccatagaatgctgaaatttctgtctttgaagtaaatatacgctttgttggtggactactctcagcctactatctgtctggagaagaggtaagatgaaaagtggtatataaatgtgaattataaagtgtcttaaactacatttttggtaaaatatgccattcgtgacatatatttagaaggaatctatggaatttttatatttcaatgaagctgtagcttacactgagtttcttacaatatgtactaatgaaatgagcaagctgggaaagtttggcagaacatattgtcagggaatgttaagtaatgcctttagaaactggctctattatgttatgtatggtgtgattatagctacaaattatatgtgcctatggacaaattaaagaagtttagtgtagtggcgggcttgtggatgaatttttttctttgagaattattttaatgttaatacaaataaaaacttttttaaatgaataaagcctggcaagtaagatataaaaattgtagtttttatgtaattaagggggtgagacacttagctaccaagtaaacagtcctaaaggccagcatccctgtatcaagtgctttggagctcttcctgagtcaaggcttcattaattatccactgcttggagcaaagcaggaattttaaatttagctgccttttattgatagattaagaaaggatttttgtatcatcctcataaaggtcactgatgctattttcttgaaaggttttggacaactttatgaatatcgtttgagtgtccactaagggttgttggaatgggcctcatctttaatgttgacagtgttaaatgttgacattatggaaaaactgtcacatatttcagttgcacgtcagtcagatttgagttagcctcagcattccggctggggaaagagtagatcttacccaaaccagtatttcatgtattgctatgctccttcaaacagatttaagcacagcaataaatgtttaatgagaaaagctgcttgactttgttcctgtctctcaagtactttcttaaccaaaacatacaaccttcacaatcttacatttcctctctgtttagattttattctaccttagatcttttcaaagtatatagatgacttctgtattcatctatatctctcctgttttagtgttaaatgttgttcattgtgaactctgttaccttctcagccagggtaatgtgatcccctggtctgttatgcctcttcctcccttttttctgtttttccactaccagataacttcatgtgttcagttcagtttagggtatactaaggattaagccaaaaccaaaaaaccctaaaaccctatatttttaaaaagttatgtttaaaattaactaatgttattttagttaacaggtttctgcttttagaatacttgtctttgagtatccaatgccaggatgttctcattgctttggacataatatgctaagatgaccttggttttaactttttccataatctatgtggaggtgagacaatttggaggaaataaggattgcatccttttgtgtctgggctcaattaggataataaagcatacaaagaaaaacacatatgtatctattctaaatatacatcatgtttgattaggatacgttttcactcagtgttttaagtttacatacatatatgtgtttctatatatgtgtatacttgatatgtatatatatatataattataatacccacagatattatagtttgcctatagataaaataatttgcctaagactttgtaaggatattttttaattctgtatagtgaactttagtaaacaaatggctacaaagaacacttccattgcaaataactattctttcagtctgttttgccattatcactacacaaacatgtttttattacatgtaggttttctgtattttaaattttatgataaaaatttaagattttttcttttatttttctatctgtagagtgctttagttatagggacccatattcttagcatgttttttcttatagtttccagaatgttgaacagttagattattttcagtatctttttattttgaataatattgctataatcaatgaatatttattctctgaagtggtgttggcaagtgagaagtgattaatactggattgttttaacatcatcacttgcctatttctcccagttacttagaccctgacaattgattttcatttgatgaatgcattcaggggaattggccattaggaatgtgatccggaaaattttttaccccaggtctgttcttgagctatttgtattcatatcaaaatttttttaaatgagcattcatttaatagaacaccaacatagcaaattatgaataagttggttttaaatagttgataaagttttataccacacactttttacatagatcagacaatttactaaggtgtctaggacaatttgtctttctatgtatctcatagagggacttttaaaccaccataatttaacattctgatttcatcactgaggctcaggagtattttaagaacaaatcaccatcagaagtagatagaccccacattgatatcagctcaagattgttaaatttgtatgcaaaagcaggagaagaagtactactgatttgtgatatgtgtttcaggaaagttacagttagaaacactggacaatagttaagaatcccagcagaagtctaagctaccaaaaaaataatagaaacatgaagtacctgtagtaaactttgattacaggcacatattcaaaaatttgaaacctcgtagctcagttaaaatattttgtagcaccataaaaaagtcaagcatcagtattttcaaatgctatataagaagctcaaccacaagaattacaaacagataggatggggataagatgaatattaaataggaagaatcagtattaaaaataaatttaaaaggtagcactgctctattataagctggaagggagctaaaattctcactggagatagtaaatatagcagcatctagaatatgattacccaaaatatgttctaaagaccactagtttcttttgatatggcaggataaatctgtatctgtatacatactaaaaataagtttgggaagagctacatcctgtattctttcttggaaattcagaatgcacaaaaaaagaagtgaattaacttttatttatccttgcattttccacacttacttaacaatagccttcctctattaaaaaaaaaagtgacatctgttaacagtaaattagaattatttttcagaacaaattttggaaatactactacagaataagagtaaagcaaagatgatattgaaattgacaagtgcaaaacgtgtaaaatatgacattgcaagagaagatgacacatgtagaaaagaatttatgtgactataccatgtaacattatttgttttacaacagaaaccaatagctatattgagcagaaagtgaatgtaataggacatagaaatgttacagaatcagagagagggctgaagagcaacttggaacaaaaagtgtcaagttggcataggggatctctatagctgtactatcaccttgggacaccctgcaattagtaacatggactatttcttccacccttctgttactctactcaagacacaaagtccctgaagaaagaggctaattgtcagagtttcagttacatgcagcctctttggggatcttggagaatgaaaaaggatatgctagaagtcttcctcaaagtttggattcatatcccgtgaagactgagtagtataaggaagtatagataattcctgaacaggaaatcgaggccctgtgagaagagtagggagataggacgtgtaggagccaacaataagatttcgcccactatggtgaatataaatatggcagagaaaatagacaaaccacatggaaactgacagttgaataagatacctgaaaaaatgtaatctgatttgcaaaaatattttgtaagctaagagacgacatttagaatagaccagagtttttaatcctcaaagaaaatattctgccagtacattttaactttgtaaaatagaaaaacagtagccaactcctggaagccaaaatgattaagaactagctttcaaagaaaaaagatgcggaagacatcttatccaagactggtaaaagacacagaatggatttttacagtagatgagtttactatgataacctctcattttgaaggcagcaaaaggatttttcttcagattccccctaaaagttatccactgctgcaaacaccagtatgaaatactgctgaaagagatttactcaataaatataatactgccaaattttaagactaacaaggaggaaacacagaggggagtaggattgtggagtagggaggagagagagaagattaagaatgtcagttaactggtgggaagatgtagttgttttttcataatagggttaagacattcggagtatttgggggttagaaattgattttttagagtttgtttagttatggataatcgtaaaaatgtttagaaattctctagaaaattaggatatatgactggttacctttcaaactcaatgtctgccacaattcattagaaagtgagtcatctcccagactacccatctgtctcctgcctgattctgcaaaaaaatcagagtgccagaaaatgtgtatgattcaaacagagctgtggaaaaacagagaataaagttagggcatattaaagtttcagataaggttagcacatagcagtgtattctgccagtttgtaaatcatctgggctttggatggaaatgtatcttccggtttcctagtgaccagagcaaagaatggaagagcattaacagcaatctggttttgctatttttatgaatacaaaaaatttgataccataaaataacccacatatattgcttatattgaattttccataaaaggtagaaatatgtggtataaacaagaaaaatccaacaatacatttggatccaccagaaatacattagcaccctcccaaatcctgcctaaatactaaattataaaaattgagctcacatttatcctgctttcttatatatggaaagaactttaattatgatctctaattaggtagatttaaatccagaaagtagagatatcaacaaaaggcctaattggaaaaaaaaaaaaagaattgaaaacagtgatcacaataccttaaaataaaaatatatgttaatcccatacagtgaagaaataacagctatgcaatatagttaaaaggaagaattgaaatagtgatacagtgaaattaaaaatcaggtaatcgatatagttcggatgtgtgtcccctccaaatctcatattgaaatgtgatccccaatgttaaagatggggtctcatgagagatgtttgggtcatggggccagatcccttatgaatggcttggtgccttcctccagggtaatgagtgagttctcactctattagttacagcaaggtctggttgttaaaaagaatctggccggacatggtggctcatgcctgtaatcccaacacttggggagactgagggagggggatcacttgagcctcaggaatttgagacaagtccaggcaataaaagccagattctgtctctactttaaaaaaaaaaaaaaaagtctgctacctcctttcccttcccctgtctctcctgctccccctctggccatgtgtgacacctgctccctcttcaccttctgccatgattgtaagtttcctgagggccccaccagaagcagatgctggtattatgctgcttctatcatctgcagaaccatgagccaaaataaacctcttttctttataaattacccagcctcaggtattcctttatagcgacacaaaacagactaatatagtaattaaattctttacaatatttttcatatgctgtagacaatgaaaattttaggaaaatatgtacatcatacctccaatcaaaatataacattagaaatgtacacatatttaaaatggtaaaactacttgaaaatttaaaaatctctcaaataactagatcaaggaatgagtatacaatattagacaacttaacaactacagtataagcatcacattaaatttgttggaaagcagccagagttatacttaaaaaaatacataattccaaaggtctgcattaagaaaaaataaatatgtggttaagtctatatttcagtaatttaggggaaaaaaaacaaaaagacgtaacaaaaataagaatataaatagattgcaaaatgaaagaaaagctgataaagctttctctgccccttctcaacagcgtccttattgagacagtcttctgggaaagaccttgagagcagtaagaaccatgtttttcacttattaagagacagaaagttttgatgaccgtgagtttgagtggccccctcagcaggaagacccttctaggcatgtttttatatagtgtcctcacctgtacagagtggcacatggaaatggtgcttatcagattgggcggtgattgggaaaaaaccgtgagagatgtgctccagatcacaatcactatttggaagaaatcaagtatcccttcagcagatattggatgagtgccaactatatgtcagacactgctcatggcctcgagatatgcctgagataaaatagcccccaatccctggccttgtggagcttacattttagtgattaaatgtagctcataaaccaaaactggaaaacttgatgagacctgtaagaaaaaaagttgatgttctggttggtcggttttgttattggaatgacaggccagtacacagggagaaaaccgacagtaatgttcatccaactgaccttcgtactgccagcgtctcccctcttcagtctcttccccactgtggcactaaggaaagttgtcatcactccacacagtcttcttgcaaaccaccactggtccatgtggccttaaaagttgagtcgttttgatttggcctacaaagcctttgtaattcagcctcagcctaccttttctggtttccttcataacagtcctcatggaccttccactgtataacagaccctttttcttccaaaaaacgcaccaagcccatctgtgtgcttcttaaatctgcattccttctacctagaatgtctttcaccctgctccttccacccaccaagatagatacagcccctccgaggccttccctggctgcacaacactaagacaccccctccccaccttcacttccttttctgcattctctgcatacgatattattatagttcattgtttatggctctgtgagccctctcacctactcactcccttttccccagtaggatttgtacaactcaaaaatgacgtttctgctgttttcatatcctcatgcttaacactgtatgcctggcactagaaaacatttagtaaatgtttagtcatttagtcattgactaaaactcttcaacaggttttctgagacctttactttttaaaactgcaacagaaaattcttccagtgacttttaaagtaaaatctgtacatggataatataaataagcaactagcctggaaggcttggggtaggagatgagaaggagaaaatgtaatgtagtaaggtgatggacaatatgcatgatctctaaccacaaatagcctctgtggctccaccttcaacccccaccccagctagcaaaacatcatcctttttatctgttctgtacatcctgattctctgaaaaagaaagttttgaaaatcagctggagactatttgtagattatatcattactaaatacagtaggtcatttattgtagacctttaaaatagatttaacatagagcattctgaaattataaacctaagaagaaattataagaagtaaatgtgaaagtgattctacaaggtacatatatggtccttaatttgaggaaactaactaaaacttaatgacacatttatgccaatttcctagaaaggaacaattttaattatatttatcaggtgatactgattgttatattaatgtaattatataattatgtaattgttgtatattaatatgtttggccctttgatttcttagaggtttagatttagccttacatatattttaaatgttaatttactatttggcattattgaaatttttataagaaaggaatgtaaaatactgaatagctaatattttcatttaaaagtttaattcagtaaaacagagaattgtaattttgcttattatgtttataattaaatttccatggttaatgagttatagctgttacacattgactattccattatgattggtaaatttaatttgtactttaaaaggaatataggagtgtacagagttgattcaaaaacaacacatactttagtcaaaagaaattactgctttttcttgtcctagagtgaattacagaaatcatacctaccccttaactcagatctgttctgtttgtccctctgcataagccctatcttgtactgataattgtttttgaaagcatagttttataagctgtaaaaattttatctccacaattcatgagcacatttctacatttcactagtaatcccagccctgaaacttatttatacttaatgtgtaaatggtagaagctggcctagcccttgatctcattgccaagtgagtgcttgaaacctaacggaaagggaaagtcagaaaattcagttgttttgttttgttttgttttgtttgttttctgagacggagtcttgctctgccgcccaggctggagtgcagtggtgcgatcttggctcacttcactgcatactcctcctctcaggttcaagcaattctcctgcctcagcctcccgagtagctgggattacagactcccgccaccatgcccggctaatttttttttttgtatttttagtagagatggggtttcaccatgttggccaggctggtctcttatctcttgacctcatgatccacccaccttggcctctcaaagtgctgggattagaggtatgagccaccgcacctggccaaattcagttgttttttaacgaaatatttttatcccttttagtttagcatagttccctacacatagcagcaaactacaaattcacatcagtgagaaatagacctgtgttatcattcagcaacagcctgaaatctcagtggattaagacagcatgttctaccttgactctgcttctcatcatccttccttcagagtccaacctgctggggcagctgccatctaggtcatttctagttgtcatggggaagagggagtggtggcaaaagagattctggcaaatcccacactggcttttaatgcacttgtctgaaagacccatgttacttcagcttacatgtcattggccagagcaagtcatagggccactacaacttaaaggggtgaagaggtggtgatgaacagcattcatgaccaccacagcgaccactgacttgggttagactgtgtagccctcttaactgcccagagtagcagaagataagaattactgagaagataactttgtcaagagtccccaaactggagccagccagtctcactggaaaaacccttcaataaagtggcaccaaagtagggtgacgagtgtgacttgggatatgaatcttcactaacacacatcttcactaaattttcaagtaaaaagcacttgtttacaaagtttcccctctcctgaaaataccttctactctgtaggcttctccccggccttccagatttgaaacagtaaagttgacagacagacatatactgccctctataccaccactgctgttgtctgtggtgggagccagttgctgtttggcagcggcctgccgtgttgcctggatgttaaagacctggtgcttttccttccaccactttttctttgatttcagtgctcactaggtcagtcacttctcatttttcaaaagcctaatgaaagagatgaggtaatatgttctattttgatttatattgaatcactttataattcataatgactgttgaaaccaatacttcaaatcatttttattgcctgagtcatattgacatggatttctaacacagatttttgcctgtgagtgaatgtttttcaacaaaagttatttttttcaggaatgttcttgcaaattatttttctttcaaattgtgatctcctttagaagggtatataagatagctgtagcaagaaatttaaaatttaatagggctagcagaaaatgcctcagaattgtgataatataccatctggtaatttcattcattaagtgaatcagcagatgcttattgaatacctgctttgaggcactgcagttggtgccgcagaaacaacagtgaataagagaaacacagtccccattgacaaatgttaattcaaatattaatttcacaacaaccctataaagtaggagtaggaactgtttttattctcattttatggaggaagaaacagaggcacagagtgttatttgcccaaggacatgcaaagtagcagagctaggcttcaaacttgggcattctggctcccagctactgagtagcagctagacattagagatctcaagcacagaagataagatattgataggcctgaacccatgagtcatcaacaactaaatgataattgaaagaatggacaggagtaagattgtccagggcattatacactgagaaaataggccttaatatttaagtgttgttgagaagaaagagctagaaaaggagactcagaagtcgtggtctgggaagtaggagggaaactagtagaatgtgacatcacagagtccaagagaaaatactattttgaaaacagatgttcagttctgtcaagtgctgctgctagaagttgtatatggactctctttagcatcttacaacatggaggtcatggatgactttatggagggtacttcagtagagtaataggatagaatccaaattgtttttgattgaagaagagaaggtggtaaggaaataaagattagttcaaggtctttaagcagttaggggaaggtggcattcacgaagacagatggcctttggggaggcatcctttgcaatatgagaaagcggaggagaaggtaggaatacaagtaggtaacttattagacttggtggcaaataaatgagatagttattctctggtggatcctgttaaatacaagacaaggatttctgctgagactcgggaagaggagagatgtttgatgtgaacgtgtacattttaaaattgtcattctaaagggttgagtacagaaacatggtagaggttctggacagtgtctaggctggtagccatgaatttatggtagcctcaatccttataaatgtatgatgctttttccaacagtgttcggcactttaggtacaagcatggagaaggcagttagttggttttagttgaggtttggtagccaggtaacacagagagaaaggcatggattttaaagtattggcagaatttattgaatgtatagaccatgcagtccaagatgaatataaggcagtaggaaaaaggcaggtgagtagtggttagagagaaaatggactgattgaattgcttgaggtttagctgaagtagcgtaggagtagtagccataatttaataggttattggaagcttttaaagttaaggctatatggtgggatgtatgaattaaaagagttttttttaatggagcagttttaagtgatgtcataatctaggataacatgagattgaatggttgaggggggattttgccagagtctatctgcatggctgtgttagtccattttgtattgctataaaagaatactgaggctgggtaatttataaagaagagagatttatttggctcacggttctgcagtctgtataagcaaggctccagcatctgcttggcttctcatgaagcctcaggaagctttccactcatggcagaaggcagtgggggagcaggcatgtgacatggtcagagaagggaccaagagagagaagggaggtgccatactctaaacaaccagatctcatgtgaacttgcagagcaagaactcattcatcaccaagggaacgccaccaagccattcatgagggatccacccccatgatccaaacacctcctactaggccccaccttccaacactggggggggcacatttcaagatgagattttgaggggacagatatctattatcactgacgatgcaacatatttcaattttaaaaataataagatgtaaaaattgctgtttaaaaaaaaactaagtaccggtgaagtgatctttaatactgctaaaatataaacactttctataaaattcataaatccatactaaaatatgtactgagtaaaggttgctgcttaaacaaaaagcagagggaaatattcatgcagaatgaagtttaaatatgtgattgttgaacaaacattatgactctagagccttaagaagtaagtcagataattagagttggcagtagaaatgtaaacaaaatgaatatcagctaattagctggattttaatgcatctatacctgtacagagctgtttcttctaaactatactggaattttatctgcatagataaatgtagacagtttgattgtggtgctgtgaatttgttttggatttttgtcattggtttttgttttgttttgttttttcagaattgagggtctctctgtcactcaggctggagcacagtggcacgatcatagttcactgcatccttgaactcctgggctcaaggaatcctgcctcagctctctgaatagctgggactatatatgcacaccaccatgcctggctaattactttttatttatttatttatttatttatttatttatttttacttttttttttttttttttttttgagatggagtcttgctctgtcgcccaggctggagtgcagttgtgcagtctcggctcactgcaagctccgcctcccaggttcatgccattctcccgcctcagcctcccgagtagctgggactacaggcgcccgccaccacgcccggctaatttgttgtattttttagtagagacgggttttccccgtgttaaccaggatggtctccatctcctgacctcgtgattcacccacctcggcctcccaaagtgccgggattacaggctactttttatttttttgtagagataaggcctcaccattttgcccacactggtcttgaactcctgacctaaagttaccctcctgcctctacctcccaaagtgctaggactataggtgtgagccactgcccctggcctggatttattctataaattaagtcttacctaatgtatgaaactatcatttgattcataaaaaaatttgtttttgttaaaaatttttatggtctgggaattaggtgccttctaaaggaagtcctctaaagatttcatttgccagactttcttgtgttatcactttatgatgtagatttatggtttatgtatttttttaagtttttttctttaaaacattttagaaaatagttcactgacagatcatagggttaaccattttaataataataacgaagtcacttctgctacatgatgaaatgttttcccaagagaggtcatatatctgagtatgccacaatttgtttgcatttgaaagcaaacagctccagtcttgtaatttagctgaaaattcatttaaattgataataaaataaacataagccttgagggcaatgtttgtttttaacttaacaattgatatttattttataataatttgaagtatccgattcctctgaagtagtacaaatagagattctaaggtccttcaaaaacaaggaaattccagagctttaataggataggcatagaacagaagaatttttttcgtggctctttattctaaacacttttgtttttcattcttgacattaggtagaaggctagggttagaaaagataagcagaagagattgtcatcttagttttataaataccatttaggttgatgcatttacttgtgtaatcatattttatgttatttttagttattgacaaaacaatacccacagttgctctaatttataaattactgctaacttatgtgtttcagttcttaagtctaacttgatattatgattattaaatagtgacttccttagttttctctgatgtggttactatagtcaggtagaaagaacactgtataatacagtttaggtttagctattaaggcaaataactccagcatttatgagtttctgccgtctaatgctttataactaaacttggaataatactaatttagaattgagccctgaataactagttatagtagacttctctctatcatctggtcaggcttccaatttttaacatgtctagtcccttatgattcactcctttattcagcaaatgtgttaagcatctgttatgttccatgccatgttctagtctctggaggattcagcagtgaacaaattagacaaagtttctgctttcgtaagatttacatgataagggggtaaaatgttaaacaagttcacaggataattttagatggcaataagagctctgaagaaaatacaatataaccatgtgataaagtgatggagggtgggaaagggagatgatgaggactactttaggccaaatcggagccacagtctgaataacatagaagggtcaaccatggaagatttggaggaaataacattctaaagagaggaacttaagagttctgtattgatggttcatttctttctttcctttggaatgaagaagaagagaaggagggcagcaatggtgataaaactttttttatggtttattgtgtgccaagtacacagtatcagtactggggtaattacgtcatctccatattgtagatacactgaagctctgagaagctaattccttagccatataggacatgacagaaatgggattacactctgctgtctgtagcaaagcacatgaccgtgtccacatattattcccaaaaccagtgttgccagggttggtaccacaacttttcttccttttctgtttacttgcttatcagttacatacctaaatctcataaaaatgaactagcagttgccgggcacagtggctcacgcctgtaatcccagcactttgggaggccaaggcgagcgaatcacctgaggtcaagagtttgagacgagcctggccaacatggtgaaaccccgtctctactaaaaataaaaaaattaggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaaaaattagctgggtatggtggtgcatgcctgcaatcccagctactcaggaggctgaggcaggagaattgcttgaacccgggaggcagaggttgcagtgagccaggatcatgccactgcactccagcctgggcaacagggtgagactctgtctcaaaaaaaaaaattgaactagcagcaaccttctagcccatgaaatcttccacttcttgggcaacaaagaataattaagttatgaaaactaaaccataatcacactcgtaatgcttatgagttaataatagatttttgcacaagttgtgtttgaaaacatttattcattgcacttaagtctttctcaaaacacaaagctgtccttgaatttttaatatagttcattaaattgaaaaaattctcattttctttcccatgtttttattcttcaatctctgactcttttcatcaatagagtaaaatggttttcattatccagtgagtacatataacaaaaactttcaatatatataaagacagccatgtgatttcagctttaatctctctttttattctgaactaaagtcagatacacttcaaaatgttggtaaaatgtatatattttggtgtgacattgtgacagttaaggtatacattcagccttttctcaggcatattgaaaatggtagtagttgaggtagttgagacactgaatgaggtagatgttcacgatttagaaaaaaatattattttcaattttcaaatcatatctgatataaatgaagggaaaaggtaataccttgtcatttcagatgaaactaaaatattttggctttatcaacagacataaattttgaaggcttaccaatacaattggtatgcttttatgtaattagagaactccaaaaagcacttagaaatagctcgtaaatctaccatatgttgacagcactttaatgaatttctctagactgtgaataaaaatttggactccagtgctctttatattttattcacttagaaaaagtaagacaggattgctcagatttattgtcatatatcataaaagtaactacaaaatatctactcattatagttaaagatttacagtgaacattttatagtatgttttctcttaattatgttaattgttcacaaatgagaacactcaaaaccagtgcttctaagattaaactaagattagatccagtggcctggcatctctcaggagtttttcatagggatccaacccatagtgaaatctcaggaggtcctctcaaataatggagtttaattattactcataaatgggcagttttccacactaacagatgttctcaatctcatgcaaccccactacttggtgttgcaattcccactacttttccttatccattcaatactttcccctgtgtccagatagttgctgaatcagcatttacccactttatgaatactcagaataaaataccaacacttagactcctctcccccaacctttttttcctatcaaattaacaaagacagaaaatcatgttaatacctagtttggtaagagtggggcaaaaatttactctcaggcattgctgttgggaatgtaatatgataaaagtgttctggaaaagaaaaaaaacaagtgctgtatatatgagtagatccttttagctccagttactcttatcctgcattggggaatctatccaaaggaaataatccaaaaatgtaattatattatgccagaagcaggtcttggaaatattttatatatttagtaaataagaagaaacatctcaaatattcagcagtaagggagtgcagcagatcatggaatgctcacataacagagtaatatgcagccattaaaatttatgcttgtttattcaagggcatgggcaagtatggatatggtaaataatgcaggatactttcatgtatgatatgatttcagctatggaaaatatagagaaaaatgatgtggagctatttctaaactataaacctaatattcctaaatatttgcttccggttggtatgtgatccttccctctgcctgtttttctgtactcatctgaatttccatactgaacttgtaatattcttttgatcagaaaatattaaaggaaaatcacaacagatttggaaaacaatcattaactaaatttctgccccagtcttactcaggattcagtttttccaacctctaaagatttaaatttttttaacttttcatactagaattcagcttataaagtcttgaaagtcacctttttccctttctgacatctgtttcataaagaaaatgacttagtggtaactggatttccttctttatagtcaatttatagatttccatcttagaaggttgtttatttacaacaacatctattagctgttaatattatcctcagttcacatggaaatggaggtgacataaagcttaaatgaagattggtcataaatccttgcacagtctcagatccaactactttgtctttatattatccaaagcagttcaaaaagacaaaggctgctgatagtaacaagatttctccgttgaaaacacacacacattcataaatcaatcgaaagtgtggtacaaaatagtatgtattttgtattctttaaaaaaaattgagcatttctaatctcttcattttccttaaccatttagaagtcaaaagttgaattatttgtgataagtgtatatgctctattaatatattattgctatagataagcatataataaagtttatatttattactaacatacatggaaattttgggctactgagatacctggcacagtcagtgactttgtctattcctacaggatctaattgaaaggtgttaggaaaggcatagcaaagagcctttttcctgttgttacaagcagtaaatggcccttaagaaacttcaaaaagaatgaatgcttgcttgagaaagaagggagtaagagaaaagcttttcggtaatgagcaggagaaaaaagaaaacctggtctgagagataaaagaggtgactattaaaacggaaggacacagtctaccagaaactcgtgaggctttacaaatcaaaatctagactcactttaccatggaaactgaagacaattagaaagtatatgtttacaattttgtaatattttactttatttttaattatccaaagcaaatataagactattcatgataggaattgatagtttggttatgactacaccgatattgaagccatgtgtaaatttgaaatacttaattttttaaagctgtttcatggaatctatagatgtgacaaaaagctaataatgtattctgtcactttacttccttgtcaccctaagactgtgtttctccttccagtaataggatacgagctacttgtctgagaacatgtaactggagtagacttttatgtagtgatctgaggcccttactagatctctttctttctaagggaaatcaccaaattttgagcctataggtaaatcatttgtaaaccgggggttggctgggcgtggtggctcatgcctgtaatcccagcattttgggaggccgaggcaggcagatcacctgaggtcaggagttggaaaccaggctggcaaacatggtgagaccctgtctctactaaaaatacaaaaaaaaaatagctgggtgtagtggtgcatgcctgtaaccccagctactcgggaggctgaggcaggagaattgcttgaacccaggaggcggaggttgcagtgagctgagatcacgccactgcactccagcctgggcaacagagtgagattctgcctcaaaaaaaaaaaaagatggggctacttgaaataatcattgtattggagacatccagctaatgaacttaagaagtagctcttatagggtggaaagaacattacctttagaatctagaattctggtttctcaggctctgtttggttattaggtattacctagagcaaaccctttatcacattgtttttttttaattgatttaagtaatggaatatgaaataaatgtcttttaagcattcctttaaatccatttttctagaactatgatacactaacattcaagttcacagaatattataaattaggggaggggtatagtgggataaatttccttcctgtaactcaaaacttcttaacccatttttgtatctaaacacaatgactccttccagtgaaatgtagagttgtgtttcttgccatacaatgcttaggtagtccagatatgtatacgtgggaatgaaaaagaagtagaaaagttgggcatctttttcccctggaaaaatattgtgttctatggaagagaaagtagttggtggatagtggaaagaagatgctaagaagtagagaagtcgttcaaggaaaacagtaaactgcaatattcacagaaacagttgggaatatgtactgattctttacttaggggatgaccatagttttaactcatttcttaccccaaattcgcagattgcattctattgtattataaatagatctctcattttaatgaccaactcaagggatattctggcagccgtggtgagaatgagaaacaaagatttttatacccagcaaaactgactttcaggtgtaaatgacacaagcgggctattgtcagcatgcaagaacttgggaatattgtttccaggaccctttcctgatgaatatacctgggaacaaacttcagaccaccaaataaatactgtatgatgtccaaaataggcatattcatagagacagaaagtagatcagtggttgcctaggacaagaggggttggagggaaatggggagtgactgctgatgcacacagcacttcttttttgagatgatgataatgttctaaaattgtgaatcaactcagtgtgagtatactaaagccactaaagtgtatactttaaatgggtgaattgtatgatatgttaaaaagaaaaacactatagttctgagttttaattgaaaatattaatatgagcatatgatatattgtattttaaatatacataaatatgcatatatatgtatgtcccctgaaaagacctagaaacagtatgaaaccagtagctatgagcatctctaacacacagagtgcgggcttgaattaatattttccactaaccagggcttcttggagaagagactgaaattggaaatgtacaagatgagtctgaaatatcaaaccaggtaacaaagaagctaacaaagactgctagagtaaggtcaaaggactcaggagccaactggaagaggcttccattggccaaaaatgagaattttgagtttcagtaaaaataagaactataatagattaaaatccactaagtacgtttaaattgataagttcaagccatgggcagtgaagcatgcatgtaatcacagctacttgagaggctgaggcaggaggatagcttgaacccaggagttcaaaaccagcctggacagcatagcaagaccctatctctaattaaaaataaaaatcaataaatggataagttcatcataatgaaaagcaaaaataattggtcaccttcaaagaatgacaggaaagcagttatcttgaaaactggtattttcccaggcagctgccaaagatggaggggcaggtcctggtgctcactggccaaggccaccttctggtctgcctgacagccgtcctggataggcaggtactgctgggccagaaggtggtggtcgtgcactgcaaaggcatcaacatttttggcactttccacagaaacaggttggagtacctggccttccttcacaagtagatgaacaccaacccttcctgaggccccccatctgcatcttttggcagaccgcttgaggcatgctgcttcgcaagaccaagcgaggccaggacgtccctgaccaccccaaggtgtttaatgggatcccactgccctatgacaagaaaaagtggatgatgcttcctgctgctcccaaggttgtgtgtctgaagcctgtgagaaaatttgcctatctggggtgcctggttcacgagtttggctggaagtaccaggcagtgacagccacccaggagaagaggaagaaggccaatatctgctattggaagaaaagcagcttatgaggctatgtaaacaggcccaaaagaatgtggaggagaaaacaattacacagaggtcctcaagacctatggactcctggtttgagcccactaaagactgtttattccttatgattggcctggcctgcccttccaccgttgctgccgtggggtgtagaggacccaagggtggcaatccaggtgccacagacagcctggtacttaggaagctgggggtaaggaaacggcattattcaactgcctttctatattgttactttaaatgactctaagaattgttcaggcgtagtttgtctatggcctactcgttcatgagagagttgttttagaaaaatgagggccgggcacattggcttacacctgtaatccgagcactttgagaagccaagagatcgcttgagtccaggaatttgagaccatcctgggcaacattatgaaaccccatctctaacaaaaatgcagaaattagctaggcatggtggcacatgcctgtactcccagctacttgggaggctgaggtgggaaggtcacctaagcccgggaggtcaaggctgcagtgagccaaaattgcaccactacacttcaacctgggtgacagagtgagaccctgtctcaaaaaaaaaagtaaaacaatagtaagaagagccagttaccttggtttcaagattagcaaaagggagctggaacatgcattggagggagccctaccttctgagtgggccatctgttttaacttcccaccttatcctatactctgcagctgtgataatgtggaaaaaaaaaacacttggggacagtatgagcttgctgttttacaaagagtatgtatagaagcatagactgggaagatgtgtgaccagggcgttacagggtagcccttgctccttccctgtattttgtggtccgaatcaaataaattgcttttaaagaagaagaagtctggtaaataaaggaaaagaatcaggcatttatcttgcccctcctgtatgaactatatcactggtaactaaatagtagataagcaatgtttctcttaaaattatacctgcttacaaatgaaagtgaaatgataaaagtagaaaatcaccatttttacaacccctgatgaattaatggatctggaccatggtcaccaacagctgcttgcttctcaaaaggagagcaaaccacatagtgcctcctgataacatatcacctatagtcttgccaaaggcatcaagtctccacatccagcttccaatttgtcataaatacagaaggaagaatgtgccaaactccaccatacatatgcagtcaggaacccatagaataagtctcccacagttcaaataacccagatttgtccacataaattataaggaaaagaaaagaaaaaatgagatgcctgtggtttaaaataagaggcttcaaagtcatccttttttgaaatgatcatgactgtctatagtgtctaatgatgtagatttggttgctaaaaccatataagatagtaaatgccaggatgtggttactttgggggagagagaaggaagtatgattgggacaaggcccacgtagggtttctagggtggctggcaaagtcctgtttcttgatctggatgctgcttactatggcatgtgtcttataatgttacactaggctatacagctgtatgtttgtgttggagagttcatatctgtgtgtgtctttttaattaaaaatattttgaaataactacataatttttaaaaggttatttagaaagtcaagcttagtggaatctgccttacatcttgagatatattttggatctctctctgtaaataatacttaatgtactgagttatcttgatgtatgtaaattacagattatatttcaacataaaacaagcataattcaaacatgtacatgtaagtattctataatacatgtctgaaagtgctgctgtaaacatctgtgcagttttttgtatggtcataaattttcagttcgttagtttaaatactaaggagtgctattgctgtatcatatggtaagagtgtgtttagttttgtaactgccaaactgtcttccaaactatctgtactattttgcatttccacctgaaatgaatgaaagttcccgttgtttcacaccctcaccaacatttggtggtgttagtgttctggattttgaccattctaatcagtaggtactaattagtatcttgttgttttcatttgcatttacttgatgatttgcgatgtggaacatctttccatatacttatttaccatctgtttgtcttctttagtgaggtgtctattaagatctttgtcccatttttaaagttggaatctttgctttctcattattttgaagagttctttgtataattttcattaacagttctttattagatacatgttttgcaaattttctcttaggccttggcttgtcttctcattctcttgacagtgtcttttgcagagcagtttttcattttaatgaagctcagcttgtcaaattttttctttcatggatcatgcttttagtgtcatacctaaaaagtcatctccaaacccagggtcatctagattttatcctgtattatcttctaggagttttatagtattgcattttacatttaggtctatgatccattttgagttaatttttgtgaaaggtataaggtctgtgtctacattcatttttttttgtatgtgtatatggatatctagtttttccagcaccatttgttaaaaaggctatcttttcttcatttaattgtctttgttcctttgtcaaagatcaattgactgtatttatgtggatcaatttctaggctctctattctgttccattgatttattctttcaccagtaccacaaatcgagacaagattatcttcatttctgtatctctatagaaagtcttgaagttgggtagtgtcaatcattgtcagaaattggctattttgaaccttttgcttctccacataaacttcataatcagtttgtgtctacaaaataacttgctagaatttttattgggattgcagtaatctattattccaagttgggaagaactgacatcttggtattcaatcttctatctataaacatggaatatctccatctgttctttgatttttttcatcagaattttgtagttttcttcatatggatcttgtacatattttgttacgtttatatctaagtatttcattttttaggtgtgtgctcacaatggtattgtgtttttaatttcaaattccacttgtccattgctgatatataggaaaacattgattttctatattaaccttttatcctgaaatcttgcaatactcacttattagtttcagatttcttttgttgattcagattttctgcatagaaaatatgtcatctgcagacaaaattttatttttcttctttcctaatcagtataccttttatttccttttttattttttcttataggacatctagtacaatattgaaaagcagtggtaagaggggacatccctgccttgttcttgatgttagtgggaaatcttctatttctcaccgtattatgatttttcaaatgtaaaagctgaaccagcacaaaaccaatatgtttattttcccctgccttctggattctaattaatcattggtagaggaagtttaggctgtgtgaagagtttggaaagaccttaggaaatttttttaaatgtttatttatttaaaatttttattaaactttattaaaatgttcaagtttcctgaagtgtttagacatcaagaaatatttacatacatctctagtttatatttccatcctgttgatttccctattaagaattttaatgaggccaggctcagtggctcatgcctatgatcccagaacttttggaggccaaggcaggaagatcacttgggctcaggagtttgagaccagcctgggtaacaaaacaagaccatgtctcaaaaaaaattaaaaattagctgggtgtattggtgcatgcctgtagtcccagctacttgagaggctgaggtaggaggatcactggagcctaggctttcaaggctacagtgagctatgattgtgtcactgcactttagcctgggtgacagagtgagaccttgtcttaaaaaaaaaaaaaaatttaaaaaaggcacttaaaagaagtccaaaatgtatctcaggaaagttgtacaaaatgtatctcaggaaagttgtacataaaataagacaggcctcattttacagatgtttctcaattatgttattccaaatctacagtattggcatagctttcactgttgaaaggtgttttcatttcttaaaaatgtttttaacctcctatcaccagtcctatgctaaaacagggtattttacccataaactaccacaaatagataaaaatagctactttacatataaatggccctttaaaactggatactattgtatgccaatttgcaacatagtctgtatgaaaagagaaaacagtaataaatgctgtgttatggaccaataattagattctcaatgtggtgtaaagtactcacacaaggttcattcttggcctcataaatttgaccatatcttttcattctaatgctcttaaatgacttagagacatgacttaacagtaaaataagctcctaaacaacaaccgcaagcacataaaaaacaaaattatgcagtgatggcatgccatttgttcaggaattggctgtcctatttactcttaaatataacagcaaatggagagttgattgttaaactgcacattcaggacctcatggtttaatatctcatgtgctatttgccagactaaagattattaacaatttttgctttgttcactgcaggaacaatacagtacttgtattatacaaatattttgattaaagtattgtttccaatcaatttatttcccattcctttcgaattacctgagttaacctagttcagtggttctcaaatgtagtgtacatcagaatcccaaggagagcttgttaaaatacaaatgtataagccctgctctcagagcttctgattcagtaaatctgggttgggcctgttaattggcatttcttagtttctccataatgctgatgctgcctgtcttgaggaccacattttgggaaccactgacctattaccatgaaaccattctctctacaatgagcagaattcttttttaaaaagttagctaaaaacaaaaaatagaccttatgatttggctgtcaccactctttaggaaagcatgttctaatttactgggtcaagaactgaaggaaacatttcttctataggagatcatagtaaagcttcttcttgaagtcttacaaatgttgtatttatcaaatggagtgttaaactattcgaggtttcatttatatttgggaaaactcttgttaaataaaacaggtagaagagccctcttaaaatccctgaagaatgtatgacacaaatttctatcattaatatataataaagattcttttttttgtattttgtttgttgttgttttttcctgtattatattttgcttaatctccctggctgcataattgagttacctttatttttaacttttactttaggttcagagatacatgtgcaggtttggtatataggtaggtacatggcgtgtcatggaagttaggtaaacagattattttttcacccaagtaataagcatagtacccaataggtaacttttcagtcctcacccttcttacacccaccactctcaagaaggccccggtgtctgtggttcctttctttgtgtccatatgtactcaatgtttagctcccacttacaagtgagaacatgcggtgtttggttttctattcctgtgttagtttgcttaggataatggcctccagctttattcatgttgatgcaaggacattgtattagttagggcgctcttagagggacagaactatatatctgtagatctacatatatcctgtaagtattaaattaatacttaataaaatataattattaagttaatatttaataaactataagtattaacttaatacttaataaactccccttttacatataaaacttacacgatcacaaggtcccacaataggctgtctgcaagataaggagcaaggagaaccagtccaagtccccaaactgaagaacttgaagtctgatgtttgagggcaggaagcatccagcacgggaaaaagatgtaggctgggaggctaagcccatctctccttttcacgtttttctgcctactttatattcactggaagctgattagattgtgcccatcagagtaagggtgaatctgccttccccagcccactgattcaaatgttaatctcttttggcaacacccacacagacacacccaggatttatactttgtatccctcagtccaatcaagttgacacttagtattaaccttcacagacatggtctcattttttatggctgtgtagtattccatggtttatgtaccaccttttctttatctagtctactgctgatgagcatttaggttgattctgtatctttgctattatgaacagtgcacaatagatacatgcatgtgtccttatggtagaacaatttatattcctttgggtatatacccaatactgggatttctgggttgagtggtaattctgttttaaattctttgagaaatcaccaaactactttccacaatggctgaactaaatttacattcccaccagcagtgagtaagtattcctttttctccacaaccccaccagcttctgttatttatttatttttttttttactttttataatagccatataatgaagttttttaaacaggcttttgaaatcttatttccttaaagatccatgttgacctttaccagaattgtttatttgtttttattatcactgcctaaaataagatagtttctttttcccatggttatcagccatttgccctcaatggtactggtttggagtgactaaaattagggccagagtaacagtacctcacttttactctattttatagcaaatgaaatgttcagtattgacattaagtttttaaacagtgtgttgctgtatttgtttagtgctgaaacagcttgactccatttcttttgcaccttgattctgtgggttttatagacagccggtgtttggtgcctggccccaggacgggactctgcactgccacccatctgccatcacttctgttactcccttttacccttgccttgccatccaccatcacttctgttatttcccttttaacccttgcccgcctatgttttttccacttagagctttggatcttttttaaacacacatgctgctatctcactctttcttttagaactagtccttttcaacaaatctaatagatcagttacttcactacttaggatgattcttgtctgaacaataaccttcaggatgttggccagtctcagaagaaaacatatacatgtaatgtacataaatcatattgggtaaagtcagttttatctaaaactgagtttaagatcttcaaaaacacttccatgaactttctttacagttttgtgctattctctttctaaatttgccaattgtatgtggtaaggttgatggtgaggatttatctgattaccttgtggagtattcatagtatttgtcttcattttctttttgaagaggagtggaagttattacttgatccttttcctatgtatcacatttttccagtgttacacttcaaaaacaagtgttattatgagtcattgaccacagctgtcatgtttacttacgtatcccaagtgtttgtgcaacttggtgcctaagtacataggcactaaataaatatttgttgaataaatggattaacatttttaaaaggtcaattatgcaagcaattcctttttgaaagtttgtaatttagaaagtttcaactatgttgaaatatgtgcgtgtgtgcaatagctttaaaaagcaataggcggggcgcagtggctcacgcctgtaatcccagcactttaggaggtggaggcgggtggatcacgaggtcaggagatcgagaccatcctggccaacacggtgaaaccccgtctctactaaaaatacaaaaaaattagccgggcgtggtggcaggcgcctgtagtcccagctgctcaggtggctgaggcaggagaatggcatgaacctgggaggcggagcttgcagtgagccgagatcgcaccactgcactccagcctgggcaacagagcgagactccatctcaaaaaaaaaaaaaaaaaaagcaataaaaaaacaagacatttagatagtgcatgagtagctacaatggacaacataaattatgtttcttgttattatttgtgtttgtattctaaagaggcatttgcctgccaaactatttcagtctgatattttcaaaactcttctaataaaaaagatactgagttatgtgacattttgatgttctgatgatgatcgttattaaggcagggcattgtttcattgagttgtttatagtactgtaagaatataacactgatctattaaaaacagatgcagtgttgtcatgaaatgggatatatgaaaatatgttaaagcctctaaatgaaaaaaagataaagatgctttcaagtaaattagcaaaattcagggattagcaaagtatagccaagcccattcattcacattttgtctatggctactttgaccctacagctatagttagtgagtgagtgaatgaattgaatgaatgctgaccagaaattgcactttcaaacatttaacctgaggaaatagttatatatacaaataagtatgtacagggatgttcattctaagctgtttgtaatatcaaaacaagggaaacctaaatattgactaatagaagactggctaaataagttctggtgtatccttattataccagaactagtgtatgatacagctatttttaaaaagatgttacagaaatgtatccagtgataggaaacaagggtcagcaaactacagccctttggccaaattggctcaagacctgtttttatactaccagagctgtgagtgggttgttaaattttaaaggattattaaaaataaacgtgagacagagtatgtgactagtaaagcttaaaatatttactatctaaccctctatagaaaatgtttgctgacccctgatatagaatgttgtatacaatgtagattaaattggtagggatgggtttaaaacattatgaaatagtatatatagaacaatatctttttttaaaaaaatgcaatcaataccatttagacacttaagatgttaatagttatttctgggtagacaagattaataagattctatattttatgtctaattttgtgatttttcaataatgagaatgtattcattgtttaagaaaataaaaatttaatattggcatggggaaaaagagaacttctctaagtttcaaggtgtacaaatatgtttttccattttgtagatgaggaaactgagactaagagtttaattaacttgcctggagggacacaaacataagacaaaaattgcattgatgccaaattttctgtccagcagtgtcaccatttgataatttaaaatgctcatctgtcagctgaaataaaactatatactctgtacccaaaggcaatttaaaggtatcagtgtataatatatgataaaggaggattatgcagaaataacaaaccacctgcctaatggtattaggtgtgtactggataggtttacatttgcttaaatagaatgaaaaaatgagtagcttacattttacattttttaaaagaaacaaaacctgtatacataggtattcagttgactttgtaaatttgcaaactattactactacataatatggtaattaattgctctttcatacctatagagtttaattgttcaaattcaggcatgtgacacaaaaagggaccatgtcctgaagcttgtgcccttcaccgtaagatagaggaaggacatttgacttatcagatccttgtgcaggtaactgtttacaaaatgagtcagcaactcagaaggagaatgaatacaacagtgagaagtctcattgtaatgaactgatagctagtaactcaaagaagcagtaggactatagaaagcagacatgaaagctcagcagcttttggaccatttagtgtgtggacaaaaggcctagtatccttctattattcctgaggaaaccactatcttatagccaagaataataactattgttgctcttttaaaaaacacttgttcctttaattataaccatcttgtgatttgggaagattattctctattcacttatttagaaactgaggcacagaaaggaggttaagtgagcgttcaagatcgtacagactgttcaagtgataatggaaaactccatcacctagtcccagctctgtatgcatatgatggtgatgctgagtaaaggcaggatcattctacatttcaccgaatcataaaaaaaagataaacgtgtctttaaaacttatataaattattaaactataaatattttgatgctcttcagagatgaggttcagttaacaggaaaaaaattcactagtgtagaatgcttcataactaaaatatgtcagggaattatgatatgcagtcatgcctaggtatctgtgggggtaggtttcaggaccccctgaggataccaaaatccacagatgctcaagtaccttatataaaatggtacagtatttgcatataacatgaatacatcctcctgtattctttaaatcatctctagattacttataatacctaatataatgtcattgctgtgtaaatagttgttatactgtgtagtttaggaataatgacaagtctatacgtgttcagtacagatgcaaccatacatttttttccaaatatttttgatctgcaactggttgataccacagatgtggaacccacagatacaaaggtccaactgtatatgcacagatgaggctatcattttttcttttgtctttttcttgaacaaagatcaccaatcctggattttgtatattttaatgatttctgatgtctgaaagcagtagtaaatagaacatccccaattttaaccctatgatgtcacatattaacatctatgtagtggagtccataaattcagttagaaatcatagccagatagagtatgtgtgctttcataattcccatctctttagtaggcattatattttttaaaatatgtcttccttttgatgtgaaatgtattttcagaaattatttgtcatatttagtgtaaacattattcactatatactgcatatttttctaaatgtcatgttggcgatttgcccattttttaaacctaaaattgagatagaatgagtagctttaggcactgtataatgacttggattactgtggtgttcttgctgtaatttattattatttatcattcttgggcaggtattttagtaattagaaagcctacaataacacatgtggtacacttaagaatagtttgaagcactagagctgtatagccattgggtttcctctcccttttttaacttccatattgaatgcatattagaaggacatgtaacttttatcatactatttccttgctcccagcccgctacttatttatgtgtacaaaagcatatactttcttcttgaggaaaatttttttaaaggaccctaattatttcttaagatttattttccttctatcaggtagccaatacagtattttttttgatgttgtcgttcatatatgtttgcctcttacactcagaaaagtcccataaccaatgagagctactgcctttcttcctgccctatttctcataaccttgatgacccagaaatctctccacttaccataaatgggaggcactaaagtagtgttaggacttccttaagacatctgatgtgctcttttaaccatcttttaaacttctcttcctggtatttaaggccatgagcttatcttatttaatctgtctctctctcaccattttctagaccctagtaatctagctctccacctgctcgctatcatgaaaagcacttcctcttcccttttgctttatctcttgtcttcctccacattaatccagagcacatacacaaacatgtacataccttctcccaaataagtacatacctgcatctatataagtgtcacgtcttcaaccttacctctccccctagacctaactcactttttaaaaaaaattcccacagttacagcatgtatcacttaatttattctctacctatggtttgtattgttttgtgttgtatatcttatgcttatatggttttatatggctgacttaccttcctggttgtaagcttcttgagatcagggatttaattttttctcatgtatctctcgtatagcccttaccacgttggtaaatatgtagtaaatgcttattaagtcttaaaataagcctgtcctgtggagcagaaacgttcctcaggaagtgtcttatcgagtgttcccattttacaaaagagaaaattggaacagtgaagtgacccattttctttatgacataactggtgagtagcaagccctgaaccagaacctagggctcctgactcttagttcagtgtgcctgttcccaggcagccttgaccacgctgatgctcagggaaacactgccacgagaacatggcatttactgctgctcacgtggacagtggtgatatccatgccctgaacaacagcctgaagttcttcccagcattccccatttttcatcttgcctccttaactttataaaaccctctctattcaggaactagggaatgaatgagagtcctctctcatgaaaaaaaaaaaaaaataatgagatacaattttattcattcatttatcaacatttactcattttgactaggagatagcataaaagccacttctcttcactacctcttattttttcatgagaataaatatctttaaaaagctagataaatctaaagtgcctattcactagaacattctacatttagatttttaaactatgcttacaattggaagtgttttcctttgtttaaattttatgcttttatatattagtaaactcaagactaaaggacagctaccttgattcttcttggttataattgatggttattggcaggatagcatgtgtagcctttttattttgaaaaaaaacaagttgggaagatctctgtgctttaatatttcaggaaaataagcaacactcttctcatctaattgcctgaaggctaaaaattgaattgtattgaatcacaggggagaaaaacaaagtaattgacaaaagcagtcatctaattaaatatattttttttaaaaaatgaagtttgtaatgaaatttgacaaatacaacacataattttttttaatttaaaacttcggttttaggttttgatcaattacagaaacagaatgagaagaaagaaagagacggtgaaagaaagatgtgtgcccacaggggagagtccctctggatcaaaaggatcacccgtctctgagatgacaggaagctggtattcacttgggtgtagctggcagtaaaccatcccacatcagagcatttaactaggagaataggccctctctgaacttcagtttcctcatctgtgtatcagattatggaactagatgacctttgatgtcccttccagctctaagtttctgctggattagttatttttacatacctttattctgatatttaaatctttcaagggtctactctaaaaagccagaatagcttaataagtacttactggtttagtgattgattttggcccatattatgtgcaagtttatcaactcaactaacagtatatgggtttagttatttgcagccaaagatatttgttgtgtctatggcatcttgtgctgaaagctttatgtagtgaaaatgagtaataggtaaactgtacttgtacaaatggtgaactagtgtttgatcttttaatggtgaagttttcaacatgagcatttgaagaaaagctttgatattgattgtgtatttcaaactgaagcatgtctgaactgaaaatatttccttccaaagccatctgttcttattcatttcttttttccttattctttgctctggcatgtatatattcctacatagttctttagggaactgcaaactaggaaggcaaagaaaaccatatgtcttgtttacagccttgtctgatactatctgtcagggtaaagtaaaaagataaatgtgtttatttgatagattttaaattttgaagtttttaaaacgttgatcaaaaacagcaataagactgatgatgttacttacgtgtaaagaaaagatacagttttcatgtagttattttgaaattcttaactttaggctataaaagtttttatttaaagttatttgttagttacatgctcgaaagaactgttgcatcgtattttaccacccttctttcagcaagttacattgttttgacttttgttatgaatgtaatcagaatccttagaatgcaaaatcttttagaaaattcttgttggatcattagatgtctgcccatcccaaactaattgctagttgtacaaaaaccatattttcttttagtggacatttaaaaatatcttctattagcaaggattacattttatgaactgtaatttttcacctgactctcttaactttataaaatcctccccaccaaatagaggtaccaacaaacaccagaaaccaagattggtgaacaattggttggcaaattaacatttcctatcttcaaaagatgatatttgtcttgcttttttcccagtcacattttagtactagttttgtagcttctgagtacttatttttccagtgataaatcaaaaacagaaatgatcagccttactctccctcttttttctggggaaattgagaaccagaagagttaactgaccagctcaggcctcacatggaaacagtagtacagccagtccaaggacctgggtccggggctctctccatcatgcctatccccatttgaagtagcactaaagtgccatttagtgtactttttgtaaaaatttgcttttcagcacatcatctaatatgtgctacttaaaacttaattgccctttagaatgatttgtgatatgcctccttcattctctcaacaattttaattttacaagctagttttattataagctcaccagtttaggtagaaggatgttctctttcagaatctggattcttcctctagtaacctcatcagagctcaggaggagataacaaatcaaacattgagattgaagttgattcagtctcgggtatgatttgactcaagtatcaatgagctaattaatatttttatctaaaaatattttgtaattgtgccaaaggttgagactctagaatactggagataattattttcagacagtagcaactagtggaacgggatggagcactttgcaaacaatgtaatatcaatggcttcttattacaatgccccaggtatgttattaggttgatgcaaaagtagttgttgttttggaccatgaattttaaatcattataactaggctcaaacacatctttattaatcaaataggaaccattacaatcaacacatttttgccaacaagaaataagtttgtttattcctgtagtgtacaaatctgtgctttgggattcgacaaactcttggaaagcattttctgcatccttctgattgtggaaatgttttccctgcaaaaagttgtcgcgatgcttgaataagtggtaatgggttggcaagaggtcaagtgaatgtggcagatgagacaaaacttcatagcccaatttgttcaacttttgaagcggttttgcaacgtgcagtcgggcgttgtcatggagaattgggccctttctgttgactaatgccagctacaggcattgcagttttctgtgcatcttatctatttgctgagtgtacttctcagatataatggtttcaccagggttcagaaagctgtagtgtatctcaccggcagcagaccaccaaacagtgaccattacctttttttggtgcagatttggctttgggaagtgctttggaggttcttctcggtccatccactgagctggtcatcactggttgtcatataaaatccactttttgtcgcacatcacaatccgagaaattgttcattattattgtgtagaataagagaagaagacacttcaaaacgacgattttttttttatgttcactcagctcatgaggcacccacttagccagttttttcacctttccaacttgcctcaaatgcaaaatgaccatagaatgatcaacatccagttctgtggcaacttccgatgtagttgtaagaggatcagcttcaatggttggtctcaattggtcattaccaacttcccatggctggccactatgctcctcatgttcaaggctctcgtctcctttgcaaaacttattttttttatttttttttgagacaagagtctcactttgtcaccaggctggagagctgtgacgcagtctcggctcactgcaactgccgcctcccgggttcaagtgattttgctgcctcagcctcccaagtatctgggactgcagccatgtaccaccacgcccagctaatttttgtatttttagtagagacggggtttcaccatgttggccaggataatctcgatctcttgacttcgtgatccacccgcctccacctcccaaagtgctgggattacaggcatgagcccccgtgcccagccacaaaacttcttgaatcaagactgcactgtatgtttgttagcagttcctgggccaaatgtgttgttgatgttgtaggttgtctccgctgccttaccacccattttgaactcaaataagaaaatcactcaaatttgctttttgtctaacatcctttccatagtctaaaatcaacataaaataaacaataattcattaggaaaaaattaataaagcgagaaatgcccattaaaattatatgtaacataaccacatttaagaatgtattccagtatcaaacggccaattccaacaatgcaaaaaccacaattacttttgtgctcacctaatcattaatcttaaattgattcatttatttattaaatgaacatctattgagtgccagctgcttccatgccctcgttgagatcgtatctagtggagttatcaaacaataaacaagcaaataaaataattaagacatgataaataatggaaaagaaacaaggtgatataataaataaggatggccaactttgtgtggggtggttaggaaaagacctctcgaggggacatttacacagattcctgaaggtaagaatgagcaaggcatacagagggctcaggaaagagcattgcaggcagaggaaactgcaagtgcaaaaaccccgatatgggaaggggccgctgttcctgtctgttaactgagaatattaatatcttcctgcctactactcataggagccctgtggtgatatcagtaaatttaaataaaaaatgacttaatctgggttagatctgtataataggcagtgaaggagaaattggggtctttttctctacttctaggaagaaaaattattgggggatatgagagaaaacacaataaaacgttcagagatctctctcttgccttctgtatcttgatttagagatctgtatcaaagactgcattgtatggtactagttatcagtgtgggagttcacagaaggcaaagatcttgacctggagtcttggcctggacttgactttggccttaaagaatgggtaaatttggatcagccaaaaggaggcagaagagagtgatttaaaatgagagaatgtgtaaataaagttgctaagatggactgaacatgaatgagaacttaagaccatgaagactcaaaagctggagctggagccagagccagatggacagaaaataattgaagggtctgattcatagaggtggttgaaccgttagtagagcagatttgacccgatgttagacaacacaggaagtcattatcatttcttgaacaagaaaattgtgtggtagaaagttggtaacgtaaatacagattaatggaaatgaggaaaaattattaatggaaataaggaaacaagcaggctaaataggaggaccttcttttttttaaatcgtgcatttcatagtacctggcaatgagaacatggcctatgctcctatcagagaatgaactgcatacaagacatttcaaatgagttaacagtgatacttagtgactgatggaggcggtaaatcaaaaatcaaaatgcctgttcacttgagtccaagggactgaccagaaaataatgtcagtgatagagctggggaagtttgcccagaatattaaatgattaattccatgttggacatgttaagtttcagaaaataacaagacacccattttgtgatgtgtgtacacaggtagaagtactgaactagagctaaaatagaaggttgaatttgagaatgcaaataggtggtgagaactgaagccttagctcttgagaatgcacacacatgattaaaagtgtgtatgtcggggaagaggcaggtggggagtaactgacacgcacacacacacacacacacacacacacagagagagaacaagagagaggagtctgaataagtagaaggcaccaaaacaacagttggataaaagccaccttcttgaggaaataccattatcattatcaccataaaaactacaactacctgttagtgtttactacgtgtcttaaagtctttaaatataataacttattatttctttccacagcctttaaaaaagtaaatgctgttgttatctccattgtacagatgaggaaggttaggacagagaaattaggcaagttgtacaagattgcccagtttggagaagctgagctgagattcaagcacaggcattgtgcttcaaagccctcaactgtgccatatggttatatccaacttggtgttttaattacgtggtttgacttcgatcttatgtaagtttcttgaaaaggagttaattaacagtttttacaagttgggtagaaaccagaaagtcaacagatggctgggcagtgattggataaatccttgtagcagaagacaacatgaaatttctctggggtaaggcagagaaagggaaagaagaatataccctttgctctacttttttttctcctctccatacactacaagttattgatacagggaattgtcccctttgacaagagttacaataatttgtggagaaaatggcacctctgttttttagcattttctatatactacaaatgtatttccttatttgtatacaaggaatgtcaatttatctaaattgactgtcaaccaaagtcatttctttattgacttccactactaaatgagagttagattccaaaagatctgtggtatgcatgaggaaaattttaaatttaaaaaaaatttttttttaagattccaaaagatagggcttgggaagtagcctcaacattggtattactggattaccttcagtctgggagcccaagtgcctggatgtctcagtggagaggctcaggacttagagcaggagttagacactgaagcccttccctctggagaagccacacgtgacttctttgtcgattgctttagtgaatgcttccccagtggctgacagagaactttgcctccattttccatgctcttcagggctcctccagcctctctcacttcttccttgtttgaggaggaaatggtacgcttccagtccaccatgctcagtcatacggcttaaaggagaggggaacaggtacctgcttggtgccacaactatagcaggcctttcttcagtaaataagctagagcttttctttggacctaaaactgaggatgggcctcatctaattaatcttcctaaaacacagttctgcacactagactttcattatttttccattctaaccagaatgaaagttttagcctcgcatttgtggccctccatgttttggcctgagctgtggatgcctgacctcatttaccagtatcccctttttgtcagggaggctgccccattccctgtttattctgtagggccccacttgccgccttctgtcgggaggaggctgatccctcagggattccctctttacttttcaatcttcactccggtctgtggtattatcggccccagttcaatgctgcgtacagttctcatctaaatgccatctccagcatacagtctcactgaactcacctagtattttatctccagctctcattatatctgtgttctagatatttatgtgcatataattatcttccctagtaaactctgggcagactctgtacctaatttaacttagtattttttatatcacttacacttaacatcagagaaagttaaagctgcaagggctgaggagacacacagacctgtgataatgtctttttcaaacttctttctctgtgctctagtaaataatagtgctgaaggtaggatagaccagatctcctggttctcagtccgggtcttatcctccaacaacagtggttctcccactggcttgcacattgaaatcacctggcgtcgcctgtgatgcttttaaaatcctgatccagaagcttacaaccatagaaattagaatctcaagagtaagacgttcacatcagtagcatccaaatctccccacatgattctaatgagcaaccaagattgggattaaatatcccccagtatgatggcccctggaccattgttgctttactgggtaattctgttaatttggtaaactttttgtcagatattaaaagtagaaaatactaaaatattaaagtagaaaagtggtaactattagataatagtatagttcatcttgttttgcttgcaacagtagcttacagttaactgtttgacttttcagatttttcgaaagaaagcagtggaacttggggtaaaattgctacctgcatttcatactccctctggaataccttgggcattgctgaatatgaaaaggtaaaactcttcattttcaacaacatgttttaaggtgaaatattccagattgttgcctaataagtatacattagatagataattacttatatgatactggtgactaacagactccactgggagtcttgagatctgtctttttgttggcagctattagcttttcagtgttccatagcctcagatatgtccccattgtgggatggcgtgacctcaacagagtcattcaggccagacacgattggaggtttacactgtttcatagtgactttgcatcaatgatactgtctccataaataccaaaagagtcccgttatcttttaattgtcatcaaagcatttcacttccaaagaagcaaattcctaagaacctttatttaagttcagctactggtcagaaatatggcagaaatacaatatttggcctaatcagatcccccataaaagcagctggtataacggagactgggagcacctgtggttacccagcccccagttgtaagaagggaaggcagccaatgcactcacccagatcaatccaaccttctcatcctctttggtggagaaccctgatatgccaagttcttgagaatgtggctccaattggaaaagacacacacacacacacatcccaggctgaacagactttctggtgttctcccagagagtagttggagttttcataacttaagcatttcattaataaacgattttgtcttaagcttccttcttaacgccttcctgcccataagttattaattgcctgtacctctctgtgataatgatgagacagtgatgatagctattattgtcactataaaatgtgatgggctctttagtcctcttaccacatattatcctcacaacaacccagtaaggtcaatgctgttatctccattttaccaataggaagctctagtcacagagagattaattaatttacctaatatcatacagtaagtaaatggtagagctagaatatgtacttagatgtctatacgcacatcgatgcatatgtacaaatgaaacagctttctggtttagaaacaccaagagaatgcatagcatggtttggcaagattaatgcacatttcttcctaattatttattttagtgacattctgtccaaatattaatcataaaaccatgaaattaatcagtttattttatttttcctttaacaaatttgtgagatgccatgctttagtttcatttgtatattatatatctacaccttgaaatcatcctgtacctatctataggtgtggggagtggggtggggagagttcacacctctgggccatgttaaactgagatattaatcgttctctattgcagaatgtgatgcctcaggatctgttcttcctttaagggtcctcaggctttctctgtcagcttgaagatcatacatgtactgtagggccttaatgcaggggtggctctgagcttggcttggaagcagcttggtttgtgtttggaggcccatgagtatttgactcctgtagaccttctttcttaccttttatatcttcagaatttgtatttataggtagtattctgaccaagatactactctcttacctaaaacaagatctggtcacaaaagcaccgtgcacaattaactcatttttttccctactgagaaaagtgttatgggcatagtagtacactaaactaattggttatcaaaagacctgaatctaggtctttacagctactcgaggtttgtcttgcagcagtcatttaaactctcttggctaatttgtaaccaggaaggtaggtgaactcagtagttactttgtgaacattttggggttcacagaccactttcagattccgatgaacatatgcctctcataaagtgcatattcctgactacatggatttttacacaatttccaaaagctaacagtacaatggaagaccaccaatgaccgccagtttacaatcctagagcagatgatcactccagccttctcttaaattctgtgaagctagtttctctcgtttcctggaaggtaatgaaattggagaaaggcctactaaatctaatagaggtgtgggctacatctttgcaaaagtcgagtccatttttatgagatgctgatattgcttaattagtactggcctcccttgaaataagcataagaaattggaattcaaaatatactattttgaaatatatttaactttactgtttatttccaactgccaagtagatttttccttagttaaatctatccttagtgtaccatggagatatttttcagtacataaatacttaatttattaaattactaaatcctctagtatctttcatacctatgtctgtcaagaatttattaaccagggcattcaaattttttataagacttcattttgcgcagtattttacattagaatttatttaatttcagagattacagaaaaattgcatgtggtgaaaaataatgtgtcattttcatttatgtattcactgatgttttgaagttaaactggatgaaattgagcaaccatttggcagctgataataatttcttcttggcaacatgcatgaatttttaattatatattgtatccactctcaatcccatttactaaataccagtgacttacccaaattcacacaataagcactggcaaaattaatagtgatattagttcactaaaattccccctgttcctttgcctaatcaagtacactccttgaatcagctgtacttccagctgtgagactgatttatcatcttaagttttcctgtagggcaagaagcgacatttcatatttatctacaagattacttttcaaaatgtgctgttggtgtcatttgtacatatatactgttttgcgaatcactttattttcacagtatggtccaaggtatagggaacagctggcctagagctgctttcgtagttttggaaggctgtcaccagcaaaagtttcaaaggagtggggaaacatatatctggcaaaatcatattttcttaattaccttctcagaataagagaatgtagaaagctgcccaggagaagaaaaaaggagggcttaaagatgctttttagactagctgtgcattcattgttgactggctttgaaactcttggcaagaattaccactggagagacactgaatgtgctggctgtaatatcataattctgctcttccctctcaattttgaatgtgtctctttgtcaacatctctatgttaacaacagtgtgaacttattggtattatctgttcacattcctctggtattctggttattgcctaaagataattggtttctttaccttttctttgtcaaaactaagcatttatttgagtctctcctgtgataaagatttcttactaagtcctgggaagagtttctacttctcttcactttattcaagaagataacagacatgttctttccctcaggggactcacagcctggttggtaaagcagaatttatttttgtgtgttacacactcacacatgtaattgacaaacctaagatggaccaaggagagataataagtactcaccaggttgaatttgaagcaagcagcattttgaattggggaggtttatgtatttggagacaaaacatcaataagtcaagttgtatttcagtatttgtgcaagctgaatatatgcagagaacctaaataattcactcatatactacatgaggaactctatcccaaaagcggttcagaaaaaaaaattttaattgtcttttctgccacatctatttaaattgttaatccaataagaattcttaattcaatagattctgaaattgtgatttaatggaaagtactcatttaataacctagatgctatacagttcctcactagactaacatgtttccttcaccaatatgatcatagaatgagaatgcataagttacacacctctgctaaaagaaaatcattgcctttctaatattaggttttggtagaactcaatttctctaatgtgaaaatgtcaaagtttggtgtctattcttgttattactattagcaagaggcctatgcttttttttctcgaacttgaagcagaaaaattacctctgtgatttgtaaaatcaggcatttcaccatttctgtatttgcaaaggtaattcaagtctaggtagagtagacttagattttgggttttttaaagtgtgttcttaaaataatgtagttaatgttcccattattcatttctatcacagggcatacagtctgggcattcctaataatttttctgtctttcttgataaatgagttagttttagctatacactattttatcacttctctgtatggatttttctgacgcctgcttggtgttacatttagtagagctgtctacagtgtgtgcttttattgcacaccatgaaggtgtgtataggaaatgactgatcttcattcagactctcattagtcagtgaggtgatgaatgaggcacaacccctcacctgttttatttcctgctttgtaaagctttatttactgactattctaattatctgatgaaaatacatacgatgtcattggttacattacagtttatattattataattaaattgcaggttgctctactttgactgaaatagggctttaattaagaatagtacatagctgcctgtcttctaatagtgaaagattatcctagggaagcatataatgtgtatattttaagaaaaggtgatagcccccttgttgggtttattaatactttggtggtataaaatgtttaaatattacattatagttggttaattttaataaacacaaactatgaaagatgatctgataggttaaatattgttaaagtgttttcctatatctccctatgtttttacttgacagttaaagcataaatttctgcattattaaatttgctaacagttttttaaagttcctggtttcagatttgaaagaagtatattatattttcaaatgaagcagaatacaattccatactttaatataatagaaataatatgaaaatatcaataaacaaattttctgaacataagatcaaattgatttaatggtgctagtattctatgaggcaaaaatattgcttaattatcctaaaaatgttctgtagcagtgatataagcctgagtataaaatcagagctccatcttacactttatgttttatttatatactttatggatctattaagaagtcagagacaagtttagaaactgtagaaaagttttttaaaaagaagttacatctttctaagtattttaagttaaccttctttatggtttctttttcttcccccagttggattttttttaaatattgggttccccacttccctcttttatctattttaattcatttggccatttgtagtcttctggaactagtaatcaacaatactttaagattttaatagtggtatgtagttattaatgtcaaacattagaatattattaccatagttaaagctgctattagcagtctgtctctggaaaattcacttaacttttcataagtaaaactaaaataatagcaataataatgcctatcttgacctcataaggcttttatggaaatctggttaatgtgcagaaggttaaaccttgcagagtgctatgaaacagatggacattggaatttttcttaatttatggttctattctcaatatttcattatgaaagagtatatatgaatatggtatatgataaaatagtatatatctagaactgactaacttggttctgatgtcctttcgtggacatcatttcatttttaagctatcagtgctcctgacctgttcaagctggagttgtattttcctctggcagaaaagagatgatggaaccaattggatgtgtggagagaatgtctcaatgtggtttatgtaggatagtggtggctccgtgctcaagcttttattattttttaaattatttgggatccaacctataggatcaaaactaaatttgctccctaaaattatatttattagtgaattatgtactaaaaactagaactgttcagccgattaggttttaaaaggatgcgaggcaatccagagttatgttcttatcctaagtcttacatgctagctagtgcctaattaatgtggtacaaacccagtctatgaaagtgtgtgtgtctgtctgtctgtctgttataaatagccacatagccctgtttcctagttcttggactgttctgctaagggtctgactgttctggttgctttgtatcagtgactctcaactttcccatgcctcagaataactgggattctaatatatatatacacacacatatacacacacacacacacacacacacatacatacacacacacacatacacaaacacacacacacacacacacacacatataattgctgccttcatctttcccttcccccagtctgtttcaattggtttggggataaaattctggcattttttaaaaacctcccaggacattctaatattcagctagggtcaagaatcattgttttaaatccagcatttatatgctgaggttagctttatttctcatctcagttgcatttgaaaacattgggtttaaaacgtttccctattcactgatggtcaatttaattattgaaattttaaaatcctagaaaattactttgaaaatacccagctttaatagaacagtgcttctcaaactttagaatatataacaattgccaggagagatcattaaaacataacattgctggatcataagcagagagcctgattctgtaggtatttactaagaattgataatttgcttttctaaccagattccagctgatggggaagctactgctgctgctgcttgcccaacgaccacactttgagaaccactgtaataagaaatgactgagccatcagagccatgtagttaaatctcagagccgttcagtgaggcagccaggtccactgttggggaagcaggagtagggcctgtgttctgtttctatcatttgtttactttcattaatagttacacaaagtttccacttaactctaagcagtttgttgcttcttctggaaagcagccaattccaagcagtaattacccaaacagagtttgcatgtcctttttccccttgtactttttttttaatccagtgagactagaaagtaaactttaggcatttttagcatagaggggaaaaaataagcatttttaattagaaacttctgggttactgtttaaaagtaaagctatttccataaagtcacactttgtagcttcaggcaaaatggctttactataaacagctggtaacctggccctgtacctaagggtactgtgaagaatgaagcagaatcagggattaccctcccaccagatgagcaggagggaacagaggtcacttctgtgatcatttaatcctgtcaccaaactttggatcactacagctctgccaggcactcaataccttgaccaaactaaggacatttatttattgcaagtggacagttataacaggatagcaacacttaatttaaatgtactttgtgtatagccacctttatggagacattacggacaaggaagtctgaacaaaggatgttcttagtcatgcattgtgaggcggtaggaatttgaagaacctcaggatgcctgaacctcaggatgcctgaacagtttcctttcttcccacttctctggtcataattgaagttaacactcaggtaaatgggttttttaagtgttttttattctctgaaggcaggagcagaccatatctgcctctgaacacaggctgtagcggtcctcatttcttctgcaccccaccctcccgccttttccttgaatttccatctgctcaggctcctgctgtgtttctgatagggcaagagcaggaaattgacatgaatggaatgaccaggttcacgttttactcaacaataaattagatattttaaaatatttttctatactttcagaaagttctacaatttaagggtaaattgtagcatatgaataattaaagtggaaaaatttatccaaggtgatgtgtagagaatttagaggcagtttatcccgagagttgcttaaatccctttttaaatgacttgtatgtgggaagtctgttaagagggcttcctcacccttcaattttgggcaaatagaaccttggttcaaagcagatgggactggattgttaaatatgaccactacttttcccatagcatctaccacagtttaagcagttaactcaccaggaaaatttcatgtaaggacaattatagttattttaatgcaacaatttcaaagtggctttcatctcaagtttttcaaatgcacagaactagtgttttacagattcagctttgttcactctgttcacacaattggttgcgaatcagcctcagcaatttgaaatttatgctgtgtacagaacttagattgggaacaagtcagaatgcgtaaattcatatacctccctcacaagctaacaatggaataatcttttcaaggaattgaattccccaggtttttaatgacccagcaatcaattttcctgtgattaatctcaaaactggtcttacgttgttattgtgggacaaacctttcaaatatctaattagtaaagtttaattttaaaatttatgaaatagtttgaatacatggttgaaaatcagcgcaggtatcaaggcactttatcagccctcataattgttaatcattgtaaatattcaactaactacattgaatctttgggaattggagggtcaatataaaatatttaggctacagccaatagttttaaaggcctcacagtctcagtggatacattaactactccatgtttcctgcttgtgcagtaatagttatagttgatatgttctgaaaaatgggatgaagaattattaattgcagttctttttattaactagagaaaaaaagtgatggagcaatactgagaattaattgtaatttacaaatctggaaattaatgtgcagctgcgcgtaagtacaggcagtgcaatttggtgatttagcaatcatgacaaattatcttcatctataaggtggagaattgttaggattcctttattcatcttttaataatagacccagtttcaggccgggtgcggtggctcacgcctgtaatcccagcactttgggaggctgaggcgggcggatcacgaggtcaggagatcgagaccacggtgaaaccccgtctctactaaaaatataaaaaattagccaggcgcggtggcaggtacctgtagtcccagctactctgcaggctgaggcaggagaatggcatgaacccgggaggcggaacttgcagtgagccgagatcccgccactgcactccagcctgggcgacagaacaacactccgtctcaaaaataataataataataataatagacccagtttcaggaagactttatgtgaatgctcatgttgcccttttatcctgaaaatgtgagtgggagtttaacattataaattaaatcttgcttcctctctttgtcatgtcatgctatagtttttatggaacatttgtacaaaacagtgattactgcatatgttgaataatcttaagatgctactgagagtttaatgtaccttgtaaattgagaggcttccaattaagtcaagttcttaagataatcactttcaaaactgatcaagtaataggacattagtaaagctcttattgacttaattgtgacaaattaataaacagaccctgtgcaattactataatggtgaacagtttttcaaaatttaagcataaatctattctaaccccccaaagtacattaaaaactatatatgccattttaagatgggtatcatttcaaatagctgtgttcgagttcattatacaagtagtatgaatttgtatgtttctttcttttaaaatatgattacatttgtttatttcaaaggtcaattaatctacttgcaaagcccttagagcatataattttacaagaggtcttccgtatgccatggacaaaacaattacatgttcttatgtgttctctcatctctacttttattatgtcctgtgtccttggtgttatctcttcactgagaactatagaatatcttgtcttattgtctctttgtcccctttggggacaaagtcagcatggtacctttttatacattgaaaaatgaatcaattatgaattacatatttgccataatttttaatatctgacagtgccaattcctataactgtgctgactgtgtttaagaaaaatcagcagaaaagaaaaggcagaaagagcagggatgtaagtcttgcttccatcactttaagaataatgtgacagttacatatatttgcctaggtccatctaactgtgtgtatttaaagtgctgtgctttattgaatataactctatctttttaagtgtgatcacatatctttttttatttaaaaaaaatgtagcatgctacccagccattagtcaacataccttgtttaagcatggattttcttatttgttaaagtaggactaataagtagtatcagttttacaaagatcacatttatgacaggacctagaaagttgaggagctgagcaatattttacacccaagagaatggatcattatggaatttcaggacttcatacaggttgctgccagcatagtgcccatccagatttcctgaaatcatcaaggggccatccacactatgtttgatttagaccttagccagagagggagagggagagggagaggagaagaaaagaaacgcaagacaaaaccaaaaagcaaaaaaggaggaagtattactgactgacggcagcagtgactccctcttaaaagtaccacggacgcaaacttgcagtggggctgaaaaaaatgtaggagagggagttccgtgtggtccagggattacaggtgtgagccaccaccacacctagccaataatgaagtttactgctttaattcttcccttcatgaaagatttctctgtaacatgtgatactcttttatggcattttccacacggtaaaacttctttccaatttggagtcagtcttctcaaaccctgctgctgctttatcactgtgtttatgtaacattcttaatcctttgttgtcatttcaacagtgtgcacagtgtcttcaccagatcccatctcaataaaccattttctttactcctccataagaagcaactcctcatccatgaaagttttatcatgagatggtagcaattcagtcatgtcttcaggccccacttctaattctagttctcttgctattttaccacatctgcagttacttcctccactgaagtcttgaacccctcaaagtcatccaggagggttagaatggttagaatcaacttcttccaaactcctgttaatgttgattttttttttacttcctcccataaattacaaatgttcttaatggcatctataatggcaaatcttttccagaaggctttcaatttgctttgcctagatccatcagaggaatcactgtctatggcagctatagcctaatgaaatgtactttttaaataataacacttgaaagtcaaaattccttttttttttttttttttttgagacaaagtctcactttctcgcccaggctggagtgcagtgtcacgatcttgactcactgcaacctccacctctcaggtgtaagccattcttctgcctcaacctcccgagtagctgggattataggcacccaccaccccgcctagctaatttctgtgtttttaatagagatggggtttcaccttgttggccaggaggtcaggagttcgacaccagcaagtgatccacctgcctcagccttcctatgtgctgggattacaggcgtgagccaccacacccagctcaaaattactcctcaatccatgagttgcagaacagacattatgttagcaggcatgaaaacgttaatctccttgtacatctccatccaagcttttgggtgaccaggtgcattgtcaatgagcagtaatattttgaaaagattctttttgtctgagcagtaggtctcaacagtgggctttaaatattcagtaagccatgttataaatatatgtgctatcatccaggcttttgtcttccatttatagagcacaggcagaacagatttagcataattctttttttttttttttttttagacggagtcttgctctatcatccaggctggagtgcagtggtacaacctcagcttactgctccacctccctggttcaagcaattctcctgactcagcctcctgagtagcagggattacaggagcacaccaccacacctggttaattttttgtatttttagtagagatggggttttgccatgttggccaggctggtctcaaactcctgacctcaagtgatccgcccaccttggtctcccaaagtgctggaattacaggcgtgagccatcacacccagccagatttagtgtaattcctaagggccctaggatttctggaatcataaagtcaccagctgcatttagaccctaacaggagagtcagcctgtcctttgaagctttgaagctaggcaatgatttctcctctctagctatgaaaatcctagatggcatcttcttccagcagaaggctgtttcatctacattgaaaatgtgttagtgtggccactaacacattttagtgcggtagtcttagccaagtcttctgcacttctagcacttgctgcttcaccttgcacttctatgttacagagacagcttcttctcttcaccttcatgaaccaacctctgctagcttcaaacttttgttgtacagattcttcacttctgtcagtcttcgtagaattaaagagagttagggccttactctggagtaggttttggcttaagagaatgttgtggttggtgtgatcttctgtccacaccacctaaaactttctccatatagccataaggctgttttgcgttcttatcattcatgatttcgctggagcttttaatttcctttaactgtttggcacaagaggcatagcttttgttctgttttcacttttgatatgccttcctcactaaacttaatcatttctaggcttttgatttaaggtgagaggcatgcgattctcactttcatgtgaacactcagagtccattgttgggttattaattggcctgattccaatattgtagtatctcaaggaatggaaggtcctgaggagagggagagaaatgcgaaacagctggtcagtggagcagctcagaacacacatgcttacaagttaagttcatcattttatgtggacgtggttggtggcaccctaaaacacttagaattgtaccatctgatcacagatcaccataacagatatcatcataatgacaaagtctgtaatgttggaagaattaccaaaacttgacagagacacaacgtgagcacaggctgttagaaaaatggcaccaatagacttgacacagggttgccacagaccttcaatgtgtaaaaaacacagtatctgtgaagtgcaataaagcaaagtgcagtaaaatgaggtatccccgtatgtaaattttttaaatgtataatttttaatatgtagaattatgtggctgggtgtggtgactcatactctgtcatctcagtactttggaggccgaggcaaaaggattgcctgagcctgggaggtcaacagcagcctaggcaacaaagcaagacctcgtctctacaaaaaatttcaaaaattagccgggcatggtggcacatgcctgtagtctcagctactcgggaggctgaggtggaaagattgcttgagtccaggagatcaaggctgcagtgagccatgattgtaagactgcactccagcctaagtgacagagtgagaccctgtctctcaaaaaaaaaaattttttttaatgtttattttgcatacatacacacacacatatacaaacacaattcttaaaaatgagttcagaaactcctgaaacttttcctctggaagattttaaaataaggtagaaaaactcaatttttaagttaaatgcaaacatgaattttaaaggtgaaccactttcacaaatattttcattaaatttagtttccaagtaatcttttcttagaatgagtttctttcaaaatgcagatttgttctattgttaaattgtcacctcctttatcttgaagtgggagatcaagtgtgttgttttcttcttttcaaattatctggtaggaagcatacttgctgacaaccacttgtcacagaaaaaaaatcagcaaatgtggggatacctttctattttgtgaaatgacaactcttgattaaatactttgcctcaagacaatccaaaaatctgtttggtgcagatattattgtggtcactgtccagctctttacaaagtattgtgataatgtaataattctactgtgcaaaggttttggattttaaaattaattgcattggtggcactctataactcataatccgcaatacatcaaaagcctctgaaagctgtagaacagtgagggtcccattgccaacttcttattgtggagtctctgcaagaatctctagcatctcttgtgtgtcacctttcacagaagcaccaagggatgggagcaatgtatgtctgaagatttaagaaagccttttttcttgcttttagatttaagaattagcagctttgatagtttcctcttgtaccctgtgcttattgcactctaattaagagtcctgcatttggcttcaaaggctgctgccataaacaataaatatctaaatgtcattcacctttaagcccagaccagtttcttatcatctgacagtttataatgggcatattgtctcattacattaagtggactttgatcctctttagattactcttgagaatatttttttaattggcttaaaggaaaattctaaattatttttaactagatgtaaatattacaagactaaatttgcggcacactcttatttgtattaattttctccactttaaagtaggccaaactgtgttcatgtgcccagagaggttattgattagataaagaggttttcttaggtggttttcatgtgaaatcgcttggaaagtacttaaacacattactctctaatattggttgggtaagcaataaagtggtggagggtgtcaatctgtactaaaagagtgataaatgaacaacatatttggtgctagtatccaaaatttttgctagattcaaagggattcaaattatagaattcactaatctgagtttctgagtctaatgagcaagaaagtgataatttcatatttatgtttgataaagaagtttcaaaaaatggaatttgtggtgtaagcataagcactatatagaataatccttaagaattataaatttgcttttcaagtttttctaaagaagggaaaataggtcccttttcaaactgaagacgttacaaaatacattattgtgttgattctaaaggaaaacagagtaaaagagaagaggcaggagtcaggaaaattatgaatttagaagctataggcagccagataagctaatattagtgccttatgcttctgtaattttctatagcctacaaggatttccaaatatacacacacacacacacacacacacacacacacacacacatatatatgtgtatatatgaaatctcattaatttgatttaatctaatctggtacaagcatgaatatccaattttataatttgaatttccttttgaaatagtttggaactattggaaccgaaagaaataattttatgcttttaaacttcccaatactcagggcaaaggcagggaagataaaattatcttagtattttattggcattgtaggctatcactcattggcattgtaggctatcactctgtctatttgtagtatattgatcattaagtaattccaatgtttttcttttttttttttttttttttgagacagagtctcgctctgtcgtccaggctggagtgcagtggtgtaatcttggctcactgcaagctacacctcccaggttcactccattctcttgcctcagcctcccgagtagctgggactacaggtgcccaccaccacgcccggctaattttttgcattttttagtagagacgaggtttcactgtgttagccaggatggtctcgatctcctgacctcgtgatccgcctgcctcggcctcccaaagtgctggattacaggcgtaagccaccacgcccagcctccagtgttatttttaaaagttttccatgggtcaggttgaattctacgtacctaccagaactatatttcaccagtaatcctagggtttgatatatacaaccacctttcattaagcttattctcactatttaaagataaaaaataaatgtaaagttcaaaatctttctctaaagagttaaaagtggcaactatatacatagcacctttcttgcctggatgtgaaagctaggattatagaacctgaattcttttaaacatgttttgttagaactgattctccttcctttatgccatctttttgactccactgctcttctgtcttctccccgtctttgtgatcatgtgatcaaacgtgaaactatattcagtgagagcctcagtggtaagagtgaaagcatttccccccagtccaggggcttcatccttccttcagtgccttggccaggccctcagggaatgaggagacctttgctcttccctccaccttgtcctgactcctcaagcctccagccttgaggaggcttctctagatgaaagctcctcagtaattgtattagtctgttctcacaccgctatgaagaaaaacccaagactggggaatttataaaggaaagagatttaattgactcacagttccgcattgctggggaggcctcaggaaacttaaaatcatggtggaaggcaaaggagaagcaggcaccttcttcacagggcggcaggacggagtgagtggcagcagaggaaatgccagatgcttataaaaccatcagatctcatgagactcactatcacaagaacagcatgggggaaactgccccatgatccagtgacctccgcctggacccacccttgagacgtggggattatggtgattataattcaagattcattgtctcaaaacatattagcactctgcttttcatactttttccctttaatcaagaatctttaatagttttccaaaagcttcagggcttgtctttaagtaggcactgcactctgtaaccctatgttcatccacatgtagcccctttgaaggactttacctccaacaaaaccctgctatttttaaaggttcagttgtgtcatctcatctgtgaaagatgtcatcatctctttctctcatccttgtcccttccccactttggaaaagtaatcaccacctccttctcataacacttggtttcccattgccagtataagctatactatggagttgagggactccacaaagttccattaatacataactgtgttgaaggcaagaaaatgaaagctcttgggagaattaaaaagtaatatgttcacttggggttttttccccctaaaacaaaaaaatgttcatattcaggaaatatcaggtgaacacccttctcctagatcctggaccaggtgcaggagataagtggtaaacgttttcttggtgactctcacagagtttatagtctagggaagagacaaacattagttaatcacaaaaacatttcgaattgcaggatgtgaagaagtcatttttgagctgggatcaaggggatgtgtagatgagagctaggggaagagaagagagtggatggtccaggcagcagagcatgtggagtgtcaaaactctgtattgaaaaggaacaggacaaggccaagaggctgaaggatggcaaagccccctggggcagagagcagcaggctggagagcgaacactgacagactctgtggtggggtctcaggtttgtcttggcatcagtgggaagcactcaaggtcctgaggaggacatggtcgtgtttgtgtttaattaattcaggttcctgctcatccctgtctcaagagccataaagcattatgaccaaatcatgccagctatcaggagcgatcgttttagattgtcatgttttacctctttgatatttgtttaccttttcccaaaaacacaagcctgcaatgcaggttcctagctggataggcccttgaaatgttgggtatagtattaaactctggttggtctcctggaattggtttcaccatcaagcagtaaagatttcatttgacatcatctgtcatcagatcatttgactagaaactgctaccaaaacaaaggcctgacttgtgagaaagagcaggtatttgacacagctagcaagtttgtattttttagttctgttcacttgtttcagatagtcaaaaataactttaaaaaaagaatcttcctttaatttgaagaagagaatgtcgtgtaaaatgggttcaggttcacaattgctacagcttagaatgagtccagttaccaaaaaactgaagtcagaacgggcagatatatgtacatatctttatctgtttgttttctttatttttaaaacagagaagaggggattgcctgagttgaaaacatgacagagggattagcactgtaggaaaccaagagaaaggttcatgaaaaatgaaatgttctgtgctagtattgttaaagtatttacactcagaggacataagtggatgccattgattttcagtcaaaaatgcttgaagctcaactgcatttgtgaaatatatacctacatatttaagctaacataacaatttatagataagtaatatttcccaaattgcattacccagaatattatgtccatgaaatattaattgatgatctatgaaaagaaaacagctctatagataaataagtttgtcaacactggatttaaaaggtttcattactgtaaacttctcagaactattaactggctaatgtgcaatgtacattgctcatctctgggatggagctttattataacactgcttcccaaacttttttcaccatggaacctcttttatccaaaacaattattagtatttctgatctgcattttttgttttttttttttgtctcagaacacagtttgatagtcactgattctgataattgttgttatatgtccttcaaaatagtcatcttaatatcattaccctagtaataaagttcttgcctcaaatatatttgaaaataatttgaggtaagtcatttattacacgtgtatactagttactaatgagaatactctgtggtgtgttatatgaaatcttaaaaagtacccactgcagaaaattagcattattgctgtgtttatgcttctttttaataaaaataaaaaagcaggcttctgtttgccctcaatgagagaattgaacgctgggaggccaagtagtgagaacaagggagggtcacacagagttacacatatgaagttttgcaatgggccgctatataagggcccacactttttatgcctatattttgtcattttttaaaaagtataagattgacatactataattataactatttattttcatttatggataggtacataatttgtatctttatttagaaaaattctaacatttccttccaaatttgtttttttaagttcttcagatttattctgaatttcatatcattgtggctaagaaattaggggtttttctttaaaaaaaatagttttctaaaagagtctgagctattttgtgataaaaatttaggatgtatagtcatagaattctttttctgaattacaagggtcttttgtgttctaataacgtattccattatgtatatttgaatggcaagtctagatggttgagtttctcagtgaaaaatttggtgaaagaattattaagatttttgaaaattatcactatatattattaaagaaaaccctaagtcaataataccacaatgtcatgatatttgcattatgatcatttgtgttacccaaagcttcggattcattataaacacatgaaataccactagggttggagtgaagttaatcacattctttgctcttaaactaaaggtaaaactttcttcagttaagttattgaggaataaatatgctggtgaacaatcaataagtaattactacaaaactgtattacaggggtctctctgaaccatatccctttcacaagtctaataaatttcaacattgtttaacttttagttgaatatgttaaactaagaactaggatataaaatgttttgtttcttgtctctttttctctccagtaaatactttcatattttttaaaaagttttggtttcctaagcatttcaatgaacagagcaatgaaatattattgcagatgtatttctctatatatagtgcattctcttaaaattttagtgagtaaaactttttgttaaattcactttataaaacagtttcttttttctgattatagaaaaattttcatgggaaaaaataatcactcgaaatttcaatccgatgttaacatatgcatcactcaattctcatttttaaaaaacaggccaagtgcaatgacacatgcctgtaatcacagcacttcaggaggccaaggcaggaagatagcttgagtctaggagttcaagactatcctgggctatgtagtgacacctcatctctataaaacatttaaaaatagctgctcatggtggtgtgcacctgtggtctcagctactggagaggctgaggcaggagaattgtttgaggtcaaggctgcaatgagccattattacaccactgcacttagcttgggcaatagactgagaccatgtctcaaaaacaaacaaaacaatgaaattgtatacttccgttccattcgtttttgctttgtatccactttttggaggcataatttacctgaagaatacacccattttaagtataaatttcagtgtattttgacaaatgtatacgtctgtgcagacactgccacaatcaagatatacaacttttcgttactcacaaaactttcctagtgaccctttgcagccattcatttgccatcatctgaccccaggcaaccactgatatgttgctgtcagtatacattagttttgtcccttctaaattttatacaagcaaatgtgcaatatgtactctgctgtatagttttttttggtacagcatggtgtttgcggttcattagtaagtattctgtgtatactagttcaatcctttatattgctgagtagtatttcattgtatgaatatactatagtttattctcctgtttatggatgtttgtgttatctctaattttcagtgatcataagtaaaactgcttatgaaaattcacgttcaggccgggcatggtggctcacacctctaatcccagcactctgggaggccaaggcaggaggattgcttgaggccaggagttcaagaccagctgggcaacatggcaaaactctgtctctactaaaaatatataaattagccaggcctggtggctcacacctgtaatcccagctactcaggaagctggggcacaagaatcgcttgaacccaggaggcagaggctgcagtgagccaagattgcgccactgcactccagcctgggcaacagagtgggactctgtctcaaattaaaaaataaaaagttcatatccaggtctttatatgaacattttatatattcttcttgatagatgcctatgaatggaattattgatcatatcaatttttattccctactgtctttttcaaggatgtttattgaacagcgtgggaagatgtgtctaaaatatcatcttttaggacaatgggcagttttttgtttgtttgatttcatttgtttttagtttgtttgctgtccacaataatgatgtttccttctggaacaaagattgggcatgtttcctagcagcaccttttaaagattagggttccctcggctgtaacacaagccagtgtcatgtgcagcgtccacccaggctgctgtgcgtcacccttgtgtaaacgtgaaaggcaaggggcactgatgcatggatgaagctcatgctgcctgctgttcctttcactcctttcctgtgctttgtgtatgtgtgttatggcaatcaaatatttttagtattcattttgagtcctctttagacatgttagttgtctgtcttcatattagtttcttttctcatggctgctctagggattacaatttacttagagttagtattgtatttcaagtaaattataggaactttaaaatggtagagatctttttaaccatcttaccttttgcgaaaaaattcagatagatgcatggataggcagacagatgtactttatatctacctacataatttgccattttcaatgcctttagttttttcctctgtagctattccctgcaacctaaatatgttcttctagtatttcttttacagcaggtttgctggtgacaaattatctcattttttgccaatccaaaaatacttccctttcacttttgaagaaaagtttcatcagatatattgttgtttaaaaaatatataaagaagggttgttggttttcagattttttatcaaattttgaagatgccattcttgcgtcttatggctgttcattgtttctgagaagtcagccattaatcttgtcattgtttccatgtatgtaatgtgttatttattttctgggtactttcaagattttctcattatctttggctatcagaagtttgagtttgatgtccatagctagggtggttcttgttatagttatcctgcttgtgtttgctggttttttaatattggtaaattcatggctttcacaaaatctggagtttttagccagtacctcttcagatattttttctaccctttctcctcctcctcttccttctcctccttctcctcctccttctctttctctctctgtctctctctctaagagacaaggtttcactctgtcactcaggctagagttcaatggcacttcatttcagcctcaaactcccaagatcaagtgatcctcccacctcaacctcccaagtagctgagactacaggtgtgagccaccgcacctggctccagttatacttttctttgacccctaaatgttatttcacaagtctccaaagctctgttcatttatatttaatcttttctgaatattcttcagatacaattttttttttattgagacagagtctcgctctgttgcccaggctggagtgtagtggcgcaatcttggctcactgcaacctctgcctccctgcaacctctgcctcccgggttcaagcagttctcctgcctcagcctcctgagtagctaggattacaggcatgcaccaccatgcccggctaatttttgtatttttagtagagacgggatttcaccatgttgagcaggctggtcttgaactcctgaccttgtgatctgtccacctcggcctcccagagtgctgggattacaggcatgagccactgcacccggccccagatacaattatttttagtgatatcttcaagtttactgtttcttctgcccatttatttagcacattttctttgaattctttgaatgtatttaaatagttgctttgaagtcattgctaaatccagcatctagacccactcagagtccatttctgttcattgttgttcttcctgagcatgggtcacgttttcctatttctttatatgtctggtaactttgtgttaaaaactggatattttagatatgttaagtagcttttgatatattacgttcttctgagaattattttgttattgtttacctagccattaactctcttggattcaaaccataaactgtgtcccctgccaagtgtgacagctggtatttctgctcagttctttccatttccagctgttggtttttaacctggcaccctggggatcttctccgtacctgtgcaatttagcattcagtcaaggattttggcaaattttgtagacattgctaagctctgtcttctgacacttcagtaaggatttcgcttcctgtatcctgagtagagcatggattcaggagtactcagtctataaaagtagcaaacatgaaatcttgtctagtgcagtctttctttcaaaggtagctatccctctggtttctctcagctattttggtgatccccagtgtctcccttatagcatgtcttatttagtggtcatccagggatttcagcagagattatacccagtgttttggtcccacctcttctatggcttacttgtttccaggattccaccctgatctttcagctaccctgccagcctttaactctgtcctgtgccatcttaaaatataactgcaattttttaaaatcagatttttttaaaaagcctttaactcaaattcttactaattgctgttggtgtctttcaatggttaatgctctgttagtttgtgcctgctttttggtcactttctaatgcctttaaatagttgagttttataatatatatatataatgcccagattttataattgctattactggagtatttggtaaccaattttcttcaccattactagaggccagaagtccctccatttttaaaatatcctcaataattttctgtcattaagcattctctgacctttagtagctgcataatatcagatctcctaaataggccataatttttaacctgtctcccgtttttagatatccaaactcttttcagttttataatagtataattagtactataatgtataaaccatttttacttgggaatataagttttattggggataaaattataatttttagggcaaatttctagaaatgaattcagttagtaagtatgaatattaatacatttgatacatttttccaaacatccctgcagaatagttgtgccagttttcagtgccacctatgaaatgtaaggttacttttttttaagtcaaataactttaaacttatgagatttggtggtgtttggtttctgctaaaagaattatttgatttgttttataagcaaaaaaattattcctgattgttttataaactgcataggctatgcttacattaagaaaaatatcacttgtaatatggttatataaccaaaatagtagaatgagtaggagctttagtttatttagtttaattattagacttatttcagtaaatacaaaaacagaaaatttttaaattccactatagggaactaattttgttcacaaaatattttagaatgaatattctaaatattcattctaaaatattcttttcctgtttcttatttcttcccttcccccctttttaaaccactttgagatataattcacataccatacaattcatccacttaaaaggttcaattcagtagttttgagtatattcacagagttgtgcaaccatcagtacaacaaatttcccttcccttttgaataacaaaatgggagtaccaaatggaatcccagtggcaaggtcaggaaggagagagattatggggcaaggagaagagagattctgccaccagagaagctggatttttctcctcctcactcccaaacactgcccaggatttcagctgtgattatataaataacattttaaaggcaattttgtgcatttttcaaactgtagaaaactagtcatggtgaagaagtttctctgtgctaatgtgaaaatgaaatcaagatcattttgtgttgtcattgtttcgtaaagatgaaaggtggaccgggcatagtggctcatgcctgtaatcccagcactttgggaggctttggcaggaggatctcttgagctcaggagtttgagaccagcctgggcaacatagcaagaccttgtctctataaaaacttaaaaaattagccagccatggtggcatatgcctgtagtcccagctacttgggaggctgaggtaggaggattgcttgagcccaagaggtcaaggctacagtaagccatgaccacaccactgcagtccagcctgagcaacaggacaagatcctgtctcaaaaaaaaaaaaaaaaaatccttaaaaaaaaaaagatgaaagatactataataacaacaaccaaaataaaaaacacttcagggtgtttattagctaaaaagtattatccgtaatacgttttatattagccaaaatataatatttatcttatgctaacagtactgtagcaaaaatgaactctggaaaatatggctcttcacattttgaagtcagttggggaagtttgaatatggacaacatactaggtcatttgaggaaattattgttctttgtaatgttctttgttgccatatggtattgtggtcataaaggaggatttccctactctttggagatgcatagtaaaatatttagtgaattgatatctgtgacttcttcaaaataatttcccaaaagtatattaatatggagaaagaatattatgctttatatagataggtgaaggcactacaacaaaataattactaatatttgttaaatctaagtggtgggtatatgagtaaatttaagtgtttatctcactcttgctgttactttttcatatatttgacatttttcattaaaaataaagttttggaaaataggtctctgaggccgggcgcagtggctcacacctataatcccaacactttgggaggccaaggtgggtagattacttgaggtcaggagtttgagaccagcctggccaacatggtgaaaccctgtctctactaaaaatacaaaaattacctgtatttttttgtattggggaggctacggcatgagaattgcttgaacccaggaggcagaggttgcagtgagccaagattgtgccactgcaatccagcctgggtgacagaaatgagactctgtctcgaaaaaaaaaaaaaaaagaaaagaaaatgggtctctgaatattctagacacaaaacaagaatatgtgtttagtttgctagtattaggtaacatgaggaagatatctattcatatttgtcagtatatgcaaaaattatctttaaaatgcgattgaagaaacaagtaacagtggttatctgtggagagggaataggaaaagtgtggatggggcaggaattggaagtaaaatttgtggttacttttttatgctttttaatattttgaaacattttattatctaataaaaattacatattgaaagagagaatattgtcattaaagattggagcctaaaaaaatagaaaaatttattttatgctcagaaattttttcagataatgctaaagcactgggcttgtaactgttgttgacctgctgataatacatttagaatttgcttcgggggtattaaaaaattggacttctttttctttgttacaacatgtcagcattgtttttcttttattgtctttttataacatgttttcactggggacttttaaagaaaaaagtatattatgagtcagttttgtacatattgggtttttttaatgccgtgttgtttcaaataaatatagattggtgatatctcaattttcagtgctaataaatttcctttgctctccttggctcaggaaattggctaatttaactgctaacctatatagaagtatttatatgaaaaatgacatcctgtagtatctgaaaaaagcagagcacacattgttaaactagtcagacctggtgtggaaacccacccacccttgccacttaataactggagcaagtcacttaaccttgtagagacccagtttcctttgctaaacagtaatatcctaccatctacgaggttgttgtggtgattaattgaattacataaacaactcttacttgtagtgtcctcatttaaagaaggtgcctgtttatttttttaatgtggattaccaataagtatgaagggctagaagtttaacattggttatatgcattgccttatttgtttacaagtcattctaaagagaaggaaacttaaaccattttacatataaaaggatactacgtgaaagtaatgtttaattaaattaaaatttaatcaatgtatctttaaactcaccaagtaaaataaattcctgtgttatcaagtttttacctcttggaattaagctttaaattttctatttcattttaccagtgggttcactggtgattggatcagcaactccaaatatcatgatgtcctttacaaaccttatatattgtccatagtaaagtagttgtcgtaatgaacaagttttggcagaagaaagatttctatggtagtcttttgaaaatcattctaaaatgaagattgtggtaaaagtcctcttatgatggaataaagagaacaacttttattaatttcctgtgcatgtggatattcaaaagtgtatggattttttaaatgatgattctgtaagaactcatagttgattacttagccacctgcaagatattcctttgaggaaaaaaaaaaaaatcaccagacaagattttcctagcttttcttactaagttgtataatgtgtcattgatgtctgtggctgtctcttactattagaaatacttttattacctttttctagaagacgtatgacatgtaagagctttcttaaaatactacatatttggtagttgtgtagcaattacattgctttaagaaagttggctgttaacagtagcaatttgttacacttttaaattttgggaataccttacattgtttcattactacttgtgttacaattctatctccaagtgaacatttggtgaattttttttttttgagtagatgtctaaaattgaagggaaaaaaaaacaaaaacagatctcttttggttagctaaatgtcagttgcttaatccaaaaagataaaaatgttttgctggactaatccctgtagtttcaaagcattttcatgtgtattattccatttgatcccactaaaactctataaggtggggtaggtaagtggtactttgttttatagatcaggaaattgctgtcaaagacttgaagggacatgcccaagataacacctgaaaattctgtaagtgcataaatgctgcttaatgattatctgacccattccctaatttacctttagtctctctattgtcaaaactcctctggataaaatgttctctgttgtttaaatgcaatgattttcccttctctttatggagaaatattgatgaaaacactaaatctctataaagaaaaaataaatcagtgaaattttgcagtaagatgggaaaagagaaagaaatgccaaagtgaaaattaacttcagaatacagtaagtcctcacttaatgtcatcagcaggttctttgaaactgcagctttaagcaaaatgacatataaccaaaccagttttacccttggctaattgttataaacaagggttaagtttctgcagcacattcatggtcacaaaaacatcaccaaacttctaaagatcaaagcatttctaatattaaacattgaagtacatatgagctatacttaacatttaagaaagattaattaaaaaaaaaacagataattatttacccagttattccagttcaaggttgctggttgccagagcctaccttggcagctcagggtgccaggtgtgaaccagctctggccagtacgccatcccagcgcggggtgcattcatacatacatattcattcattcattcagactaggaccatgtagacatgccaattcacctaacatgcacagctttgagatgtgggagaaaagctggtgtactcaaaacccatgcagacatgagacaacatgcaaactcagtacaggcagtggccccagcctggaatcaagttttttgtgtttttttttttatcgatgttataagtaaaggacattgaaaagaccttatttgaggatcttcggtggtttaatatttgatagcaataattagctaagatattgtagaggtgagcctaatacaatgtgttatctgatgtgaaaaacaaaaatatttatagcttaaaacagtaaactttacatactgtatatactactataactttctctcctgaacctaattaggaaaaaataagttattgtacagattttcagggtcttttaaacataatcttaggtgagaggagaaagctttctaaatagggtacagaacccagaacacatatggggaaaaattgaaaatttttatcaaatgaaaattagtataacccaaaacatgactaaaatcaaaagacaacaaatcaagaaaaaaaattacaaaacataggacggataaaaggcaagttttcttaatgtataaaaagctctttctaaaaccattaggatgaccactggtggctaatgtggcatgattgtagaatttttaaaaattaggagatgtctacctgtttgtcaatagaggattggtttaatgaaatgtgattcttcacttatggaatgtaactatgcagctgttaaaaattatcctagaaaagtgtctgtgatgagctactactaattgaaacaggcatgttgctaagtaatgtatacaatgtaatcctatttattagaaaaacaacgaactccctttctagatatccatatatgtgtgtgcatgtggatggataacattggtgaactaggattggcaggttggaggcgcaggaggaattgcaatggggtagggatacagtgttagatttttctctatcatctttacattatttcactcattacaatgagtatgcattacttgtgtaaatttttttaattataaagcataatagaagtgaaagagggagtaacactcaatatgtaaatgagacattcataaacaggtatacttctcagaaaaagaattccatttgctgccgagcgcagtggctcacgcctttgggaggccgaggcaggcagatcatgatgtcaggagatcgagaccatcctggccaacatggtgaaaccctgtttccactaaaatacaaaaaattagccaggcgtggtggtgcatgcctgtagtctcagctactcaggaggctgaggcaggggaattgcttgaacctgggagggggagattgcagtgagccgaaactgggccactgcactccagcctggcgacagagcaatactccatttaaaaaacaaaacaaaacaaaaaaaattcaatttgccattcaacactggaagcttatgattaaataaatgcaagttaaagcagcattaaggtgttacttttaacctaaaagattgaccaagttttaaaagtttgataaatgcccagttagtgagcaactagaccattctcatgcccattaagagggaatgtgtattaggacatactctttggaaggcaattgggtaatgtttattaaattttaaatacatactttatgacttggaattagacttgtaggattttatcctggagacctatccatgcatgtgcaacattgtttatcgtagcaaaacttgaagcaaaagaaaaatgttgaataagtaacctactgtacatccacagaatactgtgcagctgtaattaggcagagcaccaggatactttctgttttcagcaaacacagtatacaacaacatgtatggtatacttccattcatgtttactctgagaaatgacagtgggatctggagtatgtggcagattcatttctgttacataatcttttgtttcttttcaatttttcaccatatgtatgttattgttatactttttaatgatttcagaaaagccattgcagaaaaaatgttcctcaaattgaacaaattgatctttataaataactaaaaaaggaaaattaaaatgcatgaatttggctttttccttgtaattgtgggtgatagttattatagcaaactctgaaaagagaacgcatgcttgtctttaccacacctgctcctacttcactcttccccgtcttaaatgctatcagtacttacccagctgctagagctagcaaactagaagtcatctttgatcctgtcttcccttatccccaaatccaattcttcctgacaactcttacctcccgaacatcgctccagttcctccacgtcagtccatctctactatcagcacccagaccaggccaccaacgatctgccttttgcctatacaatcatttgcttgcttgcctacactcctccttttatgtaacctattcttcccacagtatccagagtgaactttagaaatgtgaatcagactttatcatcccctgtttaaaagcctggaatgcttttccactgcacttagaataaattgaaacgcttgatctggcctagtgtccctgtgtaatctgcccctgcatcagctctccagaggccctggcactggagtcccctcactgactgtcagctacaccagccaagcttctgttttcacactttgcagactcatgcctaacttaggacacttgtaagagccactcccaggtcttcactggcaggttcattcgatcgtttctggtctcaccttgaagatctctgcttctacatgttcttcacaacaagccagtctaaagaagcttctcatcagactccatcacatcaacctgttttattttctattttgcacgtcacacattacaagacagttttgccatttttcacattggcattccacttaactgaaataagtaatcttaaattctaagaatatctgttttcccccttgggatccaagaaaacattttcattttgaataaagagaaaaatagcccaaaaaatattgttattatacttaaattgacattcaaggaaaaagaaggaactcatcccaaccataagatatattttgtgccaagtgtagacccaatctataaattgtggaatcttcccactggctcattgctttatttctcaacagttcatttcacaccagatctatctggaaaagtctggtattagtctagtgtaaacagtctgaagttcagcctctctcctgctgtttcagattcatctatctcgtagagactcttcttatcacattaccagtctctaaccctaatgattccctagaagtgagagttttgggcctaattattacataaacttttctgtatcctttgccatttacctcatactgtatgcttgatgccatgtaaagcccagattccattagcagaacataaagaagaaaggtttttattttctttcttccttttccttaaagataaaatgagaacgattagtatctctaatttgttttttgttttttttttctttttatactttaagttttaaggtacatgtacacaacgtgcaggtttgttacatatgtatacatgtgccatgttggtgtgctgcacccattaactcgtcatttaacattaggtatatctcctaatgctatccttcccccttccccccaccccacaacaggccccagagtgtgatgttccccttcctgtgtccatgtgttctcattgttcaattcccacctatgagtgtagtatctctaattttaaaatgctattctgagatttttattttagcattttataatgctttctaaaaaatacagtttccaaaagttaacagttttcttgtgtcagcattcatttatctgagtatttccttaaaggcaaaataatgacggtaatttgtttcaaaatactgtagtgggccaagtgtggtagttcatgcctgtaatctcagcactttgggaggccaaggcaggcagatcacttgagctcacaagttggagaccagcctgggtaacatggtgaaaccccgtctataccaaaaatacaaaaaattagccagccgtggtggtatgcgcctcaggaggctgaggtgggaagagtgcttgagcccaggaagaagaggctgcagtgagctgagatcatgccactgcactccaacttgggtgacagagtgagaccctgtctaaaaaacacaaaacaaaaatacaaaataccatagtgatgtttttactttttgcattttacaatttaaaaacttattttataaactgcagttatttctgtcaacactgacatattttgaatatttcttctagaaaatatgtagttttactatcagccagttactttgttctttgaaacattttttaatgttagtatcattattaagaggctaccagaagttcagagcatgaaaaatagccccattttgattattcttactttataaaggtttttagggctgggcgcagtggctcacacctggaatcccagcactttgggaggccgaggtgggcagatcacgaggtcaggagttcgagaccagcctggccaagatgttgaaaccccgtctctactaaaaatacaaaaattaagccaggtgctgtggtgcacgcctgtaatcccagctactcaggaggctgaggaaggagaattgcttgaacccaagaggcggaggttgcagtgagccaagatcgtgccactgcactccagcctggctgacagagcaagaatccatctaaaaaaaaaaatgtttttaggcatttcattacatttgcaatatatttatctaataatataatcttaatcactgaaaatgtataaacatgtaaattaaaggtaaacataaattgaaagtatcaatacatgaaaatattttaactcttgagtaataaaccttgttttctatttcatagaaaatataatggattaccgtgatatgttagaaatggatttgtcgctgccttattacaaatgcagcagttataaaatggcatctattatgtaactatctttttgagggagcggtggtggtagtaaaagaaacagaattgtttttctgcctttagatcggcatgagaagttgaaacacagaagatgtcgcaaggcagcaaagagctgattatatgcagattgtcctttaacgctgactatattttatataaaggtgtttctaaggaccaaaacagggtacacattgacttcgttgtagtagtttatgttctgttgaaaagattatctatctttattgctgagttttcctcattttttattctttattgtcctttttattcttttgtctttttctttaatctttatgtttttaaaattttagatgccaaagtgtttcataacacagcatccaacaacctccaaaccataagttgtaggcagaaggaaggaaaatgagaatgaagtagtttggtagctttattcttcagcatctgtttgagagtaatctctgaatctgtttgtttttatcacaagctatgcgcacatttttatttgtgcattacttctttcataaaaaaaaccaaaagtaagaaaagctaccattttaaattataagatggtttaattaactgtctggtttcttttggttgggtagatgcatttaatttgaagagaaatatctaaacttacctcatgcagcttaaaaattacaccctaattattgatcctgattacctagacatcatctgttttcctaaactcgcttcatattaattcatcatttgggaatttgaataccattttctcccggtgggttccttaatagcatccattttactgatcctgccttaaaacagttgattacccactctgaagtgtagtgataaagaatgtattaggcatcaaggaatgaatccgttccatttaatcctaagtagtttaatatccggaaaagacctacagtaaggatctgctgaaatgggtaataagatatcagtgtgtttcatataccagtcagatgaagttcagtttattttatagaagtttaattagaccctcttgatcttggctaagtaatgcccagaggaggaacagaaatggttttccaaaaactgtttttcctctactcagctgccagaacaaaatttaattgagttgcaattgagaccccaatcctccagcatttcagggtaggatatcttggtcatcaaaaataacctgagcatatttcctagggtgtttggtgtttggatggcacggtaacgggcatagagtaagcactcagtaaattatgcctgactgactggctcagtcttaagttgctgagtttggcaagatgcatccccgaagtgcttactttttaacctgttgaacagaatcacttaatattggcctttatgcctcagaatttctgccaaaaactaccattacttttggtataattgatagtaaactgttctttccaatagtaattgctctggtaattcagctgggccctgagactaatggtgccagacttgtagctttcatgggcaaggtaaaaattttcctaattattgagagattggccttaggttaccaatgtttttatttcatttaaaaagtataccaaaaaaaaaaaacctactattggccgggcacagtggctcacacctgtaatcccagcactttgggaggctgaggcgagcagatcatgaggttgggagatcgagaccatcctggctaacatggtgaaaccccgtctctgctaaaaatacaaaaaattagccaggcatggtggtgggcacctgtatcccagctactcaggaggctgaggcaggagaattgcttgaacctgggaggtggaggttgcagtgagccgtgatcgcaccactgcactccagcctgggtgacagagcgagactccatctcaaaaaaaaaaaaaaattcctactattatttcatttaaaaaaaaaagataagcttaacatcacaaaagtaggaaggacagagattcagaataaaagacaatcatttaaattgaataaaatttaagccttcataagaagttaccaccctgttgttattttcctcatttcaccttttcttgactcttagaagtcacttcagaccattgcaaatttgtgatggtaaatcatgggatcagcctggaagaggaagttttccttaaattggctataagaggggcatgtatgtggtgacactaaatatgggattagattatctagatgtaagtttagggtgggagccaatgacacaacctctttgtttttgcttttcggttttattaaattaagcatgtattgagcactgctgttttcttggcactgctgtagactttgggataaaacatgtgcgtgatgcacagatatctgttgctgatgatcttagaaactaggagaagcaagtaatactggccacactggctacagtaagagaccataggacagaatttggagagttactaaaagcctgaagtctgtactgatttcatgtgtcttaagccatagatgatccacagacccatagaatgaaagacagagatggaaaacatagccaaatttcactatggtgttagtgtcttaagtactgtcttgaaatgaaaatatgtgtttaactcttacagtgatgggacagttgtatctaaaatcaaagtaaggggaaattttaagagatgtttggcaaactaacttcatatattattattatttccgaagatggaatatactatgcttctattccaacttgaagcttattagaaaaatatcttgatataaatgattgtgtgtagatttctcctccccagttttaaaaagactcaatatgatgatttacaacaggtggatgtgcaatatcccaagggctatggaggctaccatatgaggtgggatatcattggcccacactggaaagagaaatagctctgtaagtagtggatgtttatgtctctaatacacattcccaagtccttcctcattatcagtttagataattaaactgacatcttccagctggcatctttgtagacatttttgtctgaacataagttagctttaaaaagaaatgattcataaacatgacaggaatgaaaaaaaaaagaaactagacaccactgaattgtttatagtggcaaaaacataaaaataaattagcttcagtgtccagtgctgcagtgagtttaaataaatcggaatatatccttggaaaatttttttaaataatgtatctgtttagtcagatagtatgcactcaacagcaataatgatgtatgttgattggcatggaaaatgtttgtgaaaaatgcagtatatatttaaagcagcatgtaggactgatttttttttaagtggtgtatatgcatgcccatctaaatacaccaaactgctttttcatcagttctgctcgcctttttggtggtgttctctgaagctattgatagaatatcccaacttgcccagtaactggacagaaactgcactcgacttatctgcaatttgttgatagaagttagcaaggagatcttacccaaaagatagatgggaacgagaaatgtggcatctttgaacctctcaggagcaggttatttgtggaatcagagagtgcctctcgccatctttgtcttcataacccccgtcttcccgcacagcccaagatagtcagatgtaagaacagcagtactgcgagtcaagagtaaactaaattgttacatcttcggtttcagctctgtctaaaacaactacccgtgatgagatggagcaagatatgactaattttaaacattattttggcccttagttaaaaagttgtgtggagatttaccctgctgctgtttgaaagcaggaagctggggtttatgggttaattcagtaaatagctgccctctgttatccacctttccccagagagatagtcattgggaaatagtcctccacagtcagtttctgcaagctgcaatagaatcgtggctagtcttagaatgccagtcccctggaattgttattccaggtcttagtgaggtcctaagagtgtaaatttgaaagatcagcactgtgcaaaccttttcaggaaggacgcgtttgtaagtgaagctcaaattgctttatctaaaaatcaattcactttgagaatacagctaaatgacgcaatcgttgatgaaatttctgattattctttcccaatctgtgctaaaatccaaaaggaataatgttggattatctgctcttttgaattaaatatccctgtttgccattctgtttgcatacatgactgaacctttgcaataattgtatgggatgtgagggagtatttttcttccaaaaattgataactgtataaccccaaggagtcagctatattctggactatgaacttgaatgaagtttgtttacagctcagaaattattcaaaccagaattctcaagaaaattatttttggttcatttcccattttgcataaaatagcaagcagtgaggaagaataaatcgaaagtcatagctaatcaagactttataactatttaatgctttgtttatatattcatctggcaatttttagaattgcttcagttctataaattatctggtacatttgatgataataggtagccaaatatatttgttaatgatccaaattgtatcgggacagtcactgtaacctataccttttttttttttttttttttgagacggggtcttactctatcaccctggctagagtgcagtggcaatcagctcactgcaacctccacctcccaggctcaagtgatcctcctgcctccacttcccaggtagctgggactacaggtgcacaccaccatgcccagctaatttttgtattttttgtagagatggggtctcaccatgttgcccaggctggtctcgaactcctgaacccaagtgggctggctgcctcagcttccgaaagtgctgggattactggaatgatgcatcacacacagcaacctgtaccttgagttaccttaatttaagattattttgaaagaatacaccatcaatccagagcaatcctccaactagttgaatcattacgggctctaggaaaagagttagcatctctcccataggattcagatatgaatagactagcaccattagtactgtggttccttcctccagccctattaaccattcccagaagacaggaggaaaagcacataaagcccattgctatcagagctctgaggtctgtaaataattatgccttcttgtttttgagtaaagtaggatgaaatgtattaccacagttaataaactacattcaaattatagcctccaaagcaacaaaagcattccacactttcaaaagatcatagtgactcaattcctttaaagagatgtttctaattatagttgccaaaatctattattttagttgtgatatatttctttttaaatatttattacctttatagaatactgaaaatttaaaaattgaaacatatacattaagtaatactccaatttaaaatggaagaagtaggaattggaagaaacagaaataaataattagagtgatgtagaagttggaagttctgctgcagaatcctttgaaccaaacacttggcagctccccagaccacatttattgcctttttgtgtatatatttccactggccaacttgtcgtcttggcttgaaatgtagtcattgtaacaagattggtaatatttaaatatcttttcctttcatgcctgtcttatggaactaatggtttctgaacacaaattattattttatctttaaaatatttttctaaatattattagtttttataaaatagaccagataacaccatagctgtctttaaaatactgtcataatggaactgaagttagagacattttaaatctcccactgccatagataaaattcgtttttggcccagcctcacctttggtaaccgggaatgcccgagacactgtgaccccctctccaccagaccaagggagctgaactcttactctggcctcatttccctttgtcaccaacccccccatttgagtgtcaaatgcccatgtccatacatcattctaaacattaaagccttataaacacatagattcctcagtagatttatagaatttaaaagacaaaaatgactttagaaatcattcagttcatctccctcaatctgtgagtgaccaaagcttacatgcttgctatgcaagacaggaggcagccatttctctgagacacacagacacatttcagctgtggcggcatgtggtagatagatgtgtgccccatgtcctcatctaatgtctatagttgtgccatctctaatttcttgaaccccttccctgacttataaagagccagtagaaccgttgatctcataagtaatctaactgaaatacattaattctgcagactgaatgaatggtaaccaaagatgtcctttcatatgaacatactttatattctaaatccagttttctttctattagtataacatttcctctgctagtgattttaatgttcttgcttccgtggttgggggttgggggggtggtgacagaaaagagtaccattttccttctgatatgaatgtgtacaaagaggaaggaaggataaatttaaccctttttaaattaaatgttaagaaatgtttctaaacgtattgaatgcttttccagtatatctctggatttttctcgattcaccacattaatggcagagaacaaatacatggatacaaagtaatttgaggtttcatttagtacatatatattgcttaactttctcatctgagtgtgctaccacatgctctaatccccaaacttaaccagtccctgaagatctggaaggcgggctgggcttcctcaacactgtgttctctttcttttccaggataaagtcatcatctcctcttaccctgatattgccttatgtcgcagctttgtttttaatatttctccagaccacagaaatttgtagttttgctaaataggcttattgacgttagtcagtgatggagtgattggaataaaacagtgatatgtcatgacaactagttaatgaccaattaccatgtgcatttgccatatgttagtaaactttgaaagtagctattcatcctatttggatgattggaaattcttttttataagccaactatgaaaataaaacctgactcacattcccagagcctaataaatttagggcattttgtaaaataaatgaatatatcattttcagatctctgtgtcttatttctctttactttttcttagatgtactgtatatcagtgttttggaggaaactctaggttttgctgtagaaaggagcaggaagtgagagtgaggcgagcccaggactgcaagcgccagtaatcctcatggtttctctcttcctcagcagcctggcagcagacgccaggacaggactgaaagggtttacccagagctgtgactgatacatggcaaaaaacaaagtgggggtggacaccaagagcattttgatggggtctaccttagaaagagaggaaagcaagaattccacaagccattaagacctggctccagcctgtccttccagccttctctcccaccaaccttcctttcctccattctgcagtgtaacagctgcctctggttcctggccagcccctctgctcgtgtgttctcccttgcccagattctcatcattttttcctcaccaactcgtacttgcccttcaagaatcaactcaggagtctcttccttgaagaagtcttctgtgatccatccccactacgctggattgtgtgtcccagctttagatgctcagagaactcttcacacatttatctcggcattcatcatgtgtgattggaactatttatgcttagttcttgttctgtcattgcactattaggtctttgagaaaaagtgattgattatcataaccatgcttgtaacccaatgccatgtatagtcctagcaaatagtaggcatgcactaaatgtgcatctaaactaaaagtgtaggattttagctatcagaaagggaatttattaggagaataacgaactttattcttttgaattaccacatctttcttgaagtgttaagtggctcttcagaaataaactgtacccaagagtactgccatgtctcaggagtcactttatgtgtatttgtatgtatgtatgtttataacttttttaaaaggcctagttttttaaaaaagcatttctccaagaaaggccatgaagcagtaatttctgaagctcatggctttcacctttccagatttttataacataattttgttgagattcttgatcataggttatatagagtacagaatgagttagcaccttaggtaatatgcttagaaaaagataaaatagtgtgaagatacacgtaagaaaggaagtctggtaaatgcaggaagatttggagagggatgaagtgagtgtataattagtgaatctttgaaatttatcttctatccacataaaattttgtatataatgtgaatgtccaaaattccttggtctcttaggctgaaattaaaatgttgaagagctttatgtggcatttgggcatggtgggagtgttttggtcagattttcttttatattctatgtggaatggttatgcatctatatagcacctgtattttccaaaagatttgtgtgttcaccaacagcaagtactcagcagcttttttctaaattaagtcaacagtaattttcaatttggagataggagacaaaccctaaaactggtagccaaagaagacagtgcttggttttataatatctagagtggactattagctaggatgcctttttttaaaagctgtctatttcatgtctgctatttagatagtgaaaaacggagttaatctgacccataactcttcgacgtcatctcttctttagtggtattggaaggaactggccctgggcctctggaggcagcagtattctggcagaatttggaaccctgcatttggagtttatgcacttgagccacttatcaggaaaccccatctttgctgaaaaggtgagattcttcaatgtgccttggcctgcaaagcaacacttatgagaaacagtattgtctctgagaaggtttaggaatttttgaagtggaaataataaccaaatttgttatagctctttctgaagttttgcaacatgcagcatttcatttagccaaactgtaaacctacagcctttccagtgcaccactctagttcaggatgtgagggcacagcttccacctctggttccctttaccttaagttagttacttaactcatctgaagtttgtttccttatctaaaaatatttagtaataaatgcactgcatgagccaactatgtgaaagacagactgaaagtgtcgtacaaatgtgatgttgcagctgaattggtccctcgttttccgaaagcaaaccaaatatttggataaattcatgttccccccatcactctacttttattttcaacctgctttttggcttccctttacagtaaaattgcttgaaagagtcgtccctgttgtctacttttcaagtctcttgaacctgctccagtaggacttttcccccagccacacctgtcacagtgaccagtgagcacaacagtgccaaagccacttaccattctccccttcatcttccttgccctcttagcattcgacacagtcagttcttcgttcctgagatacacttcgcgcttggcatgtaatactctcccagtttgtctcctcttttgctggatgctccttctgtcttttttgtgtcctcctcaacaccccaccctctaaatattggaaagccctagcactcaatcctgtgcctctgcttgttgatattcactccctacattgttgcatctagtctctgggctttacataccatctctatactctagactccaagtttattatttcagtcccaacctgtcccctgaactccagactctatatctgtttattaaacatctccactaagaggcccgatagacaagtcccacttaaaatgcctcggacttaacgcctagacgtgcttctccagtctttgctatcttggtaaatgacatctcactgtacccagtggtctcctcctggttcttcttcttggtaaaccccaggcccagtccactaagaaatcctttgggtgtctcactgcctctactgctgtcctgatctgggatccatcaggtcacctggtgtactgtatgtacaccatacagtagccacctgaccaccccttcctcaccccctcagccttctcatgacactcagagtaaaatatgcccttattgtggcctgtggggcctgggtgacctgggccctggctctcctctcctctacctgctgacattctcccctttgtctcctcacctctggcctcagtagcattgcaaacctgctgtctcctcagggcctttgtacttgctcctctctctgttccgagtgctcttcctccacatttccacgtggcctactccctcacttctttaatattctgctcaaacacctccgccttgccaggccactctgactaacatgggatagcctctccacatcaccctgtcccgttaactctcaatcagctcgggttaccataacaaaaatgcagccagaaacaaccgaaatttatttcttacagttctggaggctgggaaatccaagatcaaactgcccatgaggtaggttttattctgagcctcttccctgggcttgtagatgacgagaactgtcccagtgtgtgttcacatgatgtcttctttgtgctctgagggagagaaggagtcacagagagagagagagagctcttgtgtctctcatgagggcactaatcccatttaaggctctaccgtcataacctaattaccatctccaaataaatctccaaatacaatcacactgggaagtagggtttcagcatatgaatttaggggtatgcagttcaatccatagcacccttttatttttttccacagtatttatcatctcctgacatactatacagttaggtgttacttaacagtgtttattcaacagtggaccacatatgtgacagtggtcctgtaagtttataatggagttgacaaaattcctacggccttgtgacatcatagttgtcataatgtcgtagtgcaatgcgttacttacatgtttgtggtggtgatggcataaacatactctactcccagtcacataaaagtatagcacatataattatgtacagtacataatatttgataattaaatgactgcattactgatttatgtactactatggtttttattgttattttagaatgtaccactttttttttaagttagctctagaagcaaggtccttcaagaggtattcctcttcaaggcattatcatcacaggagttgacagctccatgcgtgctactgcccctgaaagaccttccagtgcgataagatgtagaagtggaagacagtgatattgatggtcctgtggagtcctaagctaatgtgtatatgtgtcttagtttttaacaaaaagtttaaaaagttaaacaactttaaaaagaaattttaaatagaaaaaacttataagaatataaagaaagaaaatattttggtacaactatacaaagtgtgttttaagctaatggttattacaaaagagtcaaaatttttttaattaaaaagtttatcaagtaaaattacagtaaactaacgttaatttattattgaaagaaaaatacttttataaatgtattaataatggctaagtgtaccatgtttataaagtttacagtactatacagtaacgtcccaggccttcacattcacttattactcacttactaactcatccactgcaacttccagtcctgcgagtttcattcatgataaatgccctatacaaagtgccctgtatttatgtatagggttataaaatgtataaccctatagaaaggtatcatttttcatcttttatagtgtatttttctgtgtttagatacacaaatacttcagtacagtaacatatgctacacaggtttgtaacctagaaacagtaggctgtgccaactacatttgtgacagtgtgctctatgatgtttgtacaagaattaaattgcctgtgtttcccagcatgtatccctgtcattaagggacacatgactagacttattgatttattgtctgtcccgtcccactaggatgcacaattctaagagtgcggtgactttgtttatccactggccccttgttcctagtatggcatctggctaatggtagataactaatcagtgtgactatattcacttactgccattatgtttgtaataataagctaacagcagttatctttgttctaactctgcatcatttaagtcaacttgtatgttcaagaagaagaagaatggcatgaaaattgttttttagattttcacggtaacattttattttctattataggtaatgaatattcgaacagtactgaacaaactggaaaaaccacaaggcctttatcctaactatctgaatcccagtagtggacagtggggtcaacgtaagtcagaagatttgcattattatagctctttttggtactgtactcgtggagagagaggaagcacaaaagcagcacagattttgttgagaaatgtttagaaaaggagaaaggggcatggctcctttaataaacaggcttctgtcatcagattgtgttattaggaaactggattgtgtatttttcatatataactccaagtgtgatgacatataagcacatttacagctattaatcagaaagggaagatctggccagagtagtgtggggatgttaatctgtaacaagctggtcatgtggatagaaaggaaattcattcctttgtactaatgactatgagggttttatagagagtaggtagaccattctgcttcctaacattctgtttctgcatggctatataatgagagaggagcctgaatttttaagagttgggaaattggaagagcaaacagcctgtttttctcttcttaattttaagctgccagatataaaggtttcttgccagtagaattacctttaggatgggagaaagtattgcacaagaacttttgatcctagaagcctgcacttaagactcttcagacgattttgagcaggggcataaagattcagagtagttgaaagaaatgttctcaagctgatttggaaaaacagtagtagattaaatagctgaaaacaagtgaagaatattgagatacccaactgtagcaagagtacactgccttaagattttactctaatttgggttttttctttatattttaatatcatgttcttagatacctcattattactttagaagtacttttcttaaagaatagtttaataggaaagtatatgccaaaatccatatgctaaaatatgtctgtagctctggaaggcctagctgttgaaaccttaggactataatcaaggttaccacttacctaagtgtggtcaacagatcactggaagtccttgagacctctgaggaggcccacaaggtcaaaaatatttttattataatactagtataatgatatataataacaagacatataatacatgtcttagtcatatttactaagccagtacacagtatcttgcacttagtggatgtttacttacttaaattttgtgaatacatatgtgctctgtatctcatctctctttctgcctctgcttttaatagtggtactttgaaagactttctgccttttctaatgtgttgatatttacacctacagtgttaggtgatactgctgaagcctcactgagaacaaaggcgaacaaacaccaaatagtactaatattcatattttttcttttttttttcttttttgtgggacagggtcccactgtgtcacccaggctggagtacagtgtcataatctcagctcattgcaacctctgcctcctgggctcaagctgggctcaagctatcttcccacctcggccccccgccccgagtagctgggactacaggtgcacgatgccatgctcagccaatttttaattttttttttttttggtagagagaaggtctcatatttcccaggctggcctcaaacttttaggcttgagcgatccctttgccttggcctcccaaagtgctgggattacaggcatgagccaccacaccagcccccattgtattcttaatagcattttaaaaaaggatactggtttcacttatgaatgtgcttactgaaacagtaaaaaaaaaaaattagtgattctaataaataccaacctgtgagtacacacctttgtcatgttctgtgaggtgaaatggaaaatactcataaatcactcctgctgaattatgaaaaatgatagttgcatcaaggaaaagctcttgggtgttttgagttgcaagctgagctagccacttactgtttcacagattcaacatttttacttgaaagaacaatttaaaaaatgattatttaggctaggtagtcaggagccatgttcttgaaaatgagcttgtcacttcaagaaaaagtcacagtatttgtgccaatgattataatccaagtttctaaataaaaaatagaattttggaaaacttgtacatgctaccatgagcttgacacaaatacttttcctgttagattgatgatgatattaacaaatgtggttttctgatattgtataatggaatgggtcaatatttgaaagatctgcatagttcagtgagccaggattttccaaatgaccaaagcatgatattataagatcatatatggaaaacaatctgtgtaaagtacaagatagaccagtggcttttaatgtaacaatacgaaaattcattgatgtaatttctaattttacaatgcaattaacctttaaaaaagaaaccacttgttgactattgttgtaatatcaaagaaaaatatccacaattgtgtgaaaagcctgttaaaatatcctttctttttctgactgtattactgtgtgaggctgacttgtcttgatgtattacagccaaaacaacatatagcaaaggattgaaagtagggcagacatgagtatccagctgtctcctgtcaaggcaaacaagaaagagatatgcaaaaatgtgaaattgtgtcagtcttctcactaattttttgttttgttttgtaaaatataacttttttgaaaaattgtatatgttaacataatgggcatgtaattattattttaaatgaggtaacgaaaatatttttaaattattttaattttccaatgtagtaaatataggtattatttacataaattatttggggtgtccatttcttttgaagattacaaaagggtgctgagactcaacagtttgagggccaccagaggactagggataaaacaacttgtgtatatttctgttttgttgtttgagatgggagtctcgctctgtcacccaggctggagtgcagtggcacagcctcagctcactgcaacctccctgtcccatgctcaagcaattctcctgcctcagcctcccgagtagctgggactacaggcatgtaccaccacacccagctaatttttgtatttttagtagagatgggggtttcaccatgttgtccaggctggtctcgaactcctgacctcaggtgatccgcccaccttggcctcccaaagtgctggaattacaggcgtgagccacgctcctggcccttgtatatttttctaagtataaggtgacaggatgtgattctctaaaagcacaagcatttttggagtattcctcaccacacatttcaaaagctgaagaaaagtctccttcatttactgtttccttcctatgatttaggatttagaagctgctatgaagggggacagaaggagccagttgtgctggaacatctccgcttcaccttctgggtcacctgtatgctatgtatttggccatgtttcctagtacaaagagccctttatatttagattccttatgggccaatttcctgatggaaaaaaaaaacaaaaaacaaaacaggattgatgagtcttagctctctctcctgccccaacccccattctgtgttctagccagaggaaaacacacttatttttttattcttcaatcgaggcctgcttggccatgttcaggtctttgcttgtgccatttccttagccctcccacctctcaagacccagctcaattgccatttcttccaggatcccctcttcagtgctccggttgggatttattagcatccacttttcctctattctttccctgccccagcgctttgagtgctttcctatcacaaaccttttcctgatgattcacatccatatgcatcttcctaaggatccaaagcttttgcgggtagtaaccatgtcttagtcatatttactaagccagtacacagtgtcttgcacctagtaggtgtttacttacttgaattttgtgaatacatatgtgctctgtatctgatctatctttttgccccttacctttttttttttttcttttttggagacggagtcttactttgtcgcccagggtagtgtgcagtggtgcagtctcagctccctccacctgccaggttcaagcgattctcctgcatcagcctcccaagtagctgggattacaggtgcccgcccctacaccagggtaacttttgtatctttagtagagatgagttttcaccatgttggccaggctgatctcaaactcctgacctcaggtgatccgccctccccggcctcccaatgttctgggattacaggtgtgaaacaccacgctggacctgcctctgcttttaatggttgttctgcttgttctcttttagcagttgcccctgctcctcagttgtggctgaaaggcagtatccggtcctggtcactgataatatgaactgatcttgttactattgaggccagatggcagggtttcctgtctgtacacagagtatttatcatcccttgatttctataacagccatccatctatctatatttagtctagctagctatgtgtagtgtcactagcatcattgggggattgtttcaaagagagaaattcagatgaagtcaacaaaaattttaaaagggagatattgagtattttaattcttctttgtcttgattcttttgctacttgctttttctcttttttagatattagaaatccttttatgggacctattcttatgaagaaaagaataaattactccttcagagaagagcgtaatatttgactgactacagtacacctcacctttagagcagttggacataaaaataccatattatgttatttccagaagtaggttgatcctttcctgctgataaattcgggcctgctctccccgacatccactaagatgtttacacaggactgtgttgagaaacagccatccaggcctgaaggaagcttagtgagtgacatgctaaattaatgagaagacctgtttctcttctacgttcctttgtcttgttttttttttttaatgtgaaatttttataggcaggaaattttaaaaatagaaaactagcacttaccaaaattaattaaaacaaatgtattcttatataacacttttttcttttttaaaaaaaatccccagctgctcaaacttgcttcttccgtctattagaaaatcataacccaaggggaggaaaacatcaagctgcttctggccattggttttcagctctcattgctttaactccaaatgacacgtctggatcctggccatcgtttcctatcacttcatcgagtcagtgttgttttgacaatgccaaaccatgatttgcttttccacgcatcacttgcatgtgtctcctacaatcatgttgataacaacagggcttattattgatgagttcgtacttagtctatttagtttgtaaatgtcagaggtttctgtgttgatttaggaaactgtaaaggtcacttcaagaatcagacttagaatttttaaaatatatttttacactaaaatttaaactataattctacactttctgcaaaaagaaaatcacatacttaactactttaaaacatggctctttagcttgagtagttacagccctttattaaggttgacatagaagaattttgctttgttcgtcagttatttgttgagtacctaccatgtgcaagacactttccaggggctggggtggactgggaaacataataggtctggtctctgccctcttggttcataatcttgtggaggagacagaagaaaatgttaccacattatgaaattacaggtgataagtgtgtgctaccaaaaagtgtgtgacaaaggaacctagtggcattgtcagagaacactcctttgaggaagtgtcatttggtcccagatacgaagtatgagtaagaactactaaagaaggggaagggggtcctagggtccatttcaggcagagagaacaaggcctatagaagccctgcctgagatgagatggaacctgatgtttttgaggagccaaaagaagggctttatagcaagtgagcagagagcaagtggagcaagactgaatggcatagagaagattgagatcttgcatggcaccaaacacacaggattgaaaggcttcgagtaaagggtgatctcattcatgtattaagagggctattctggcattaatgtggggaatagattgaaggggcactgtcattagaactctgggccaggcgcagtgcctcatgtctgtaatcccagcacttttgggaggctgaggcaggcagatcatcaggtcaggagttcaaaaccagcctggccaacatggtgaaaccccgtctctactaaaaatacaaaaattagccaggtgtggtggtgggctcctgtaatcccagctactcgggaggctgaggcaggagaatcgcttgaacctgggaggcggaggttgccatgagccgagatcgcaccattgcactccagcctggtgacagagcaagactccgtctcaaaaaaaaaagaaaaaaaatgaagataccttatcctacagttgtgagattgttaatacatgtagtggatctggcatgataaatggcagtgaaggtggactataggaatggagtattaggaggaaaaacttcttcttctgccccatatcctttctgactgcccctgtcccataggtatttgacccttcagattcatagcactagaaaatttatcaaataataataggctgagcacagtggttcatgcctgtaatccctcttctgtgagaggcccaggtgggaggattgcttgaggccaggagttgtatatcagctgaggcaacatagcaagatgccgtctctacaaaaaatttaaaaatgagcctggcgtggtgatgcgtgcctgtagtcccagctacttgggaggctgaagcaggaggatcacttgagctcgggagttcgaggttatagtgagctatcatcgtgcctctgcactccagcctgggtgacagagtgagtttagaaataataataatggcaagaacctgaggagcttcttgttttatttattacaaaccaccttctaaaaaagatttgctaatactcatagctttgccagaattttatattattcagaactaaagcaaataaaaatgtatttaaatatatactgtgaacattttagttgggtgtttttcactagagaaccagatttttagaattaggggtaattacatatcttttatcttccatgtttacaaaactactctggtaattatttagagtatgttacattagttaatagcccatctgctcatttcagaatatctttctgaaaataagagatttgttggaatttaaatgtaacagtgacttgcagttgacatagggttgcatcctagttgctaatgtgattttgctgcattatctgaattaaaagctgaatcactctaaaattcatttccctctctttccagatcatgtatcagttggaggacttggagacagcttctatgagtatttgctgaaggcctggttaatgtctgacaagacagatctggaagctaagaagatgtattttgatgctgttcaggtaacccaatatttaaatcatctttgccactcagccctaacttataatttgtatattaatcaagttttaatgaataagtggtatactacatgagtgagttacaaagtatttccaattaggtagagttcgatatctgctaatatcatcgtaataatggtaatcatatttgatgtttatttctaatagggccgttaaagtttttgcatggtttaaacctcagttaagagtcacatatctgaaaaagtagtattctttgataaatatgaattctctccttaggaccacaatttaaattatgcagggggaaatcctgaatttgtattctgacaattgcctaagttaaaattgcctgagaagacagacagtcccaatggctacctccatgtgaagtaaacttgtccccagagataaatggacagtactctaaggaaatccacacataaaaatctgaacaaactcatatttcagggaagatcattaatagtatcaaagattctttacagtggagaagtaagaggcaacagttgagtgttgaattgcctaccatgtgctaagctgtgtgttaggtagctcctttaaatgaagcggtggagttgggtttttttctctctcacagtacttgagattattacccagttttacagataaagttgctgtacctcagagagattacatgtcgaaccaaaattaagattaaagtttgtctatatcagcacctgttccttttaactcatccactgtggatttatttgtaagaatttccattctacacttaaatcttcatttactaatttgcaagcagtaagttagtaaggtaagttagaaactacttaaagtctctaggaggaggctagtataaaagtaaactaagaaacacctccagttaagcctcaatcaaaaccgaaaataaagttagaaagtaaataaagttagaaagaaaattactttatctaaaatatttgtactcttcaggaacaaaattttttagtggaatcaggtgcttttgcgattaagtattttatgtggtaatacatatattcttttaatattattatcaaggcttctcaagtagtgttgtaaaatagtggctcagtcctcagaaaaattttatttttcttgacagcttagaaattttttaataaagtgttaattcataggaaaaaaatggaaatttgtaatcccaaagatgtagccattataaaattggtctttctaacaagaggtctgggttattttgacataggcgtacttgtttatttaaatataaatgcagcttgctttgttctggttaactacactgagtatgacattggtttcctttacaagtcttcactacttcacacgtaggaaccagaagcgccttagtgagaacgttggcctacatttggcacagcctttataaaggcacatgattaacatcaaaagcaaactaggatatgatccacatggcctcttttaggtttatttttcctcattgctgtgaggtttcagattttaacctggggagttctccatattttatagtttccattctgtcatcctctaattaccatactggcagacattttaattattctaatcttaaattggccgtctaagatcttgatgttcaaaaaaagacagctttaaaacattatttgaaatattttcttcctaattcctaaaaccatacccacacaacttttagtatattgtattcagacaaatcattgacaggaaaatccattaagaacaaataaagtcaaagtgtttcctgcttctcttagtagtaaaagctaatttttcaatccactgtatattttcaacttagaaagcaaagctagaacaactaaatttctgttttgagaagtagcattgtcttatacagcaaagtttatttctgctaagttgtactttagaagattattgtaaccaaggggaggatgctgtacactattgttctggacaattgattactaaagatatggctactctgttgtagtttcaagtagattttgggaagcatttaatcccagagtgatatgttttatttgattattttaataacaaaatattttgagctttcaactggctatcatggccctatctggagactacactaggaactcacaatggcaaatgatacctgggcagatgacatatcagacacttacgattctgaaggcttcatcaaaccagttttttaaatcaattatagaaggattaaatcacaaaatatatcgtactcttttttctaatcaattatctgtatccttgacacagttttttcagatctactaaagactatccttctttgtatttatttatatttcccatggccacacaaaattattgtttgaaggtcttggaatttcattgtagtttttattaggaggtagcaacttggtccgaatcatgccagaaatactttatttaggatccataacagggtaataatgtttctctaattcatcctcaaaagctactactcttgccatgtagaaagaataatttcttaggtgatgaacaagtatctgcttgaaggactttattgcaatttgtgttatgagaagtataaatagctaagatattcagtcgcataaaataagaatgaaatattaatgtaataactaaaccatcaataacattagcttaaccacggttaatgagcacagtaatatgttcatttatttcttaccatcttggtttcattcgtttatttctaataaaggtaggaaaggttttagcttcctgtgtgttcattttcattcattcttctctatcacaagtttttttctgtgtctattattcccaaatgtgcttcctaacaaatccctctctcttgatagcagtgtacaggtatagacacagtcatgtcctttttccttccatgaagtaattgtggggcagtggggagaacattttctgttagagtaattggagattagcaatgccaaacacactttatttttgctttttaaaatataaggcatattttacttacctgtctagtttaagagaatatcaacagacctgggatagaaataaaagatgttttataaatcatttttgtaaacattatcatttctcccaaatttaaagatttttctgatttttaaaatatatacatttattcattatataatagtgtgctttttaatagaagtattagagaggaacttgattcaagcgtcaccactttggagatgtaaatgataattataaatgacttttatcaagtgccacttgcattagtgactgctttataaacaaaatgtggcagagtcgtatcaggagatcctgttgttcccatttatggattaggatgctgagatttagagatatagtaagcaaattgttcactcccacaaattagagatagtgtcagagctggaatttgaagccaagtcttccggccccagaacacctcctctttgccactctattttgttatccctccaagcctacggaagtgaaaggaagagttctgccaccatcctggatctcatgcacaaatatgctgtgttcttcatccaccttagggcctgggctgtgtcatttcaccacttatggaaatgaaaatgtaccaaaccaactattactgctgcacagtggcctgtctttgggaaggggaaagttttttgaatatgaggaatacaatgtttggtcacagaaccaagcaaaaccaaatgtgctggcgcagcagtgttaattctgactaatcaaacaaataaggcataaactagaggaggaatacagaaagcaatagcatgtaatttcaggttgaatggatttttaacaccaaactctgattgtcaggtgtattctattcttttttttttaatgttgggcatatttttagtataaatttgagaagagattacaaaatgttaaaaaataagtgtttttcacaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatgtgagtacatgttattcttcatttatggtctattcccacatgctttgatttaatgcagttttgtcattgctgccctcaaaagactatccactctgcctatgaagcttgatgatcgtgattaatgtctcaaaggaatgtatattttattttaaaaggcaatgcttttcttcctaaaaatatctacctttagtttaccaagaaacaaaaatccaggccataaagagttaaagccagcctaatttactgacttctgcttttgccaataacattgggcaagggtctctatctccctgcaaagagaaacttagcattttattaaccattattaatcttctccacatcccccatgaaacagatcatgaatcccactcccttcttataaaataggaatttgaaacacaaagtgtaaataactggccttctgttacgaaattacttaggattgtcaaccactaagtttctggctaactcaaatggtatttcatggtgccttgtatctgcctggtgggtgctcagtaaatgggggttaaatgaaaaaaataaattgttaatattttctaaaatggactcttttcaatgactaaattgtttaagtatatgaatattatatattacatgatgtttataactcgtttttaaaatgactactttgacatttctcttcagtgttgttaaagtacagtcagaccttcgtatccctgggttccacaactgcagatcagaaatgttcccaaaaaatggatggttctgtctgtagtgaacatttatagagtttttgttcttatctttattccctaaacaatacagtataacacctagttacataacatttacactgtattaagtagtataagtaaacgaggtgatttaaagtatatgggaggatgtacctaggttgtatgcgaatactttgccattttatataagggactcaaggatccatggattttgttatccttggagggtcctggaaccagtccctcatagatactgagggatgactgtactttctagtttcatttaagttattgactgtaagcactgtccaggaaaataacccttattcattcattccatgtcctttagttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggtgatgttttaatttgcatgtttcttatagataaatttcatagtaaaaaatgttcagtgatacccataaatcaggcttatcaacttttctataatttttaatgcttcgaccaggattttttccacccaggactgtgtattttcattgaagtcattttatatccctggcttcagctttgctttgtataacattgatatagatatatctactgataggcttagatattgaaggagataactagaaaggcatagtctaaaattaagttcccattaatacaaaaatgatgatctcttaattccacctaagggttgttggcagcttggggtattcacctctatttcaataaaccacttcatgtttttttctgtctttgggctttaaaatgctagtatatgcttttacttagagtaaatagctacttagatctaacttttagaaagcacttatagaagaattactttgtataaggatattcctttaccagtctcaggtttcttggaatatctataagctttccatctgcccagtgtgttgttttgtctgtcacctcttgggtctcttcctgccgaggatagtatacttccttcctaaaccaatctagtgaatgctttgtgtgccgaatgcctgaggaggcaacctgcaggatatgcatctaacaatgtctgtctaattgtaagagttattattcctcaaggagtaggagggaattcaggggataagaacaagcaaatgctttaattacactctcattctctagcactctttgttagaaagttagctatctttaaaaactgtccatgaggaatgacttctctcaggaaatctaaaatgaatattgcctttggtaaaatttaactaatatcttaggaagccatcggtgaatcttgcttattatcctcttcatttaatatgtgtcttatcattaatcatcagtcattttaaataacagcaattctctaggcctctttgagggggcagttttattacatttaatcagtagtcattgtaatttctttacatttctgtttttttcctctggagaaaatgttaaagttgaagcttttctaaactttggtgatagggaattgttttggtcttcaattggccagcaaatgaattgaatattttaagttgaaaatatcaggaatggtgtgttccatcaaatctaaaacaccataattagtaagaagcatcattattttatataccactaagaaaaataacactaccaattaagttatgacatccattttatagatgttagaatgtacaaaatgtatggccgagaaggtatcaaaaatgggaagtaagcaaattcgtattgccaggtagacaggatgctttggtttgctgtgttcttcagggggttgcttgtttatgagatcataaggttggtttatgtgttatgatttttatttcttgtcaactctttaacataatatatgacctgaaatcgtttccctgtgtcacaacactgaggtctcaattttggggatgcccccagtaacctctgctagaacctgagctatagtggtgagccaggagtgctgtagggtcttgcattttttaaaccagaaaaactgggacttcgaaggcatggccgcacgtttttcccctggtgttatgcccacccccgtggcctcctgtgtttcagcagcagccccgcatatgcttgcagctcccacctccagcacttggctgttctgatgcatacttgagaccacagctggaaaccatgtcaggaaaagaaggtggaagagcttttccctagccagctggctgtggtctgggaagtgctggggagttaatggctgtcaaccaaggaggttttggagttggtggataactgtcccagtcttctttccttcaagaatcattctggaatgcatgctacatggttcttcagagggtttctagcaggagtgagcctcgttgcacacagttgaacaatatgattcattggctcttctgtccctgttttgcttttcccacttgcccacttcctgatgtcacctccctgatagacttcctgcatcctgcgtccaacccttgtctcatgctttatttttaagggaacgcaaactgaaacatagggggtcttaaaaatcacctcatccagctttccgcttaaagacaagactcccctccatatctttgcaagatagctgttcctcatcaacccaaggactttccagcaaaggggaatgtatcacctaataaagtaactcattccaattggtaatattgaaggtgttagaaagttatttattttgaagccacaatttacagtgttctgtgctctgggggtaccagagggaaaaaatctcccttctgcatttcagctcctcaattatccgaagacagcaggttctgccatctcttcctttcctcatccatcatttcccttgattttcttctcctgacctggtttccagctgtggtcttttagggctgaatagtgtgaacctctcttctctcttcgcagtgtgattttttcacagcttatggtccaacttgttcttttagtagatttatatttaaaaaaaaaaaaaaaaaaaaactgggaggccaaagtgggtggatcatgatcatggtcaggagatcgagaccatcctggctaacacggtgaaaccccgtctctactaaaagtacaaaaaaaaattaaccaggcgtggtggcgggcgcctgtagtcccagctactcaggaggctgaggcaggagaatggcatgaacccaggaggcggagcttgcaatgagccgagatcacgccactgcactcgaacctgagggacagagcaagactccaactccaaaaaaataaagaaaaactggcttatattgaaattatggtcagtgttagcttctccatttgctaccgttgagtcacatctcctttgcactgtgctttttcacccatactttcagtttgtaaagtatttgtaagccgtcttcctatcttctaacaaagcactcccttcccagccttctttcactgatacacttgagaaacctgctttctgtgtcttaattaaatttctaataataatgtcaaataagatgtgaaaaggtatataatccagcagtacaacactagagagttcttttgtgggttaacagcactccattaatcacaggtgttcaagcacttgtgagtctgcctgacagaaataatatttaactgataatttcttttgctttttctcaaaaatgtcatgaaagccaggcgtggtggctcaagcctgtaatcccagcatgttgggaggccgaggtgggaggatggctcaaggataggagtttgagatcagcctgggcaacaagtcatcaccctgtctttacaaaatttaaaaattagcccgtcatgctggcacactcctatagtccctagctactcaagaggctgaagagggaggatcacttgagcccaggagttcaaggttattttgagctaagatcacaccgctgcacgccagcctgagcaacagagcgagactctcttgaaaattttaaaaaaaaaaatcatgagaaactgacaaattccttccatttaaacatctgataacttacagcatgagctttatcagaatattgtatgtatatattcacatagattatataatgtctcagctgatctatggtaaagggtaaagccttacctagggatttgggatttttttttggctttagggggtttttttttggtagtttcaggttttttggttttgtttttttgcacagacattttctttgctcttctaaacctaaccttttccactcagacatttcgactctcaggaagtgacttcttttcctccttcctactcctgcctcctcaggcttcatcctgtttccaaaccctctttgatttgttcaaggtgcctgattctctgtgttctatccttgagttcagacgacactcaagcagacagccttactccacggatcagccatttatatatctggtaggcaagagaatactcttctgtcctctgacttaggatttaactcatgatgcttgctattttcttacctacccttcatcctttgtttagagctccaatcattataaacattctcatatcctgttctctgctatttgcacatcccagtcacataggatcactaataatagaagcatttactcaaaaccaaggtggtccccatgcctagaggctgagaatcccaagaacagattatagtacaatgatgatctggttagacttagtcatacaaacacatgacagcttccactgttgagatgctgatagaatcagggctgttgtaagggcccaggaaagctatttgtccccagcttcacgttcctaaagtcttaaaatctagacttttgcgtaaggggtgagggggagttcttgggtgcttttcctttaaaaaaaaattttttttttttaatttaccaaaaacttcaaaagcaaagtgactgggcctctctaaacctctgaagcccttgttattgtctaagcatttcttcattttgttttattctcacgtacaaccccatgttgagaaggaagatgctgcctgggacatggaacctctggggccactgataagggggtctcaagctggaagttggcccactactcaaaatttttggctgtgttcttgaatactatagcttaccccaagaggacttgtggggaacaagaatgagagggtgaactagaaagaaaggtgattaggcattgtccaccccaaaagcaactcctctaacaaaagaaggagcttagagcagtttccatggagaggaggagtggctgtttatcatggctggccctctcattagctcattaccaaaaaacctcaagggaacaactaagaaaaggttttgggattaaaatctgtttaaagaaatatccggaaatagggtttcccataaaaaccttgcccattttttctaaattctgatttttttcctttttttaaccaataatttttggcttattctacatatctggtatttgactctttgtcaaaaaaaaaggaggaaagaaaaaataataggacttgaaagtttctttcttcatgctcatcctccatttgacgcactgtctggaacttagaatttaatcgaagcatctgtttttaagttgatcggtcttattttcttcggggctttttaaaagtatgaaatcatgaggcattttctttattttctttattcatgtggcctgctggccagaatttctttaaccaggtaattaaatgcttctcctcatagtctctctgctctctcccttctgtcctccagccctgatgtgaaaaatcaataacctcattatcagtatctgcagatgggagctgagctctcagtgcaacatctctgctcatgagaatccgtggctggtacttactttccctcgcctcttttctgggctctacattcttagagccttattttcctccaaaatcctttctagccagagaaggtttttctcaactgataaggcaaagtctatgctttccatcttcttggtagttggattaaatgggagaaaaatggggtacaattatatatgtaaaaaaaaaagagggacagaattatgatccacaggggaaaactgaaacgtaagtgaaaaatgacatgagaaactaagagtaagtatatcttgtttacattttctttatttcactataaaatatattagggttttagtcttaaactttattatttttgtctacagtcaataaatgagaaccagattgcagatggcaatttttgtacgatggaaatttttatttgaccatataattaataggattagtaggatgtgatggcagaaaataactttcctagagatgaatatgcctggtaactagcagagcaacaaatgtaatttcaaaatataaacagcacaaaaaaaaaaacaactcaaaatgaattaaagacttaaatgtaagacctgaaaccataaaactcctaggagaaaacaacaggggaaaagctccttgacattgagcttggcaatgattttttggattcgacccaaaaacacaggcaacaaaagcaaacataaacacatgaaactacatcaaactaaaaagtttccttacagcaaaggaaacaatcaactaaaaacacaacaaaaatgtgtgcaaaccatatatctgataaggggttaatatccaaaatatataaggaacttacaattcagtagcagaaaaacaacctgatttcaaaataggcaaaggacctgaagagacatttttccaaagaagacgtacagatggccagtagtgaaaagatgctcaacatcacaaatcatcagggaaatgcagattagaaccacagtgagatatcacctcatacctttttaaatggctattatcaaaaattcaagaggtaatcagtcttagtgaggatgcagaataaagggaacctttgtacactgttggtggcaatgaaaattgatatagccattatggaaaacagtatggaggtttctcaaaaaattaaaaatagagctaccatatgatccagcaatcctaattcttggtgtatatccacagaagatgatgtgtatccacatcagaagatgatgtatatccaccacagaagatggtgtatatccacagaagtagtgtatatcaaaacatcacactgtacaccttccagtatatactatttgtatttgtcatacatcggtaaagctggaaaaaggttaaagaaaaatagaaacaaacaaaagaaagaaagtgggctctgaaagggaaaaagaaaacacaaacagcagccatcttagtggtaaccaacaaagtggaaggcaggttggtttaggttgttacctaaatgttcatcctcacactgcccaacccatctgttttccaaatattcattaaattcagacaactacagaaatgtaggatcatttctctctagagagttgtcagtggagtcatcccatcttcttccatactagactgaaaaaaaaaaaaaacatgtattttaggaatagatcccagccacatgtctctcactgtctttcattttcttcttttagctctgttaccaatatcactgatgagtaccctacaatcaattttcagaaactcagatactctgattatagaagcagctgattttgttccagtacggtttctcaaccagtggtttatgatcccagttgacattagcagtctctccaaactaggggtcagcaaactctttctgttaagggccagacaatatcaggcttgggggacagccagctagtctcttttgcatctacttagctctgtcattgtagtacaaaaacagccacagacaatatttaaacaacatggctgtggtttaataaaagtttatttacaaaaataaacagtggactggatttagcctatagttcatactttgctaaaccctgctccagaccatagggggaattggtaaaaatcagtgaaaaatttttccaaaactaaaggcagaagtgtttcaaattaggtaagatatgtggtccatatgttctatgacttcatttttaatttacatttagtttatggttttaatttttttttacctaaaactctataacaaactttcatttaatttgaatccaatttgtaaaaaataaattttgactgggcacagtggctcatggctgtaatcccaactctttgggaggccgaggcaagcagatcgcttgagcccaggagtttgagacaaccatgggcaacatggcaaaaccctatctctacaaaaaatacaaaaaattagccaggcatggtggcgaatgcctgtggtcccagctacttgggaggctgaggcaggagaatcacctgagcccaagaggtagaagctgcagtgacccatgatggtgccactgtactccgcccaggcaacagagtgaggccctgtctcaaaaaaaaaaaatgttttatctgaacttgacaatctaataataaaaattagtgacaatcagtttactgaaatgtgacttttttttttcctcctctataatttaggccttggaaaaccattgcagagtgaatggaggctattcaggcctaagggatgtttaccttcttcatgagagttatgatgatgtgcagcagagtttcttcctggcagagacattgaagtaggtgaaaattattctaaaaccatgtggctaaggtacctgaacagatctttgtagatgtctttatcatgaacacattcaagtaatatcaagtatgcctgattcagaatatcaggcatggctataattgcaggtatattctcaataactaggttcagtgacttggtactgctaacaccaaagcactgagtagctgctttaccccatgttaatgagtataacccctcagggttttgatatatttgactcttgtccatgtttcttggtaagatgaatgcagacattgatgtggtttttgctgtgtgtttgtggtttcactgcctgcctagtgtcttgggcctcatatacttatgtttctctcaccagatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccccactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtcaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcctcatttgttatatttttctcctttttagtaggcttttgtatatctaaggggt

SEQ ID NO: 12543 - DNA, 37068 bp, Human
accagcccttggcccaatggtctggtttgggttattatacagcataagacactgtactaagcaatctgcttagaagaactaatttaatcttcacactaaatttctgagttagctactattatcaccatctctagtcatggtcaccatgaggtaggggaaagttaaataatgtgcctgtgttcacagctaatgaatggtggagtgaggatctgaaccaggacagcttgacggcaaagttgacatttctaaccaccatgacatgttgcctctctctatatattggagtctttgtccggtaaatcagatccagccagaaatcagggtgtgtgtctgggcgcggtggctcacgcctgtaatcctagcactttggaaggccgaggcgggcggattgcttgagctcaggagttcgagaccagcctgggtaacacggtgaaatcccatctccactaaaacacaaaaaattagccgggcgtgggggcgtgcgcctgtcgtcccagctattcgggaggcgggaggggaggcgaggcaggagaatcgcttgaacctgggaggcggaagttgcagtgagccaagatcgcgccactgcactccagcctgggcgacgaagaaagactccgtctcaaaaaaaaaaaaaaaaaaattcggggtgtgtgaagaactgagtgagtgcccttctgttctgcaaggttctttgagatctaagccagatgccatcatttccttacgctcttgggagaaagcagcaggacttggaagtaacagggatgctgaagcctgacgggtcagttgtccagtaggcatggcacccacactcctgttgtagggcacgtaaatattcaccacaccctggagcaaccaggaatataaaaataaaaaattttaaagagctactactgcttctttaataagacatttctgggtgtttactgtgcggcgggaggtggggaggaattagggtcccgcccctttaaattgccccctcggcagtaagtgctgtggggccccgcaagcactggagattaggtcacccaagaactatgagctgtcgctttaaattgctgggcgtctgccgagccgggccctgggaccggagggggcctgtcacaggtagagggagcaactgagctccctaggtaacaccccccaaccccaagaatgtcgcccgtgagtggggctttgtcacacaccaagtgggggagatgggagcttttcaccacttccagtctccccttaatttatctacttagactcccacctcccaactctcctggggcccggggccgcgaggaggtgccgaggtggcgcgtgttgagagtgtgcgtgcagctcgcacggcctccccggaaaggacctcctggagcacgcggtggcagcagcgccaggcgggcgggcgggcggccggcgtgctccgaggggcaccgtgggagcggaccgatccctttaaaggcctctgggtctcgcctccctactttgcctcgcttcgtcccttcctccctccctcccggcaggcggagggatccgccgctcccagcgccgcagcctagcttgggagggcggtggggtgggggccgacccggcctggcccggccagccctggggaagcgaggggcggggccgcgtcctcgggaccgccccagccccggctccgccccgccacccccacaggtgcctcccattggcccccacgcctgtccgtcacccctttccccccacccctcaagctaggctgagctgtgcctacgtcggcctcgactcccgggggctggaggagttactttggagcccgaaaggaggaaggaagcaaaatatcaacaacagccgaggcggctcaggcgctcggccccggttccccgcttgcctgccgcccgcctgttggcccacgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggtgagtagagaaaaataatgcgcctgccactttaagaggccccctcccccacccggtccaggggttggggtggagggtggtctagaccgtccccctgaggggtgggatggggcagcccccgggccgggaggaactcgcgaagcgggccgtgttttcgtgtggcgttggcggggattacctaggggactgtttgtgtcagggagtctgtcgtgggggacaagtggagtgggctgcaattcccttgggtgttgggagtacggggtggggacgggcggattgggggcgcgcccgcctgttcgtgtagggggtttacgacggcctccgagcggtctgggacggggcgccatcctccgagggggtctccggtgacagtcgggagcgactgacattttaacagccggccctccctccctctccctcctctcgccgcctgttccctcctccttggcccgaaatggtgcagaagggggcctgggagggcggcgggagggtggaggcggggggagccgcagctgtttgggaagcgggggagggaggggggatgttgttcagatgacaccggggtagtgggttggggtgtgtgagtgtgtgtgtctccggggcccgtgtttgccgggtgcctgtggagttgggacgcggagtcgccacgaggtgggcacgcaggacccttccttgagacctcctagccccgcttccgagacccctgatgtggtttgtcagtaaccccaactggagaactccctggccagaagtttgcagctgttcaacatctgggcaagagttctctagtcctttccacctatggcaggcggagctgggctgcgagcgggggtttagggagtttgggggggcttttgggaggatgggccaaggagaccaaaatgcttttagtcccccactccaatgccagcttctctcctaccaggttcgggtcttagggggatggggaaaggggccccctccccctagtgaatcacgctgtcctctcagcagccttccgaggactcctcctgaaaggaaggcactctaggagccaccgaccgggttatcccaggtttgcccttctgaatgggagcctccctctgcctcccattgcttggtgcattgttgatgggttgggggagggtatagcgggttgggggggatcctgtgtccctctttgctgtgcccaacccccatttgagttttcctcagagtcctggtttctttgctttggggtggaggtggcccttatccactcctcctcctatcccttcagtgggtctccgcagcaattcagggtccagcctagactatgggaagtttgccgtctggggcggtgaccttgggctgctctggcctggagataggaggggagcgcaggtcagcctgagattgggtgttttggcgtttgggagctgtccacctcccactcctctcccaaccccaacaggaaggtctcagtagctgaggagagcattgaaaaggcacatgtcagtgttcacagatgtccacccgcttgtggccacggggtcacacccgccccaggacttagtctggctgtcccagctcccacggccctgcctgggaatgaatttccttcctgtggtttcccagtgtgttgggcaggagatgggggtggggtaggactattgtgggagtggctgaggacctctttatacggggtgattgggggacactggagcttatatggagctccttccccacttgccccagcataggcatttggacctttgggtctcagtgattatattctctttgttgtaactcccctgcccccgccaacacaccctgtatgtttgcatatgtgtgtatatgtatgtgtgtgcatgtacatttgtaaagggagaggtctctggtctctctggggggaagggggggaggggggaagggaggaagggaggagcttttactcacccctgtagggacccaaaaggttgagttttttacctgagatcacacagcaaatctgtgtcagagctttcgtctttccactcttttaggcacaacttcatagtagggagggattctgggaagggagacatacagtccgtgttcatggaagccccagtccaagggaagaagcaggacccagagagcctcatgatccttgtgttgggggatgggcatggggaattggctagagcttctgtctgctgtactcaatgcctgaaagattggtggaggacttggaggggtggcaggtgctgtccgtgtccaccccactctgtgcttggtgcccctgggctggagggcctgggcatcctggctctgcccccttggctcctggttcttctcataggctgggagatatgatagtctttctggctgctgttatataatctctctgtagcagggtttttttttttttttttttttttttaatctttcctgggagatgtgatagggaagagaagccagagggagactcttcaggttggggggagctaaaggagcagtagtaaggaagcttggagtgggaggtgccttggcccccgaggaggccttggggataggccctcattgattatggcccagcccctcagacccttctcctctaccgtgccctcagagggtccctctgctgtggtcgtccctggctcttatacccccagagaggcctggacctctccccattttgtcaactttctcttcctgaccagctgggccccctgctctccctggttggcactggatccagaatctcaggacttacgctggcctggtgtgggcccttggttggacactttgccacacacctgagtacctttatggggacaagggaagtccaggagcaagtgggtgggcccaacatttccctagttctatttgagtcaggccccctgcttctttgcccctctagtcgagagagtggtggccttactggaaaagaggagttgagggccttgacttaatacaggccttgacctcttggacacaggtcatcgttggtgttcatcaggttctataagtgggtatgaggatccgatgtgagcctggaacccatcatcaagggtcaggttctgagtctcatggcactgtggtgctgggattctccccatcccacgggaccatggctgggactctcgaggctctctcaggccagctggtttgaggcaactatctcttttttatagagaaggaggaaatggtggcaggccggcacaacctcagcatcactgtaattgctggtggcttttatgagccagtcatggggccggagtccggccaactgtctgtccttctgtcccagtttggtgacttactcatggagggaggggcggttaggtactagaagctgtgttctagaagctggacgtctgactgtattgtggtcgatgtcactctgtctatccatgatcacagcaggtaggatggagcttagacttcaggaagaacttcccagtggggaagctgggggggagagagatggctctaattttgcataggaaaggaggggaactcaaagcactttcttttccagtggctctcccgaaaggaaaggccttgacctttggcttggtggggtcggtgctatttggatctcggaatatttatcttctttttcctctccctgtttatggctgaaagtattctgaggcgtttgtcctggagctgtgggagaaatagccattaggcccctttcccccagtagtgggagctagataagggtctcatgtagacaggcatgcccaatgcagtccacagcatttagtggtacacatgcaggaaagtgtgcaacacatacacactggtatgtagacacccacagagcagctgctgcactgcgggaggtggggggtagtgaatggcaaagatgattaaaggattggagagttgggatggggttgaggggaccggaggcaagaaggcgaagggcatagcaagaactttgaagagagaagggctgactggagcaggagggattaaggttagaccacagatgggcaggcagagccctgtctgcaaaataaagagcatggcttgtgagtcaaggagccttggctgacttccatccctgccccttacccctcccccacgtgcccctctctgtgttcctggcacagcctgcctctgcccctcacactgaccgtgtgtccccgggtccctcctcttgggccccagctttccagatgtacagagtttcgcctttcggtgattaacacctgggtgttttggtggtttgtcgctggtctctgttgccctccccgctcaccctgatgagcaaggccactgtgaggcatcaagactacatctaagccatcaggcatctgggggtagatccttggcctaggtgatccccaaggccctcttcatctgacattttccttttcctgaggctgaggctacaagcctctctttcctgagagccaagttatgcttctggttagtcctggctggtgtggagacaggggaatgcattcattgattctgcacaggaccctgatagccaagggggcgggaggcacttgtgcctgtctgacttcttttctttctgctgtaggctgggaggggagggacatgtccgaagctctggcctgtcgctggccacacccaggtgggaccatatttactcatttaaacttaccctcccaggaggctctgggctctaggcctggtcactgaccttggcttggtgcctctggctggatgctgtggccactctcctaggagctgagcagacgaggaaaccatgcagagggagctttttttttttttttttttttttttttgccccctggtcaaaggagctttaccctcagcattacccctcttgcccaactttccagtatactttgaagaccaaaaaccacaactttttaattttttttgaggtaggatcttgctctgttgtccaggctcgagtgcagtggtgccatcatggctcactgcagcctcccattcaagcgatcctccggcctcagccttccaggtagctgggactccaggtgtgagccatcgtgccccgcccaaaaaccaaaacttttgagatcccaatgaagagaggtgatgggttctcaaaagggaggaaggaaacttccatttcttatgttcctgtgtgccaagctttgtactgagcatgggaatataagaagactgtttctctctaaaactgtttttttgaattgggaaactgagtctcagagatgtaagtgacttttaagctttcctagttatgaagtataaagggcttttgtctgagattaaaggagagatcctgccctgcaggacggggcaatggaaaggaggcccacggagacctgagaggaggaggagaaattgaagggaagagaaaaccaggattcctcagcagagggcagagaatcagcctttggtggcaaggtgaggagggtattgttttgacttgagtgtcatggagaaagcccccaaagcaagggtgtgagggcaggaacaaatgacactccgagacccctcctgctgtccctgtgagctgccgcatgggatgaatgagaagagacactagagtgggaaggcttggaccacaagaggctgggcttgtctcaaggcagacacaaggccaatgtgagcctcccaggcccagacctggggaatgggccctggaaggaatgtgctagaactccccggtggagggagactccctcccactcccatccaggttgtaagcagaagccctgtgcccaacagtcagtctgcctctgccccttatttctggtgaccttgaggaagtccctgcccatctctgtgtgagtttccatacctgtgaaagggaggtggtgctacctgcctcacatgggaagggaaggagtttccgccagaaaaagtgtgatggttgcatcttttctctcagaccttcagccccagcctggcccaggacttgcctgctaaggcagctacccagaagcaggggtgggggcaaggaatgcctttggtgtccagggtagggattgaggaggccttgagggttcctcctggcctagggctccgtttggccctgggatgggttgggaagctgagcccagccctcccctccccatccagccgtctccttgtctcagaacctgcctcctccacacttagccccacgagtcttgccagatccctctggctgcatgcttgcttatccctcgtgattctctcatcctcagcccaccagcaaatacctagggttgagggttgagagaacaaagaatacggggagagcccatccctgagtttcaagtagaaatgcacggcaggcgggtggagtgaggagagtggggcttggtctcttttcctggggtcttcccactccagttggatcaagtaacaagggaatagagcaaggggtttgagggatgacctcaaaccttgagattttccctttaaagcatgtgtgtattgtgcttttggtgagggatgatggttggggtagaccaggaggatgggatgatctgaaagtgggtttctcagactttcctgtcacctctctccttaacctatgggccctttcctccagccaccaccactgcctcctctatgctgagtctccttatgcaggcctctggggcccatgatggctgggtggggacaggtgtcctagcccagctgctccctcttatctcccccacctgtcagcctgggggtggggagctaagaaggaggggagttaggggaactgcttagcccctcacctgttctgaggggtggggccctggttgtaaactgtagcaggggagtcaagagtagacaacaggcaggacttcccctcagaggaaggataactccagatcatagtaatggcaaggaaaacttggtaggcagaggtccttgctggcaaaaatctgaggggtccctgcacggcatcctcatgaaagggtgagaagccaggtattggtaaggagcacggatttggcgacatgtatctgcatagccttgtgcaggtactgctctccccacccccttccttctgggcccccctccatctggctgggcatcttagcctcacctggcacctttcctgaaagcagcaagctaatcctgtaagagctgcctggctggccgcctcagcaggcccacgcagccacaatgcccgccctccctccgctgccaggggcttagaggactgtccttcgagttagaaggagacccagctattgccctgaacggcccctttaaatcctcagtggcttctcgaggtcatgatgtctctaggaggatttgctttccctgattggattggcctctttcgggtcccctgtcatcatcgtaggtgaacccttcatgttttccacctcccctttcctcataattggtgctgtccagtctgagggcccaggccttggactctttcccctctctcttagctctcatgtcccagcaatcagggctcagacccccttcatctgcttcagccagagcagccctgtctcagtgctgtgggtgagaagaaaggatcttgctgctttaaaaaaggggacgaacactgcccaggaagagaatgcccttctgagactgtctgctgcctgcctctctccatttttatctcttcagcctgctcttcctttggccaggggcccacactcctcattaccccatgcacttatttccatgggaagtccctcccctgatctaaccattagcccacccgctgcaatggcaggcagcccagacccagcactggtggcattatgctcattccaacggctctcaagctgacccgcccccaaggccccagctgccactttcacttctgtctcctgagaccccagagggaagttgtgttggggaggtggaaggtgacacactaaccgtcccaaccgcccccacctctcctcagccagggcttctgatagccaagggcccctgtccattgctcttgtttagatgaccaaattgggttaggtaacagtggaagattggctgcggtgggagggatggccgttagatagcaggaaggacttcctaggattggagaccactgctgggcttcattgtttcagaagatatgggagaggtgtagatactctggacaaatgtaggtcagacttaaaggtaggtaggagattggttgtctgcagctcccattggttggcatacaatgctggggcctccatgccctcccacgtgtcaccagcctcgcatgcttggttggagggcttctgacaaagcaagtttgagccccagagactactttgagtccaaggactcagccctgagaagttctttctgtagtcttatatctgtcctacctgctgtcctgggccatttactcccaccctgcactgtggatgcgttttggaaatggagctagaaatggaagtaaaggacagctcacctccctcctgctgctgccgccccaaccttagcactaaagaggggaatgggattcttctcctgtgacgccccaaggcagtgacagagccacacttcaccctgtgaatcttaccaaactcctgtagctgccatgcttgcttattcctcgtgatttcacaccccttccccatctctgcctagacaagagtaggggacccagttggactgagagctctatactgtatcactgggagttactataaatccaagaatgctttctggaggggaaagatgggaacaaaggccagaggtgccaagaactccacttggtgtccgcaagtgcctacggatcctgggtgggggtgacccaggtcctggaatgggaagttgagcctgaaggaataaggtcagagacgctatgcaaatcctcatgcaaatgagtggtggtgagtcattgcagctcggcctgctgggatggagtatgaagacagccttaggcttgggttctagagctggtcccaccagggaccaaacagtgaccttgggctagttgctgctcagtaaccacaagcaggtgggtctgataggcattcccagtgtgtgaggggattgggatgactgagcctctgccacaagggccttgtgtgccccacttggtacttgttctggctgaccagagcctttgtgaacccttggccatctgttggggggttactgtttagaaggcacctgccccttcaccagccccatcctgactgtcttctagcgccctcattgcctttcctccccagcaggaggatgacagacccagccaggccatctcttcagttcctctccgtgacttacacaattctgatctcccttccctttgggcctccccagagagcacaggagccatgtgtttgggccagaagggcatttgggtacctagtccacccagctacccataatactggccagtggggtgaagcctgtagaaggcagtgacttactcaggatcacatcttagaccagagcagggactagaacccaggtatccagaatcccagcttagagaccccatatttccctaagctgttcattgccctacctcacccatcccttctctactgggactcaatctcctgttgcccccaaatacttctgagaacagtctggctagctctaggagcttgttttgtgggggtgcggggtggttacctaggagccagcccagaggccataaggggaaggtcagagctgcagtgggaagtgctggaccctggcggacaggctgctgccttgtagagagccaaatggcctcacagctgctacaggaaggatgagagctagactacaggaagaacaagctggggtgaggaagacatggaggaggctcaggagacagaccctcactggagaggcatctcctgggcagagaacaggatgaccccatcccaggagacttgccagggagaagagggcgggaaggctagggtggggctcgggagagttgtccagcggaagctagggggagggctcagccctgctctccataccgtgtgctccccttggcaagtcggttcctgtcccttaagctgagactgcagggcctgccccccatttgagttcttagggtgcctggggcctgagaccacccctgccctaggcccagctttcctggactgcctgcccccacaaaccaacagcccgcccccaggtcccctgtcggtgagttaaaattagctcagtgcccaggctaaaaatagcccctgcccagccctgaggctgctggactgggggaggggagtccccgagggagggaaagacggtgggaaccagggatttgggtagtgagcctgccagacagaactttgaagggttggggctgggtctctgcctttgagatcagaccctagaagcacttctggggtgaagaaaagaggctgctgtgggagggggcggggacagagagggggcagagggaacggagcatgagaaggagacccgagaggggcccaggagtaggggcgtggggagcaggcctcgcaggaggggttgtgagaattgggctgtgtgtgggatggggagagggacaatgtgaggctcctgccttggctcagacttcggaggggtaatgccccccacttcttttgtgaaggaagagctcactgtgtgaaccacagaatgatcctggaccatcttgcctgggtgtttgggggcatcaccggcttcaccttcctgccctgtctcccagagctccttagcctgtgtctctgtactagggaggaggtcccagggctgaagttggaagagagaatgactaggaaggttgtgaacctgagggtagactgggtaataaggcagggcctggggattcagctgggcagctgtcgtccttggtcctcggtcctcacctctgctgcctctcagggccggcctgcctgctctgggatgctccttctggggctgtgtctgggtccagtccaggcccccaagagcccccttgcctctccctgcccttgccctgggtgggacctgcccctcccttgtctgtctcttggctgcactgcaagttctcagagggcagggatggtgtcctgttgagttattcccccagcgctgggccaggagtcagtcctggaagccgttgttgaacctgtctcttgttctctacctgcttctctctgaatctttgtctctgtggtctcctgcctctccctctcctctagccctctccttatctgtctctgcctctgccccataatgccttctggcctcgctgcctctttttctctgtcatctttcctgtgtctgtgtgtctgtcccccctctgccaccctcttctgtgtctgcctcacccacgcctcctccctcgttagtgagcaggctgcttgaggctgcctgactgtgggggtgacaggtggattggattgtcaccccctcccccagcgcctgctgcttatttcatgccctgcagcccagccacagggaaggggcgggaggagggatgacagctgtctccagcgcctcctgccttcccctccagtcctcagcctgcagcccggagcagcctgggaggaagagatgaagggcctgcctaatgagagctccctttctcaccatgaggaagagcaggttgaggcccactgctctgtgatgcgaggctgctcactcagcttctctgggcatctactcccttttgacctgtgctggtatgggagctctggaagcagatgccctgtagtttctttgagccttgggaccactaggatgggaacagatatgggtggaagggtgtaggggagaaggacaggtaggtactcccctgccaagagcaagaaagagaggatagaggctggctatcggaaaggaattcccctgcagctccatgggaaggacagccctgctcagccctgctgcagctgcaaggaggctaccctgacctctccccttcaccgctctccccactggccccaggccaccttcacacaggaactgagatagcatcattctgaaacccgagaatggtttgaatattgctcaggtacccagaggtgttgcattgggggaggcagggacctgtttcttctcccatgccccctccaaaccagtcctcctttacggtacattttgcacatcatgtgtagctcatttgcatgtaaacacaacccacaagttctaattgggtcggtacctgggattggaaaaatggctatcagtggggtccttcttgattccccctggtcccctcagctctctttgtcaagggtgttgtcagaggggcctcctgccctgcatcctccctgctgtccatttgtgaaggcttctcctcagccacccttctccacagttggtgagtttgtgcctgtttccctctctgggcatctgctcccttttgacctgtgctggtatgggagctttgaaagcagatgccctgtagtttctttgagccttgggaccactaggatgggaacagatatgggtgggcattgccaaatgtcctgcccatctttgcttctcccatgtccaccaggaaggccctgcctctgcctgtcccaaccccctgccacccacaaggttcactccgccccacccttgtcctgtccacggagtcaggtgaatcagagtcaatcagccagagccttgagagcctttgaaggggaacttttggtgacatagatactgtcagcccgaggagtcatagttgtggcctgaggtcaggattgggcaggccctggggccatcagaacaggaaggccatcctggccaaccccctgtctctttggtagcccaagtcctcccaagccctgggctccagatactaggcagggtgaaggagagatggttagaagagaagcagccaagggccggatcatctgcgagggcttcctagaggaggagtagaccagacaggagaagaatggggccaggtgaggctggagaggagagactcacatctggagaacagatgcccaggcctctggctcctgccagttggttaggtaattaggcagagggctaattaaggaggtccaggtgttcattaaaacctccctaattgggtaggagggaagtttagctaggataggcctccaaaccttggatagggtcaggttagggtattttgtgcctgcctaggccccagctaccccttcttccaaaatcagggttgagttcatgttcttgcctcagggctttcaaagaccctgcagcaatgtggaatggatagcagaaggaaaaaaggtcagtatagactgcatctgctttgtagaggggtttgtggttagatgggaggaaggactgcctaagacaggggcatctcctcctctggcagtgttggcacagaagtgggagcagcagtggggaaaggggcctgggaagcatggaattataaaaagtgctttgggctaccttggtagggagtggggatagatggggcctagtctttttaaccctgacttctctctgtcagacgatgctcagtgaatctctgttgcttccctgccttctcagccctgatccctctctcgtcccagctcccccagcatgaggcgggggtggggggggcggtgtaggagatcagccagggagctggttgccaggcgacagttgcctaagcaaccccatcctctccatctccatgtgctcagggctgctccttagaagactttagagtctcaccctctgcaccaaccaacctgagggtggggagggttgaggactgggataccaggggtggttggagggtaggtggtgtccaaatcttcaggggcagttgggagagcaagggttctagctccatagaggatagagtgagaggaactggtactgcagcaagactgttggaggttagactgcaagaaggacttctcacagcaccacaacaatgaaatagtattttcttcttttcaacagacattttctcagctcccttcttataggagatagagtagtgaaaaagacagatgtgattcctgccctcatgaaactttagtctcatagaggagccaggcgttaaatagaagcacagaatcatagttattcacaattgtgataaatgctagaaagactgcaagaatgacttttctgagggtcatgagaacaaagagaggcttctcttccagtttggaggaagaggcagtattggtcatcagctgacagaggttacatctctgcaagaattcggttatgaactaaaggtggtgagagggagatagtaaaggggagagaaggaaggtagatgctgtaagccagaggagctcagcagttcctgcatttaacagtctagattgggttttcaagactaggccagagaatcccatttaaaaagccaactatttgtagccccctccccttgccctctgtgtgccctcccctaccttccctgccaaagcccacaccactgtagctctagaaagcacagtctttggattgcactgggaagcaggggagctgaaatccctgggctggagcctttgcaatgggaacttggcagacactggggtcacaggtgaggaatggggtgtctggagctggtttggggctcaggtgtctgctgggccactcagggctggctgggctggtgttgctcttgtcccagggtaccagtaggaggcccagggcccatggagcacgaggtcgaggtgggtggatcacaaggtcaggagttcgagaccaacctgtccaacatggtgaaatcctgtctgtactgaaaatacaaaagttagccaggtgtggtggcagacacctgtaatcccagctacttgggaggccgaggcaggagaatcgcttgaacccgggaggcagaggttgcggtgagccaagatcacgccactgcactccagcctgggtgacagagtgagactctgtctcacaaaaaaaaagaaaaaaaaagtcaaaaaaattagcttggcatggtggtacacactcatggtcccagctacttggaaggccgaggtaggaggatcacttaagcccaggagtttgaaccagcctaagcaacaaagcaacaccctgtatctaccaaaaaaaaaaaaaagaaattattaataaattacctgggtgtggtggcatacacctgtattctcatctacttgggaggctgaggctggaaggttgaagctgcagtgagctgtgatttgtacactccagcctggacaacagagcaagaccctatcttaaaaaacaacaaccaccaccaaaaaaaaaaaaaaaaaagaagaaggagaagggtagggagtcgtttgaagcgcaatgcatttatctgcattgttttctgtagatatccaggcaaagcagaagctctccagctaggctggggagcagtcttggtaatgggatggggccagtatcccagctcctcccaaattgatagattccttgccttccctctcctccttccctcatgagcaagagaccaaggctgaactttagcatctactgtggtaccgtaggggccatgtagagttgggctggaaaggctccagggaaactcagcagccattggcagtgggagctggggggtaggggtaagagttgttctctgtcatcaaacacctctccccaggtagtgtgcagtgggtgcagaggatcagacagtggctgggggtctacatccctagactctacagtagggtctctgggcatggggctctatggaaggggagctctggaggggagggcgggccttctctggtccaggctcctcccaggacccaaatagagtggctttagaaagcatgggccccagttcactatcctcttccaacatcttccagaaagctccacttttgatgcaaggactcctggaatcagagctagagggggccctgaagtcattccgtgcctccgtcccatcttgggcccttccagtccccaaggactcacccagcctatgtaggcactgcccataccggagagaatgcgccttttctggcccaggctgtgctgccatccttgagccccctcctatcctatggtgcctcctggagttgttcagtgcaggggctgtttctcatcctggctttagcatggagctgttcaactagtgggctgtgagggggttacaggtgtcctgagacagcaggttctctgcctggtgcctgcatccgcctggctgccagtggcctccccagtgtatgtcatttggccctgtattttctctgtctgcttcaagatgtacaaggttgggaagcactactcttagactgagcttgggttctagatgtggtccatacctctagggcaggaatcagcaaactatggcccgtggaccaaatctggcccatgcccatttttgtaaatatagttgtattggatcacagccatgcttacactcattcgtttatgtgttgctgtctgttgctttcatggtacagtgacagagttgagtagttacaacagagactgtatggtctgcaaagcctgaaatattactatctggcccaaaaatttccatctcctggtctagaggaatggtttcattgttttaagcagcacaactctttcctcaaacaaaaatcttaggctgggcatgtccaaaggtagtgagttagctcaattgattgttcacagtcagttacagatcgaactccttgttctactctttcttctcttctcactactgcacttgactaggcttataaaaataaaaagaaaccttaggcttaagctcactgagtaaaacagattagtgtggaggaactctagttgaagggagatgtgggtgctacaaccccaagccccactacaggactccaggccccagagttccatgagtcggtatgaggcccactgctctagacctgctctggtatgttcttgagccaggggcaccagagacatcccatcctggcaccaggtataccatgcttgttgttcactgactgggcagatgtcctctcagcgttgtctcttctccaagcttcagaatgggaaccatagttctaggccagaggagcagctggagcacccaggtgtctatagtacaagcaggttctagagagaagaatgggccatgggatattctctgagacccagaccttggaagccaggaggtccatttactctgtcctggagcctgaggacagcaatgaccgaggggaaagagtctgggccttggtgtgagctccagcttgtgcctggctgtggcataccattgcctcaggcagacagcattgcctcatgttgagggtggagctcagatgctgccagcctctcacaggggcgctgtgagtctggcctgtgtgcccagggagcagggctgggggttttgggggctcagagtcctctcatgaccctccctttccaggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtagggaagtcctagagccgtacgaagtgggtgagggcagggagcaggcctctgcctctactcccttcaggcattccaagagggctttgtggaagaggggaaactataagctattacagaaggggaagggagattgggagaagaggaaccccaacctcttcgcagctcttggagctctgcgtccctggactccaggactcttctgctgccacagctagatgagcccatgttcccatcccagagccatatgcaagccttaggtcatacccccaggcactcctcctttcccaacaggaatcctctccctcttcttctccactgacctcttcatagcctccagcacagaggtgtggagttctgtccacctgaatcctgccccttcagtgagtgggctctgggctgtatctaagctgtgtgttggcctacaggcactagcctggtccttccccaaaccagggactcctgagaccaggggctgtgtcacactgagaatgggggctcctgagggcaggggctatgtccagccatctgtaggctgggactcccaatcaggccttaactgagccagatctggccgcccacccatccttctctgcaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgaggtgggcccatacacacaggcaccaggatatacccccgcctgcatccacatggacacgtgcccacgttgcatgtacacgcagacctgcctatgcacacacactggtatacatgccccttgtagcccctcacctgtgcgcacacacatgcaaaccctccttctgtcatacaaacccagggtctgaggaggaaggaagggcagttcaagtgaacaggccagtgccaggctgccagcccacacccaccctgccctctccaagagtctgctgtcgtccagtgtgatgtaacatctctatcctgccttcttgcatcctgtctttctctttgtctctctttccccgcttctccatcttctggtgtgctcctgcacctgcctcttccttttttaaatctccctctttgtttccatctctcctgctgtctctgtctgtttgtgggcccggtagttctattttctgtttcaaagagagccaacattgtgaactgttgaaggacatgagctttggaattcagttctgacctttaccggccacatggccttgggcaggtgcttaggctttcccgagccttggtgcccacctccacaaaatggggtcagtgcctgctttgaagggtgctgtgtgaattgaatgtccctgcttctcacactgaggtgcgtgcaccttggggatacagaacttgtgctgacgaagagggtgcccgggaagccacaggcctactcagagatttggaggaaagtcccttatttttatgttagagaagacagatttactctagactagaaggtaaaatttgcattcattttaaagacaaagcaagtatctgtaaagctattttgagcatgaagagggcagctttggggtctactgcagatcccccagatgtgcctccactagaatgtagggtggtcacagtagggactcagtcagtgttcatccccctttccttttccacatcccattccccgctctctctgtctccatctctatttctctcttcctcctattctcctaagcagagcccagggactgggagcagagcccccctgcctacctccccctggagaactcagtgccttctggtcagggcttaccacagggtggtcgggcagggactgatccatggcaccagctccttagcccatcccctggaggccccatcccctggaagccccttccctgcctgtcactttggaagtacatgtctccctgccaagtgcacccccaggttaggctcaccttccagccttgttctctgtgttccgacagctcccaccaagcccatcttcagatcttcacacgatgccccaggaggcactgtcagtggggaggggccagggagatgctgggaaccctgaagaaggaggtcggggaagagtagggggcccttagggaggggctggaaggaactccagcgaggcgggcgggaaggactctcacccagctgatggcagtggtgcggttacagaccctgaggaagaagggcttcaacggctgcgacagccccgagcccgacggggaggactcgctggaacagagccccctgctggaggacaagtaccgacgcgccagcgaggagctcgacgggctcttccggcgctatggggtgagccccactcactctgtctctgttggcccccccttccggccccttccccccaggcgctgcacaagaagcacagggaatgtgagagccctgaggtggacgaggtgtttgccctgaccccccagacggaagagaaatataaaaagatagacgaggagtttgataaaatgatgcagagttatagactggccgtgagtagtcgcatggagcagagcctccctgtggtgcatggtgtggcttcgcgccctggctctcggctgccctgatgggtgctccgctctgagccatgctcgggttcttagtgaccactgaggaacctctgaccttggtcatgataaacccgcatccctgctgagactctactgggatggagcataagttggagaggcctggagtgtccccctctccagcaagaagtgtgtagatgacatgagatccttagaggacagcaaagtggagtgtgctctttgtccagatgtttttttggggggagaggcctgcttgggcttgctctgatagcccaaccagagacactcagccttgtgtagggaaagcagaactgctgaaggggaaggcagcgaggtgggggtgagctctctctgcagcaggccagatgggtggagactgcaagtgaaatgatgtccctacccgtggtgcaagcctttaacagccgtgtgtgaatttgagtctgttatcagggcctctaacctgctccccgtgtgtcctgcctggctgaggactaacccacctccactagggggtgtccctggtcctgtctgcagtgagcagagccttgttctcattctgtgggccagaaatggacccagagtatggacccagagtttctccccaaagttcttccttggtgggactggcaggcaggactccacaagggcacagggcagggagcttgaactgctggccctaggatgcgtagcccagaaatgagaagaacccttgcctgccctcccaggaaaagtggactccatggaaggggtcaacctggcctgatcctgcccctccatctttctgtctagtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggtgagtgggctggcaggtgggtaggtgaggtggaaatgagatgtgatggggactttgggattccattttcaacagcaagtatttctcttcacccaccacagcattccgccatttgtatggctcctgagggaagggagtatgactcttcctcctggggtcccctcttcatgttcagtccccaagactcactcttgaagcgggagtgttgtcagctcatcctggttctgtttttcctccaggggccatgctggggggtgacctgaacagtgctaacggagcctgccccagccctgttggtgagtgcagtcatccttctacctggaggtggggaggggtgcccgctcagtggcctcagggggtccaaggatcaggaacgacctagatgagaggagaggaagatcccagggccaggactggatgaagagtcagtcagagatttttaagcccctggattttgttttctgtagcaatgattggtgtagatgatcagcagagatggaggctcagggaattctgggcaaactgtgagaatgggccagcatttctagttggaagggaagacccaagtttttgcagttgagtgtggttgggatctggaggatgagaatgccgggcgttccctagacaaacaacagggacagactcacatagacactcacgcaggcactcaacacacataagtgcattctccctcttacagaagtatccagatgttagatgtgcatttgtgagcacacatacataagccacagaagaggccgggcatggtggctcacgcctgtaaacccagcactttgggaggctgaggtgggcggatcacctgaggtcgggagtttgagaccagcctgacaaacatggagaaaccccatctctactaaaaatacaaaattagccgggtgtggtggctcatgcctgtagtcccagctactcaggaggctgaggcaggagaatggcttaaactcaggaggcagaggttgtggtgaactgagatcatgccattgcactccagcccgggcaacaggagcgaaactccgtctcaaaaaataaaaaaataagccacagaagaaaggctgccccccaacccctggcagcggacagcccctcctaccctgtgccgttgtctggctgggtgactgtgacttcgaatgtcacgattgacgtcaccctgccattcctgccattcccagagtggtccgggaattgggatggaggcaggcacacacttccagggcaacagcatgctcttaggggacagagcaaggaagcatttctgactgtggtcactctcacatccttggacctcagcatcccccagctcagttttggggcactgtataatacctccctggtgataattatgtcacagggtcaggaaattaaaggggtgggtgaatatgtcaccctcttcaaggagaaggccagagaaatgcttgtagacctcaagtgagcagtgatccatagaggcccttgagtccagcatgtggaaagtgggagagagccctcacttggcctccagccagctgtgtggccctgggcaggtcattacacttctcccaagcaggctctagtttcctcttctgtgaacagggctaatgtcctgtctgtcttgcagagttaatgtgaggattaaataagataatacatgtgtgaaaggcctgtgtggattgtagaatatggagcagatataaaagatagttattacatttgttattaccaggctaattatggtggtggctgtgttatgtgtctcccagtgccaataacaccatcaccaacagtgaatggcttgtttctcccaagctgtgggcaacttgtcacatgttgatccaaatcacatcatccacccccagctcacggcaaatggagcagtctgagtggttgttggtttgtcatggtgaccaggcttctcagtgaggcccggattccaggctgccaccccttccacatcctggtcatggtgggtcctgtccggggtagactgtgggacctaaaaatgctggacttcctgtctgtggagactaaagtagagagaagacagggagaggcttgggtacagaagaacctcttggccgtcgcagagcctagaggcaatggctgctttccagttcttcccactgacttcagagtcccatcaccaagccctatcacatgtagcttggagttaggggaacgaacctaaagattcaggagtaaggggtacttgcctcccattattctcaagacatgaagtgttcagggaatatcagatagctcagcccccactcaaagcctaagcatggctttgagaggttccgggtaacaggagtattggtgtggggaagttaatagggctgaaggataggcccatgtttttccttttaccctcttgttgtcacttctccagggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttggtaagtgggtgtctgggccaagggtgggggctggggaatggaagagtagggacaggggaaagagcagacctctagcaggagagatgaaggctagccagcagttaggacttcccaagataaatcttggaaccatggctttttatgagatttttcttcccagagggccttttaagaggttgcagcacaagaagtaccagcctaaggcagtaaaaaggggcaggaggtgagagagaagtggtggggaggatcatagaaaggatttgccactatagcaggagggatggggattagatggtgagcatttcctcactggtggagattgggatggagcatctctggaaatgagtcaggacggtggagagctctgcctttgtaggctgggtagagccaccctactcttatgcagagaggtgactggaacagctgtggggacagaggtgtgggggagggcagcggccagagactgaacatccccttggttttatttctgctctcagactgaggaccatttagatctggtaagtgaggctgtgagctctttgctgtggctttgaattctgggtattgctctgcggtcccccagcatgaagtacgtgtgcgtccttggcctctcgcctgtgcgtgaactgttgctgtttctttgcttagttgccaggagctgtgcttaggtgccaagtgggattcaaaggtgaatggggtgggggtgagaggtcagacgtgtgtgtgtgtgcctgtgtgtacatgaatgtctgcatgtggtattatgttcattcagacacacctttctctgtatgtacgtgtgcgagggggagtgggccagcccagggctcagaggtcccaccctgatgcctggactaggccctggactagggggctggatcccactagtcctctgactccactcaggcccacactgcattcttgggatccaggacaggatccttcttaggagggaggtcagctggaaggagaagctggtgtttcaggggaagccaaggcccaggcccaggctggacttgtccttcttggtggcagcttcccacctcccctgtctccctgtgctccctcctgaacttaagtccatgacacgggcactcagaggcatgcacagctgctcattttcctcctctgtctcacacacttacatactcacccccagccaggagtggggcgggggctcctccctccctaactccctgacgggaggccagagaggctggaaaaggcaggcaggctttggcggccaacacggcggcagtttcggccccagcatggagttggaataaacaagtgactcagcggcagatggagctgacagccccacacacgtgtgtgcatacgcgcaggcacacgccacgccaggccccacattcccctcgcagatgccagcacgcctctgccggggcgtgtgctgcagtgtgatggatggagagtgggctccagagagacaggggatggacgatgtctcccttccctcactctgcactgggaggctgggcgagtgttggtgctggggccacagggccagtacacgtgccttcatctttgcacgtgtgttggtgtcagtgaatctgtgtgtgcatgtttccctccatggatctgagtgtctctgtgaatgcaccaacgtgtgtttgtatatctgtgggggcctccgtgctaaggcaccccgccttggctttgggattcaggaaccccaccttggccttgggatggagggccaacataaagctgcccacctgtcagccacctcctgacggacagttttctcctacagaacaatgcccagcgccttggggtctcccagtctactcattcgctcaccaccccagtggtttctgtggcaacgccgagtttactcagccagggcctccccttctcttccatgcccactgcctacaacacaggtgagtgttcatgtgacatgtgcatgtgtgcacttgggcttggggcaggcaagtgaccagacagaaatgctagttatcccctggacaggccacatctgaggagggctactgatttgggggaacccccacctacttatggttaacaggtttagcaaataaaagcacagaatgcttttaaatttgaatttcagataaaacaagtagttttttagtacagatatgtcccaaagacattcttctgctaatgtatgtcccaaagacatattttatttttgggtttgttttttttttcttttttggaacagggtttcactctgtcacccagactggagtacagtggtgccatcctagctcactacagccttgaactcctgggctcaagtgatcctcctgcctcagcctcctgagtagctgggactacaggcacatgccttcatgcctggctctttttacattttttttgtacagacaaggtctctctgttgcccaggctagtctcaaattcctggtctcaagcagtcctcctgcctcagtctcccaaagtgctgtgttaccgactgtgcccagcaccaaagacatactcatgctaacaaattatgtattgtttcatctgaaattcaaatttaactaggcattggtttttgttgtttttgtttttttgaggtagtctcactcttgtcacctaggttggagtgcagtgttatgaccttggctcactgcaacctcttcttcctgggttcaggtgattctcatgcctcagcctcctgagtagctgggattacaggcatgcgccaccatgcccagctaatttttgtatctttagtagagataggtttttgccatgttgcctgggctggtctcaaactcctgagttcaagtgatccaccaaagtgctgggattacaggcatgagccactgtgcctggccagcattgtttattttttaaaaagtacttaatggaggagggagcccctgtcctcagaaagcctgcagcctgaggacgagacaggacagaggcaggtctgcagatcattcaggctgaccaatctctaggctgcaggtatggggagtggtgagggggacgtggtcagttcagaaaagcttcctggaagagaatgaaggaataagagaaaagagacaaggaggctgaggaggccagagagaaagcacagtcagggtcagtttgctagcttcctgggaaagccaaatgggggctccagggcaaggcggagggggaagaacagcgtctctcctctagttttggcatggtggtggaatgatgattggggaaggaagaagagggaagaaggttagagaggggatctgaaggtaaagagccacttaaggacatgagaaaggtctctggatagaagaattcagataggacacccagtgcgcgggctgtcctgggtccctagggccatcctggcctgtgtcacccacccactcacacctgcgcaggaacagtctgtgatactctcagccatccttgcctgtatgctaagccactgtgtcaagaaggacttgccagtaaggaaacgccttgtccccttgtttcagagcattcatgtggctggggaacctgggctatttccagctagagacctctgccttcctcaggttctctcacatgtgaatggttatgtcaggccagttcctttgatgagtttagtctggaccaaaagactcataaacttctcccccttccccaagcctcccagagttgaaccagccaccagtgcaaataaccacaaaatcccacctcctccccacatgtaaaaatccagaacccaggccaggcgtggtggctcacatctgtaatcccagcactttgggaggctgaggcaggaggatcacgaggtcaagagatcgagaccatcctagccacatggtgaaaccccatctctactaaaaatacaaaaatcaactgggtgtagtggcacgtacctgtagtcccagctgctctggaggcagaggcaggagaatcacttgaatccgggaggcagaggttgccatgagccgagattgcaccactgcacttcagcctggtgacagagcgagactccctctcaaaaaaaaaaaagttcaaacataaaaaggctgggcgcaatggctcacgcctgtaatctcagcactttgggaggccgaggcaggcggatcacgaggtcaggagatcgagaccatcctggctaacacagtgaaaccctgtctctactaaaaatacagaaaattaagcgggatgtagtggcatgtgcctgtaatcccagctactcgggaggctgaggcaggagaatcacttgaacttgggaggcagaggttgcagtgagccaagatcacgccactgcactccagcctgggcaacagtgagactccatctcaaaaaaaaaaaaaattagccgggcgtggtggcacacgcctgtagtcccagctacttgggaggctgaggcaggagaattgcttgaacctgggaggtggaggttgcggtgagccgaggttgcaccactgcactccagcctgggcaacagagcgagacttttgtctcaaaaaaagggaaaaaaaagaaaaatccagaacccagccctctgtgtaggaaagcccctcgtggcaggttaagagagctggagggaccgcctcatgttgagggaccagactctggcttgtgtgtctgtgtgtagttaccacccaggtgtctttgagccccttctcccttgcatgtgcacccatgtgtgtgcccagccccaggctacgatgtcctggcaacttcacagatggctgcttcagaagacacacgctgtgggcccgtctccccatctgtaagaggagtgggtagacaggaggtctatgaggcttttccagccctgccactgggcctctggggcccaaccagaaaaaccagccctgagggtggggtggcctggggacagggacagttggcggagggcagctcagaccactttttagaccacttttctggagctgtttatcaggtactctgtgagggtggttttctgtttttctgccatcttgttgggcccacagtcttttgtgaagcaggaggaaagttagttggtgtcagccaacctgggacaggcactcaggaaggctagacttaaagattctcatctgtcactctggcatgaaagcagtttctgcccctgggccgcccttggagccctgctgggaagtgtgtgagatttctcatctcctctcagagaccacaggctccctttcctcttgttacaggagcagctaagcagatctcagtttaaacagcaggtgttttcaggtgaccctaggtgtgtaaacaaaaccccagtgaacacattgctgtttagttgttcactgtttacagtccttggctgcagttcaagttccggctgggggtaatcgggctatggtaatgcctcatgtgagggcctggccccttgttgacactggccgcagaggcctggctgtggtggctctgggagcagaccagtaggctgccaggtggccttgggccatggtcctccttggggagccaagcctcccagtagtagatagggctggaatctggtggaacagtgcagggctgggagctagtctccatcactcactcactgaggggccttgggcaaggcactgtactgttctgggcttggcttcctagtttgtacaagtgttagaaatagttgattctggccgggcgcggtggctcacacctgtaatcccagcatattgggaggccagggtgggcagatcacgaggtcaggagttcaagaccagcctgaccaacgtggtaaaaccccgtctctactaaaaatacaaaaattagctgggcgtgatggtgtgcgcctataatcccagctactcgggaagctgaggtaggaaaagcgcttgaacctgggaggcagaggttgcggtgagccgagatcacgccagctactcaggaggttgaggcaggagaattgcttgaacctgggaggtggaggctgcaatgagtggagatcgcaccactgcactccagtctgggcaacagagcgagactctgtctcaaaaaagaaaagaaaagaaatagttgatcctagggcccgtttctgcccttgctctgcttttttaataagcatttcaaaactcctgaccaacgttaggagactagagccaagcacagatccccctctagagagatttaaaggtaatagagtcctggggtcctgtcttagctctgccgctggctttctccatgacttggagcctgttcctcaaacttgaggctgcagttgcctcatttgtaaagtaataatagataaatcttttgattattttctatgaaccagatactgttctacatgctttttgtgtattaacttgctcagtcctcacaacagctgtgtgatgtaggtaggattattacctccagtttataggcagagtaagtaacttacccaaggtcacatggcctaagtggaggtagcctggaagtttgacctcatagctcatgcctttaaccttattgctatattgcagagataatactgtcttccctgcataaaaacaaagggctggagcaaatgactccctgagtaatagcatactggtggggtattgggatgattgaggggtgcgttccctatcacagcactcccactaccacagtacagcctcagggaggacattttctttctttctttctttcttttttttttttttgaaacagagtctcgctctgttgcccaggctggagtgcagtggtgcgatctccactcattgcagcctccacctcccaggttcaagcaattctcctgcctcaacctccctagtagctgggattacaggtgcgcgccaccgcctggctaattttttgtatttttaatagagatggggtttcaccatgttggccaggctaatcttgaactagggaggacattttctaaactgtcccaaacaggatacagcatgaaacaatagtgctgtgtaaatcatgaaacattcagtgattctatttattctgtgacagtgcaaccatcagtttcttctttaaggtagacattttatgacgtaatgaacaccccctcatggggagatctgctggaaccttggccagctgtgctcccggcatggtacccttgcagcccctctgccccttgggcatgaggccaagacatagaccttctctacttatctgtttccatctttttatttttttaaattgttatgaaagtgatacctacacatgattttttttttctttttgagacaagatcccacaggctggagtgcagtggcatgatcatagctcactgcagcctcaacctcccaggttcaagcaagtctcctgcctcagccccctgaataactgggactacagtgcaccccaccaccctagctaatttttaagctatttgtagagatggagtctccttatgttgcccagtctggtctcaaactctgggctcaagtggtccttctgccttgacctctcaaagtgctgggattatagacatgagccactcgcccagctgtttgtttttttttttttttaagttcaacactatttttaaaaaccacctcttggtcggatgcggtggctcatgcctgtaatcccagcactttgggaggccgaggtgggcgaatcacttgaggtcaggagtttgagaccagccttgccagcatagcaaaaccccatctctactaaaaatacaaaaattagctgggcgtggtggcatgtgcctgtaatcccagccatttaggaggccgaggcaggagatttgcttgaacgtgggaggcagaggttgtagtgagccaagatcacaccactgcactccagcctgggcaatagagtgagactccatctcaaaaaaacaaaacaaaacaaaaaccacatcttttcatcctgttaaaacacagcacctcatggttattatgacttaggtttctttaactctgagtaccgtcttcactgaatttttgtggtcttcttgaattccttacatctgtcattacacactccctgtcccctcatccccacagtcctcctggaggcagctccctcataggagcctgtgtgctctccccaactccaggttcatcctcacttttcctccatgcagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatgtgagtcctggggagactgcatgtgagtgtgtgggaagggagaattgaacgggaagaggagggacctcttgggagctgggttccctgcagggttctagtggacatcctatgaggctgtgcactgcacagtctgttaggcaacagtggcacccctgggctctcttgtacagacccaagaggctcaccctgaaccccttctgagagccagccccagggtagggggtgggaggtggggggccctgtgttgcagaagatgacatgggatggaaagagaactaatatttcttatttcccttctcttcccttcattcgaccctcttctgatcactctccatccaattgcctctccccaacaccccatcccccatattctcatcctcttgttctctctcactttctgtctggtgtcctatcacttgttctgtcactcaccccctctgtttttatcccttgtaccccatttccattgcctgcctccagcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctgggtactgtagcatcacctctcctgtctgccagtgtctgctacacccagggactgccccgcgtgccccctaacctgttttatttcccacccaagaggccttgtggccggctaccccttccgccagcccttctagggcagcaccaacaccccttcacccctgccaaaggcccatcttctccctccctccagcatcagtccttctgctcgatgacttcttcccctcacagctggccctgccactagaatcctggccctatggggagaggggagtggggggtacagacacaaagagagggccaccccctcacacccccttctccatctcctctcttcacagacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctg

SEQ ID NO: 12544 - DNA, 129380 bp, Human
aatgcaacaatacttactgagttctactaacaccatgttgggcaccagagacatttgatccctaggcaaaggtcagaagaaggaagaacggcttctttcctgaaggagcttacactatggtggagaaggcagaaaagaaatctgggggctgtgaggagctcactgggagccctgaagacaaagtgggggcacggggtgagatgagagggttgtcagccagagaaacagctttcctggacccagcatgggggtggggcgaaaagtcacaacacttatattgaatatttagtaccagttaacttaggtttctatacatgatgcattacttgattaggtaagtgtaaatttacttggttcctgctaaaatacatagtatcctcaagtggaaattaaaacacaagaacaagccacaggtctcccgcatgctgattatatttgctaagtgttttgtgacttggacacacgtgtctgcattatcagctagcttaaattcggtagtcataccaaagaatacgtagtacaatgctgtttaaagaagagatttattttattatttaacttttaaagtctctaatatgccttctaagaagggttctggctcagaaaattgcagaagaaaatcgagtagagaactagaattacagaaacctaagaaatacttttactgagctttcttcacacaagaaaatgcacggaaatgaattatacatggataccaatttgtgatttttaaaaatttgtaattttttaaattaagataaaaattagtttatttttttgaatacttttttgttttgttttacctcaccctttactaagctgttagcttggtctgttgcgcttactgctatatcctcagcatctagtacagttcctgacacatatatgcacttaataagtatttgtcaaatgaatattattgagtaaataagatgaaggtcaattcagaaattcagcactatcaggctatatacataatacagactattataaaaaactagaatggagcagttccttttaacgacggagaaatgtcagtaacatactttgagcacaatatagctaatttcacaactggtctttaaatataacatacctataatcaatttaatgtttttctttgttaccagagttgttcaaaacgtgcgttttacctatcaaagctcaactaaatgaggtttaagaaatctgcacatttgaatgtacttaattttaaaagattctggttttggattaactctggatttcaccctatgggaaattttgtaaatatttccaacttaaaaaaaaactgtgaagccccagcgctaagagtaaacgatgcattggaatttcaacaggatttctgtaactctgaaataatctttagcatttcttcttccccccatcccctcagtgtaggagcattccagtccaagtttctgggagatcgctatcgaatcttatgacactggggtgagaagttttgccgggttgaaatgagggggtcactttaataatctggaattccggagactttatgtcaagtcttaaaaattcgagcctgtggaaggctgcgctgtcaagagaccggagttgcgagcgtctgggtgacgtccgtcctcctggaaggtgggatccgggtggcaggtccctgggcggcgactccggccgggctcatagcgtcgcgcccgccccgctcatcggccctacccagcgtccctcccagaccgacgaccgcctgggaagcctcgagctcccagcccgctgcacagcccggctccgctccacagtcccccactgccaccggccggggcgacaccgggcgagctggcgagacccggctccaggaccgaatcgcgccgacacttgacggcgctccccgcccctccctgccgccgtctccgcccccgtccggtcgcattccggcgcccgccgccgccgccgccaccgccgccgatctgggaggcttgtccctcgccgcccaccgtagccccggcgctcggccggtcgccgtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggtgagtgtggcggccgcagtcggtcgctcgcagaaagcggggcgggtcctggcccgaactcggtcgggcccgagggcctctgcttcccgccaggttgggagggaagcatccagtctctgcaggctggggcgggaggggcgcggtgcatccctgggtcccaggggaccgcgtctgagtctgtccggcgactcctcccggggttgcagctccgcagggttccgctcgagcgtgttgccggctccccttcccttgtagactcccccagctcaccctcaacgttgcgggggctgggagcagagtgcggctgcctcccctgccgctagcttcggaagagtggcctcactgaagtgcctctcatcattactgaacgaaagtggtccctcccctctgccctcattcgagtaaaagagacattcggaaatcgagtgcgtactggctatttccccgcgttctcctcctcctctccttttgcccgctccagagaatgcctgtcatctcttccgtgagaaattgcacttagactatgcagacagatacgttgctttcctgttctgagggccccttactgtcctttagtgctagtattgtgcagattgttgctcacacgtgcacaaaagtaaggattcatttgtctaaaactttgctactgcaggaagctctaaggtggaacttcggtaaccaaagcatttgttgctttttcttccatactctattaacttatttttatgtctttattttttttttaattgagagaacaaactcaccataactgagaatttccctctttttacgtgcctatgtttgtatgttcaaatgtcctcttactccctgtcctttgcatcccagagtaaacttgcaaactgctgccccctgtcccctgtaatgaaaatacctcggcagctcctcttggcatcttatggtcttgctctttagttctaggaataaggcagtaaagtgtcctctttttcctgcttaaagaaaattcacacctgtaactgtagttagaactgaacacaggagccatattcttgcttgtcatcattcagttggcccaaacaaatttgttttatttttataagctgtgaagaaattagttgcctcttttaattctgagatagttctgggtacttctaaggaacaacttctctgaataatggtacagggtgtaatgagaattcctttggttccttttgaatacatctagtatttttagaaattttgtcagaaagtttattataaatttgttaacggatcagttttcgagcaattttgatacctttttctttaaaattaatagtgaacacttaacggttaaaataggccattgtctttatttctattaacccatttaatcttttcaacaactctatgaggtaggtcctgttatactctctttttgacagatgaggaaactgaggcacacaggttaagtatcttgtccagggtttcacagctggtaatgaagaaaggtctggctgcacagcccatgtctttaaccaccatgaagaattcattatccaaatgggcggatcagaaattagaattctgtataaccctactccggaaagaaatggacatgagcattcttaggtaaaagcgagaagggcagagaaatgaaaatgtgctgcaaaaatgactgctgcttcagtggtaaaaaaaaaaaaaaacttgacttttcagtcaggcttctgtctgtgttataataaaaataggtcaggataatgggtttcatccaactgtaagtgaacagcagtgtacggaacaagaagatctgacaaatatttttcttagcaacattgcagttaattttacaatagaaaaatctgtaaaacagattacttgacaaagctgttgttttctcttttttatgtcctcgttgtcaccacctgctcttcaatacatagaactgacctctgacagaattactgtagatctttggtaaaagatgtagggggtctatccagttgttcatttgaacttttttttttaaccattttagaggagctcagtgtacgtgttcaaaatgtgtgaaatgccacctcttttttttttttacaattttcttttttattttattttcaatagtttttggggtacaggtgttttttggttacatggataagttctgtagtggtgatttctaagattttggtgcacctgtcacccaagcaatgtacactgtaccaaatatgtagtctattcctcaccccgctctgagccttcccccgagtctccaaagtccattatatcattcttacgcctttgcatcctcctagcttagctctcacttataagtgaatacgatgtttggttttccattcctgagtgacttcacttagagtaatggcctccagctccatccaagttgctgcagttgccattatttcgttgtttcatggctgagtagtagtccatggtgtatatatgccacattttctttatccactcattggttgatgggcatttaggttggttccatatttttgcagttgtgaattgcgaattgctgctataaacgtgtgtacatgtgtctttttcatatgattagttgttttcctttgggtagatactcagtagtgggattgctggatcaaatggtagttctacttttagtttttaggtttttttagttttttttgagacagaatctttctctgttgcccaggctggagtgcagtggcgtgatctcagctcgctgcaacctctgcctcccgagttcgagcaattctcctgcctcagcctcccgggtagctgggattataggtgcctgccaccaggtccagctcatttttgtatttttagtagagacaaggtttcaccaagttggtcaggctggtcttgaactcctgacctcgtgatccgcccatcttggcctcccaaagtgttgggattacaggcgtgagccactgcgcctggccagttttttaaggaatctccatattgttttccacagtagttgtactagtttacattcccaccagcagtgtataagagttcccttctcaccacatccatgccattgtctatttttttaattattatttttaaattatggccattcttgcaggagtaaggtggtatctcattgtggttttaatttgcatttccctgataattagtgatgttgagcattttttcttatgtttgttgaaaatgtgtgaaatgccaccttttaatacattggaaaccaataatgtgataatttatgctaccaggttaactggttttgccacagactagaataaaactctgtttgccatctttgtcacatactttatgtctgtgtgtcattgattaggaaggttgtgttaatgcacaggccttttgtagaattcaggcctgtacatgttggcctccaaagctgtgcagcaagtgtgccatcgtggcaggtgcagccagcccagcacatctgcctagtgtgtgctttcctcctgacccaagagtgttatgcagtgacccagcaacacaaaacaggcagagaggtcatagtactctattccagttttattgcttgctgtcagttgtggatacttttgtccttatttttgataaagaattcatgataaggatagctgttgttattgttagtgattaaattttgaaataaacattgcttatcatttctttttcaagcttctggggcagttttaggaggatcctgaggtgactaggagagctattaaaactaatttggaacaatttacctttgtgacttattggatctgtacacctaaaacacagaataaattggatattaaggctgatataatgctcttgtttactataacctttcatttaaaatatttatattaaaaatagcctcattgttctcattgtccttatgagtacatgctgcataaatttaacaattaactttttttaaaaaatgaattatttactttatatatttattgtaaattcatttgaaaaactggatttcctactaaaaaactagttgaatgtcgtcactcctaggcaatttgctctgcctctcggcttgaatgtccaccttgagcctgtgtgtttcagtcttgaccttgtatgtcaactgttctccctggcaaagtcagcctcctgtggtgctccagactgttggtgtagcatcagtgatggtcatgcctttacaccactgtaacagtagatgccattggcgggggtggcgttaggcagagaggagtcaccaaacagcagtgatggcagaaacttcatgttttcaactggggacttgtcacttaggaggactttgtagttccctttaattttctgtcattgttagaggccactctgtttccttcatgtatgctctcatggtgtcctgcaaatcttgttctgagctctgctgaaatacggggatataaaggtcttgcctgctcactggatacatttgttgtaataacttcctgttatttaataattcctcattcctcatgactatgattttactcatagcattctattgtctcagccttgtcatttgaccaggtagtatgtatgctgtttgaagactctttaacgttgcctatcagtaggctactggtagtagtttctttaaagagaaaatggaaaacgtgagagaaggagattagctgaagactccgtaggtcttcataagctggcactcccttggcacgataatcaaggcccagacactcactgtgcttggcttctcaggcacagatactcagctttgtctgtacacctggttagtcagtgtattctcttgcttgtagaaagccaaagtataattaagagattgattagtaagcatgatattagcaagggaaatgagttgaatgatcccggtgactcatgttagcagaccagtgaggtgggcttgcatccctagcaggtgcacccctgcttctgaatgagaggcagtgtgatccagacttactcttaggtttttattttctaggcatcacacaggctgcttttttcccttgtgtcacaaactttcctaaattgtttgggttatagtatgtttgttttaatcttcagtctttataacaaaccttgcttttcctgctttaatttgggagtatattttatccttctcactttaagatttctttttttaaacctcagtggtacggtacatttttactaatggtgagtctcagaggatcaccttattgtctccatcccccacccagtattctccccataatctctgtcccaccacccctcgccaagaatcctttagcatagtttctcagaacaatgtggcaaagatgtcagtggttggtgctttcataaaattctttttgaatattgtgttcaaaaaggatcatgatggtatctggcttttctggatttaagtcataaaattaaattttaaaaaatcagaaccacatcagaattctatccagttattaaaaactgtttttaaatagtgtttagtgacatgtgaagatgctcatgatacaactccttttggggtggtacctgagtagctcttcttaagaagattctcaagtatttctgatgtatacatactcaccgctgtgttcagcaagaacaaacagactatgaaacagaatttgcagaagatgggagccaaaatttgaggtagtttttcatctcatacacatatttgtccaccggctgtgtctgccctacttcactgtcttccttctaccttatttgggggaattcctctcttgactcaaactacatggtacatattggagctgccctcttcttacagatgccaggccataggcatgacacttgacccagtccaggccaattaggattctttcctgggatttttcaaattggagctgggagagagaaacgcgcattttactgaagtataggctgagaattcatgagcctagagctagcttcctgaagctcctacagaggacctggtctcagagagtgatgttaatccccagagaaaagcagagaggctgaaagaggtctatggccagttgcctttaaaataaataaataaataaaaataaataaagagatggcagtctctgtatgttacccaggctggattcaaacttctggtctcaaagaattcttttgccttggcctcccaagtaggtggtactacaggtgcgcaccaccacactgtcagccagttgcccttttgtgctagatttgtccctatttttctcctgatttgatgtgagctaatctctatttgtgcttaaactattaatttgagttaaacttcttaaaaccctaatactcagtgtgatcgcattttaaaaagtatgtgcatagaaaaaagatataaaaaatacatactaatttttcctaaaactttttatgatgaacgtgttacacattttattttaaaataaaaagctaatcagagagcctaaattcttaactagctcatttataattttaagtttctttacgttgaattgttactaaaattgaaattgatgagagtccatgtgatataaagagaatattgttgccaaattttaaatgattttatttatttttggtatctgagctggcttatctgagctggctgtagcaagctgcttttaaaaaactatttacttcagcttgggtaatagagtatgtagattagaaacaactccaacagtaacaaaacaaacacaggacttacattagggtggtcttttacattaatagaaatatttaaaatctagaactgtgttctcaacatgtatattgtgtttaaatgctttccccattttaagcggtgtacttgaaatgtctatattttaaaagatacattattccactggcagtgagtatggtaggtgcatttttagacccctgcagatctcacactgtgtaatcgagtgcctttgcctttaaatatttattcactagcaggcaacatgaagttttgtttttgaattacaagaacgttcatgttttgcaatttgcagacctacctcagcagtattggtttcatgggtcatatggatgccacgtgtttataaattagcagggaaagctattaagaatatattaggcagtctatcaaaagcatttcatacatggatttcatttcagacaaaataagccttctgtggagaaaagtagatactaagctttaaagctgatcagatttgatgttttcagtggaagcttttttgtgtgtgagcaggctatttgaagatactgctgaaatgtagaactttctgaatagggcttgttagaggacagctagtttagagttgtcaaattaatagaaattgtcaacctttttagtgtttcagtggggaacttttggacgatagtacatttattttatttaaaatcctaaagtctttttatatgggaacataaaaatgtagatataacttggttttctcacacaatttttggagttagttagttgtatctgttaagtatttagttcttactcagataaggatttaaacatttgctaatacaagttcttacagatggtaggacgcttagtgttcatttcatccaacttcctagccattgcttatagaattacaagagttgagctcttataagatcatttgggctgtgcgtctcgttttagagatgagaaaaatggcctagaggggctgcagctttcccagctgacagcttaggctccagatctgcaagcccttcttcccttaccctcgcatcgccatgtgctcccctggtcaaggtccaaagccaaggtgttctccagccacctgccatacatagcccagcttaagcccatgtgcacagttacttggcaaccgtgaaatgctgtattttctggatgaattggactcaacaggatcaaacgagatgaaagatttgtttttagaaaaaaatgcaaatagaaaatatgaaatcctcttaaaactcatcatccacaacgtttttcccccgtgaaacttttatttcttgctcgcagaataaagaagagccaatgctcagaaattttcagatacgttgttattttcaggcgtcggtctgtacatcaagaagacagtaagattctaacttctggtctgtagtagtggttttgaaactgtgtttatggtcgtgacctacagtaagaaatatattttatgacagtgtgtgtgtgccttataaccaaaagaaaacaattttgaaacagtatttgaccttgcaatatatgatactcaaataattcttattctgttctattaaaaattgttcatcataacctactaaattgattttattacccacaaataggttgtgaccctcagttttaaaagcatagctctacccaaaataaaatggatgctgttatactttgtaccttgtcccttgagactgagtcaggagaacaagtacactatttgtctactaaatgatcaaatggaattttgaagaagctcggcaatacttacttcttgaagacagcattgttacccgaaggcaagagtaagaatgtatctatgcttgtctctcaaggttgttctcttggctgcttatccttaaactacaagaattgtaaagatcagtttaaaatctaggattaattttagagtaaaattgggattggcattatgtgaataatttaggtaatttgttgatctttctctgaaacagtaacctgtgtttaaaatttttcacatagagcagtccttaagaaaagaaaggaactcattttcccctgatatatatacacacatatatgtgtacaccatatatacacacacatacacacacatatatgtgtacacccatctgtatacacacatatgtgtacacccatatatacacacatgtgtacacccatatatacacacatgtgtatgcacacatacacatgtgtacgcacatatacacatgtgtacacatacatatatgtatattatactatacatatatgtacacacacatatatagtgtataatatgcatatatatgcacacatagtgcatattatatataatatacacatatgtatataatatatattatatattataatatacacatatgtatataatatatattatatattataatatacacatatgtatataatatatattatatattataatatacacatatgtatataatatataatatatattatatacacatatataatacaagtgtatataagtatatatgtatatacatatatatgtgtacacatatataagaaatccaaatccaaatactgaaaaatttacaaaaaatatttacaaaaatatttttatcaagttattaattataggtggaatcatgtatgtctcaagctatgtgttataaatgttatcaaataattcaaacaatatatttcacatctatatattctgtatatgcatgatatatatgtcatatgtaatctatgttagggtacagcagtttcactttaggtcttaagcattgcttactttagggtccaccttgacatttcccccgcttccccccagaatagatgagatccttctgttatgtgtcctcagagcccctgcagtttgccaccatttgtaattatatatttgtgtacatatttgtttattatgtttgccttcagtaaactccatgagggctggggcatcgtctgttgttttgcttacttttattgcctaattcctggctcgttgcctaacagcaggttctttgctgacacttgtatgaaggaggcagagcataggttttggtagtagataggctttgaatgttaccttttgattgctagcagtaggattgtggggaagtaatttagcctctctcagtctgtttccgcatttgaaaggcaaaaataataacatcttcctaggttgttattaagattaagtaattcctgttctatagtaagtgctcagtattagctgttttattacatttctctttcttcctctttttgggcttaaggtaaaagaggcaaatcctatagtgattttcttaaaaagccaccaaatatgcattgaggctggatacttttaaaaatagctgcaataatctccattcaagaaacatttcccccccgacgtctgcagaagccatagaaataagaaaaaggtttttttttttttttttttttggatctagcttttccagattctctctcttactttagttgtggtttattctgcatattattcctacaggtgtttggaattctggctggcccttggatcatcataaatcatgctgctaaattaagaactgtaacgctactgattgtgattgtttaggttaataggcacagctgtctttttctgtggaaattctttttagttcatttaacttgtgtctttataacttggattaattttcttttcattttttaaatgttatacactgtaagaggaatagttttcaaattgatctagccactgcctaagaaaaatgaatgaaatcttttcacgtaataaaactagattgatctagctactgcctgagaaaagtgagtgaaatcttctcgcttaataaaagtaacttaatcagttagaaattttcctgattataaaggtaacctgtatctattatggaaaactatgaatcatataaagaagaaaatgaccaattctaattctgccatctaaaaatagttttggctttttttttttttttttttttgagatggagtctcgctctgtcacccaggctggagtgcagtggtgcagtcttgggtcactgcaagctccgcctcctgggttcatgccattctcctgcctcagcctcctgagtagctgggactacaggcgcctgccaccatgcccggctaattttttgtatttttagtggagatggagtttcaccatgttagccatgatggtctcgatcttctgaccttgtgatccacccgcctcagcctcccaaagtgctgggattacaggcgtgagctcccgcacccggccggcatatttcttttctgtgtattttttttatacagtttatttttacaagctgccatatcatgagcattttcctatgacagacaatggcaaactgtattcctctagatgtatatcccataatttaatagtttgaatttgataacatgatataacatatggtttgtgacatatgattccacttacaattagtgacttgatacaaatatttttgtgaatttttcactattttggattgtttctttaggatagcttcctaggtcataagatatttagagttttaaggcttttgagaggtgttgctatgtttctttctagaaaggtattaagttattcataccagtgtgaaagacaaaatgcactggataattttatttacaaaagcatattctcctaaattgtaatgaggtatagatcgcttaagaggaaagggctccttatatattcagaaaataaaacattaataacagcaacaatattctcaacagaatccacggtcatccttgattagttcattcagtcctgtgtaattctttttccacttgatctttagttagcagtctcatgaatttatcttcttcttgattagagttctagaaatcctgagtcagtccactggtatcttctcaaagttgtttaaacattacatcagaagactgtactgcaaggtacctggcatagtccttttccttgggtcccaagacagctcttctttgttgaagacaggcactgtggcctgtagctgattgtaagtgctgtcagggaagcagcaaggtagaacgaaaacctatctgtaaatgacaaaataacttaaagtggctgtggttaacttattactataattttcaaaagtgaaagatccaatgagatttcattataagaataaagcaattaataaggatatttggttgtttctttgttgtacaagacaagattaaagtcattccaaaatttttttaaacaaaatattcatataaacataaggattctattttcaagaaagagtggctattccatttttataaattagatggaatatccactctttcttgaaaatgagttaatctttactgggaaataaaagtatataaatataattactgagaaaaagaagtttagatataacatatgatagttctgatatatgccaacaatataccaagcatatagttaaaatataccaagaatatcagagaaagagattctgtaagtccggaatatgtcctgaacatctatctgtgcttattaatgaaacatcataggtaagtaatgtgaatatccagttgaaaaccactggcctggaagatactagattcaaattaagttgggaccaagtcaacatttaaaaacaaaactgaaattatgacccataatgctgtgttgtctaatatcgaacaaagtagcaccaggactctgataaatagcagtgtatcattgtcagtgagagcactgacaattttctgttaacttctatagcaagcagagtctgaaatatttacaacattttacctatacacatttaacctagagaaggctaagcatttcttctgacttgacaactcatcaataacaacatgacagataaacctaattattttctagcacttctttttttaaaaggtgaaagaacaaatctttgtgattgtttcggggaccaccatctgggaaatctcaaagacagttttaggtgcaaatgatatttatgatttgattttggtaaggtaaaatattaaaagttgccaggagatttgaaaacttcaattaagataggatcgtgggttaccaagaaataatagatgactttatatttaacccaagtgacaataaatattttgaaagtaaacataagtggtaacatgatcgtcaagaaactttcctgaaggagaaacttgttccttaaataatcaaggacataataagttggcagaaaccataggttttcatagtaaaacagagaatcttgctgtttgtgcagataatgtagaaaagtaaagaataacttttacagtctattaagagcaaaccagtaatctgataaacatttgacgttgaaacagagaaaacacgattttagttttgtatcagtataacatttgatactaaaggtctttttaaaaaccttatttaaaaccaccaaacttatccagtcttgaccatgacaaataaaattccctttccatgaaccttctacaactttctgtattcaaaatgaacacattcattaatggactcaagacacaaaagtatataaactttttttttttttttttgagacagggtctcactctgttgtccaggctggggtgcggtggtaccatcatggctcactgcagcctcgacctcctgggctcaagtgatcctcccacctcagcctccccagtagatggaactataggcacatgccaccatgcgtggctagttttttaagttttttgtagaaatggggtttctccacgttgcccaggctggtctcgaactcctgggctcaagcaatctgcctgcctcggtctcgcaaagtgctgggattagaggtgtgagccattgtgcccagctttagacttaaattgtgtttaataatcagtgttttagtactcaggaatggtgtaggtatctaatgaatacccattgattaagtcaatttagtatcagaagttttaaattacctagagaccttggaaattatcttcaagctgatgtgattattgaaataaagtttgtcagataatgattaaatttgtttaaatacaaatttaccttttttagaatcttaagcattaagtagtagtaatgttagcttatttgattaataaacatgtataagtttaggaagaacattacaagtagaataaaaatctgtgcgtatatttaacacactgataagtcagagaagacatagctgtttttttatttttgttttttgagacagagtcttgctctgtcgcccaggttagagtgcagtggtgcaatcttggctcactgcaacctctgcctccgaggttcaagcaattctcctgcctcagcctcccgagtagctgggattacaggtgcccgccaccgtgcctggctaatttttgtatttttaatagaaacggggttttgccatcttggccaggctggtttcgaattcctgacctcatgatccccccaccttggcctcccaaagtgctgggattacaggtttgagccactgtgcccgaccaacatggctgttttattaaaccaacaatataaactagtatcagttactaaaggtttacctaaattgtgtgaatttgaattctgaaactgtttctgagttagtttccatgatccatgtcttcttttttctcacattgaattaaaggtgcaatttccttgacttctgagcattttaggactattcaatttatagaaggacagctggcctttcgtatctgtgggttctgcatctgtggattcaaccaactgcagattgaaaatattcagaaaaaaaattgcttctgtgctgaacacgtacagacttttttattcttgttattattccctaaataattcagtgtaacaatcatatacatagtaattatgttgtattaggtattataactaatctagaaataaagtatatggaaggatgtgcataggttatatgcagatatcgtcattttatatcagacagttgagcatcccagattttgtttttccaagggaggtcctagaatcaatccctcgtagatactgaaggatggctgtacttatctgcgagccagtcagaattgagctctctcctttaagggattttataacctatttgagaatatcatctaaaggtaggaacatatacagaatatacactcacataatgagaggtataggcctttcatagttacaaacagacacagaacacaaagagaaagcctatatattcaattttaaaattttagtcatggatcaagcatacgcaaatgtaacattctccagtcccgagatctgcttcttggtggtcatgaaattcctaactgatttgagctcaaagtagacaaatagaaaaaaataatcaggttctctgtcatctttcctaacagaaaaaatatccctattataacccattaatttgtttatggagattgacaaactgtaaaatcaaaagtaaccagcaacagaaataaagcaaatctcagagtaaaaatcagttccttactgtgctgcagatgagcaaggtccaaagcgcaggaccaggaattgtactcattgttgtgtccccaggtcacagaccagaaacaaggcacaggggaacccagaggtcttgttacttgggtggagtcaacagggatctgaaggcaaggtcttcatcctgcttgagtcctggcatcaaaacaaaggaaaaatacagtggacagttaagtagacgattttattcgggatattgcagtggggaaaaacattcactattgaggaatgtcttgaagaggagggagaaacttagggttttataaaacgtgggaattactgaggaagatagagggagggctaattttacaatatgcaaggacatggtggtcctttgaggttagccatttcttggaacacagaacgtggatttcctatccattgctctcttaaggagcacagggctcagataaagttaaacagttgtgtcaagtgatgggtgtgtaagtgcccaactcattctgtcctttataacatagaatattttcatttgtattaaatagtttgaagtaattaattttaaatacccagacatgatcctgtatagcctctgaaaatctgtaaaggtttttctcctttttaaaaaaattgctttggttcatatttggtgcttctgctctttaataggctttgtttctagtaaggtcatgcttatttaacttatagatattgagcttttagagagtaatgtttcatcaaacataaaaggctgtcaattgtaatatgcaacataaattttatatgtcactaaggaaaaactgcaatgaagcaatgacacagtgctttttttatatcagttgtagggtacggtgaaatatcagagatgttaaaattagggaaaaacgtgtgttttaaaatcagtgaagtatggccttgactcttgcttctaattaaactttttatgtgataaatatggtaaggcatagctattgtcttctataaaattctggtaaacccataaagagtagaaagaaggtagaaaggcagaaagtgggatagagtggaaagtgggatgcagtgatgatatttattatataatatttgatataacttcagtctaccagtaggaacctttgttgggtagcaattgcatactcattttcactgggtgttttctgatatttctcttctaggaagctgtgatcttaatttaaccagtcttttgtcggactcttaggatgtttctgtttcttttactgttatgaatgaggttaaaagcattgtttttagcttaatctttatgtctagtcaagatgttttattagagtaaaatcctggaaatataattactataccaaagtgtgtgtgtgtgtaaatatatgtaaaattataatccattttattctttacagaattttacataccgagttttacgtataatgggagctgtataagcgttgacataatgtggtaatagatgaaacaggagctggcagttgaccaattatgtaggaccttgtagtttcccctctactttgtgtttaaatttttgtatgatatttattgttgtataatttaacaaagacatacttgtgtatattacatgtgtagcttgataaattgttcaaaagcaaatacagcgttataaagtttacctaagtgaagaaataaaatgtgagcagcatcctagaaaatctcttcctacttcttgcacacactaccctttctttcctcattatcctgacatttactgatattttacatctactactttcactcagcatggtgcttgtgaggttcatctatgttgttttggttgatggtggttctttcattcttgctactgtaaaatacttgttactgcaaaatgtgtaacattttgctcaatgggtataatgtttatacccattgtataaatgtatcatggcatattcatttttttaaaccatctgaacctttttttttttttttgagacggaatctcactctgtcaccaggctggagtgcagtggcacgatctcggcttaccacaacctccgccttgcaggttcaagagattctcctgcttcagcatccctagtagctgggactacaggtgcgcgccaccacgcccagctaatttgtgtatttttagtagagacggggtttcacacctgttggccaggatggtctccatctcttgacctcgtcatccacccgcctcggcctcccaaagtgctgggattacaggtgtgagtcaccgtggccgcctgaaccatttttaagggtacagttcagtagcgttgttaagtacatttatttacactattgatgcaaccaatttccagagctctttttatcttgcaaaactgaaactctatacccattaaataacaactccccatctaccccggtaaacactgtgttacagtttcatgaatttaactactctagatatctcatgtaagtggaatcagagcatttgtctttttctgattggcttatttcacttggtgtaattttcttaaggttcatccatgttacggggtgtcagagctttcttcctttttaagactgaataatattccattgtgtgtacatatcacacttcatttatccattcatccattgatgaacattttggttgcttttatcttttggaatatgtgcatttaaaaaaaaatctttgaaaggctcttgagaatatttgtgccaatttccaccaggaatatatgagtttattcttgacattacaataataatttttaagtctttgctagtttgataaattaaaaagctcctgagaacacatggacacagggaggggaacaacacttactggggcctgtcgggggaaggaggtggcggggaagagcactagggaatagagctaatgcatgctgggcttaatacctaggtgatggattgataggtgcagcagaccaccatggcacatgtttacctgtgtaacaaacctgcacgtcctgcacatgtaccctgggacttaaaaaaaataaaaaagaaaaagctcttagttttaaattcttgcattttaaatcgtgaggttgaatgctgttttatgtcactcagctatttacatttctccctattgtgttttaaaaattattcatgtatcctcttgactgtactacttgagagtagtaactattatcataggtattccatttatccccgaagtgcctggtactatatgtaccacatgagatgcccaggatgtttggtaaataaatcagtaactttctttgttgatgtgttagaacctcataaaattgtatgcttatcatattttttggtttgttacaacttttttaaaagtatttcttaaatagttacataataaataatctcaagtaatatttgttagaaattatccaattatccctattttaggctaataaaagtgtttatttttaataaacatttcttggttcaaaactataggtatatgttttgtttctttcaaatgttttttaaaagttcacttaaaaatcatgttattccattaaattttgttttcctacttagtccaagtttattgcacaattgcctactctttatttttgtttaatcggagcagataagcttgactgtgactaaacctaggttgagaatcattactaatcactttgctatatttactatgactaacccctgttaaatactcaaacactaatagtttatttaagaagtttaaagaagaatttatcctgctacatgcagatgtctgatagaacctacttgtaggttgcaattttatgcaatttttgtattcacaactctggaaattttgagttaaggttaattaattgaaggctgtgagattatatttattgtgtatagctttgggtgtgcttttttttgatgtcttttattcctctgagtgttagaagcgtgtgatccttagagcaccgtaaggcagtcactgaagaaagaactgtaccacctctggtgcttttgctttagacacttcattggtgtgtaattcttgaagttcttgtaaggagagtggataaatgaagagaacaacagaaagaagggtgggaaggagttagggactacaaagaaagagaaggtggagagaaaacaaggtgctgtgttacttcaaatgacattcattgtcctaataggcccatgagagggaagtctaatgaagaatttgaaagtaaaatgcttttaaggaaagtttctctggtagagtaaacccaaataactcctttaatgcagaggttcctaaacaggcattgaagttatcaacctccatgcaggtaaattgataaaatgagtatggtgactttttttctataaagttaaattaatttttcaggattctgttttttgggaaacagcggagacagtagattttaggtattttcagtgtctgagtgaaatggtggcagtctcgtattggttgcctttcaacccccctcccttcttcacacacttaattttaggtatgtcttgaacaaaaataaataatttagaaactgtttctttatacttaattatctgaaaaagtaggatgtcagaagtaagtgagggaaaatacttctggaaatgccagaaaccgtcatgaaagttcaacgccagaactgagcttttattttgcaaaagaagcccttagaggtttacttggctctttgaatatctgagtcttgtttaacagagaaccaaaggaggagtatgtgtgtattgaggaacagttactaaaaagggagagcagttagccagactgggtgaatgaaatagtaaagcttaactgtactgactagttaagtcagtagtagctcactgctgcagtccatcctacccatctggtttattcctttcctgacagactcattcatatgttaagtgctggctgtgtatcaggcagtgctagtgctggggcatggggccccagcagtgaatgaaattggtatggtctctgcctagtgactgagtcctttaagaaccttgattaggctcagagagctttttgagttggcaatctccccaccctcagatttagctgaaattagggtggccacgcatttcgagtccacatttgtgaagaggccttaacttgcctccctacaccaatttgccactcagcaatagctaagtgtgaggctgctttaagcttgaaatccaggcccaatagtcctgctgaaccccttgcctctgagaatttagagtcttaattcactgaacatcttcctagttgttgaacattctgtgttctttctcagctccattcctttgtatgggtcggttcctatgcgtcagttgccctttcctctcttttcttttggaatcatttcaagtggtgtttctcttgggaatattcccgtactccccagccagataatctttttattatataaatcataatataaagcatgccctgccttcagagaatttataagctaattggaaaagatgtaaggtaatagaaattataattcatggtctggtgcagaactgtaataaatttacatctataatctacctatatgctatcatataagtggcataacttgttgctttatataattattacaacgaacttataaaatacatatgcattttcagataagggaggtgagcctttaagagacgtattagtgcagaataccgggaatctggtctcaaatccatatttgttactctattttatatgttgtttccttagacatacatgagaaaagacgttgtgaaagatttaaatagtagtttattacagcagtaagagagatcacaggaatgattaattgccaagtaaactacacaggggtgggaggaggtcctttaggctgaggtaggaatgatatctaaatgtattgtgagcatttggcgtgttaataaaaatattataacatcatttaaaaatggtcccatcatatttcattttatgagcataccatagagctggaagttactaccagtttcttcttctagacaacactgcagtgaacctctcggtacataccacaagcttttctggctgctctcaaaagaatttcctgaaagtagaatttgaaaggattttgaacacttttaaaggttttaatatcacaataatttcctctggaaagattgtacaaatgtatataggtcatattagtgcttaccttactgtattctttctagcttccagtgttactaaaaactgtttgctaatttcctaggccagagagagccatcttgttttaatttgggtggcgggacagttttcatgtttcattgctatataaatttgttttgtgaattgtcttttcattttgtttgctcattttcttgttggtattttgcagcttttcttcatgagccttttctaaatttaggacagttatcctcagtttaacttttaatatggcttaggtaaattttttgtacatatatagaagacttaagcattcttatagttaaatctttccctttaagttttctttcatttctttaatgctagaaaccccaacacatgaaattaagggaaataatttcagattcattttctaggaaaataattgatgcagggcaggcaagcccaaaagtgaggtttagcccatgagggttcttggctttgcccaggaaagaattcaggggcacactagaggtagaagaaaacagctttattgaagaggcaacgttacatctctagtggtgttaagctccgtggctgctgctgcagggcagggctgccccgtaggccaagagtagcagctcagggcagttctgcagtcatatttatacctgttttcaattacatgtaaattaaggggcagtttatgcagaaatttctagggaaggggtagtaactgctgggtcattgccgtggaaaggggcagtaactcctgggtgttgtcatgtcagtggtaaactgattggcacactggtgggcgtgtcttatggaaagcagattctgccccatcactgttttagctagtcctcagtttggtctggtgtctgaaccctgcctctggagtccagtcccgccttcattgtaaactctaaaagagcttataatgtaggttttatgtattttgtatatcacatagtaggcactgaataattgactggtggtggaatgaattgtcattaacatgacttttgtaataaccttgctggttcttggcacctcttcctttatgcaaaatgctctcattttttgagaattaatgaactaataaaagacaaaggagcgccctttccttttaggcttcttatgcaagatttctaccccttttgtaccactgggtattatatcttatgtacctggttaaactttcttcctgggaatggtatttgaatgagagttaatgtagaacctgtcataaaatccttatttccccttgttttaatgtaagtaggtttgctttcctttcaaatcctgctagtttgttagtgctttttcaaattaatttttcagaatttgagaaataggtgattattaaaatgagttaatttggtcatgcagagagctgttccatatagtttccaaatttagtgctagtcacaatttcctctagaaataacaagtgagatagtccctttttttatatgaggatgctgaaatcctgtactaaccttaaagcacatatatttgaattctggactaccaaaaaacattgtgtctctaggatatcagaaagtgttctcattggaattggaattcacatggagaggaagagaactataacagtagggctcttgcctttacttatattttagatagctttgttgagatacaattcatatgtcatccacccatttaaagtgtccaaatcaatggttttagtatattcacagatatatgcaaccattaccacagtcaattttcaaacattttaatcaccttgaaaagaaaccctgcaccatgtagccattaccaaccccctgcccggtccccaaccctcccactgctgagtaactgctaatttactttctgtctctgtatattttcctattctgaacattttatataaattggatcatataatatgtgggtttttttgtgactggcttctttcacttagcgtaagattttcaagttttgtcatagtataaattatagtgcattcatttatatggtgtcaacagtattctctttaatgtgtatctttgtccatttgtattgctgtaaacttttgccagggacatggatggagctggaggccattatcctcagcaaactaacacaggaacggaaaaccaaacaccacattttcaatgagagctgaacaatgagaacacatggacacatgggggggaaacagcacacactggggcctgttgatggtggggggagggagagcatcagaaagaacagctcattgatgctggacttactacctaggtgatgggtcgatctgtgcagcaaaccaccatggcacacgtttacctatgtaataaacctgcacatcctgcacacgtatcctggaacttaaaatgaaagttgaagtggccaccatcaccaccaccaccaacagaagaatactcgaggctgggtaatttataaagaaaagaggtttacttagatcacggttcgtcaggctgtacaagaagcatggtgtcaacatctgcttccggtgagggcctcaggaagcttccactcaaggtagaaggagaaggggagccagcgtgtgcagatcatgtggcacggaggaagcaagaggtggtgcggggcggggggaaggtgccaggctcgttttaacaaccagctcctagggtagcgcttgctagcactcatagagagaattcactcattactatgaggctggcaccaagtcattcatcaggggtctgcctccatgacaccagactcctcccattagtacccacctccaacattggggataaaatttcatcatgaggtttgggcgccagatacccaaactatagcagtgggagtactacattttgtttttccactccagcagttgatggacactggattgttttcaccttttggttattataaataatactgctatataaattcatgtataatgatttctccatatctttgtcaacgcgttgtctgacgttttaattataaccatcctagtggatataaagtgctgtctgattatagttttgatttgcatttttccagtggtggtgattatcttttcaggtgctcattgaccatttgtatatcttttttggaagattgtttcactatttttttgtctttttaaaattgaattttaagagttctttgtatattctttatataagtctcttattagatacatgatttgcaaatattttctcccatttttgtgggctgtcttttttactttcttgattgtgtcttttgcataaaagtttctaattttgatgcagttggtttatctgttttgtcttttgttgttcgtgcttttgtatcatatctaagacctcattgacaaatatgagatcctatagctttaccccagttttctcttacacattctggttgttgttacattttgatcttctattcattttgaattaattttcacatatggtgtgaattaagggtccaacttcattccttttcttatagctggttgtcctagcaccgtttgttaaaaagactgtccttttcccattgaatatttttggcaccccagttgaaaatccattgaccctagacatacgagtttatagctggactctctcagttctgttccactgatcccgtgtgtctgtccttatgccattatcacactcttaattacctttgcttagttttgaaattgggaaggtgagtcctccagcattactcttttccaggattgttttggttgcctttatctttaaacgccttgtattcttgcacttggaatagtgcttagcacataatagctttttgtaaatatttattgcatggatggtttaaagtactcaatgcatgcagtttgaatggtgaattaatgtctttaaatagaatttcctagctgtgtctgtttttcagcattttgtaacatatcccagtcccttgttatttctatgttaataaaagttactagtaatgatatatatctcgggagtataatgctttactaaaggtcttgtgtgcactgaaaaaagaattttagaagcgaaaaaagaacaacaaaggccttagtttaaccaacattatattaaattataaggaaatgtttaggttctatacagttaaaattattcttggtagaggagggatacatttgtataattaaatgtaggttttcggaaattgagtgtttcctgtcttaattagtatattagaatttttatttcgatgatcctagctaagtcaaaacaatttggtggcatacttgtttctgttaatgatatttccccctcagtaatagggatgagggtgatagaactactaactgtttttctgacaagcacgtaaggaactgccaagagtgttatttatttggtcttctggtaccatctgtagttgagaagtatgtcactttctatttatttggatattttaaatagtattaggtttgtaaaagcctaagttttagagtttttatatgcctaaaaattaggtccacaaaaaatctttgtgatcttttgtaagttatagaaacaggcccaaagaggttaaattttcacaaaataaatgggttgaatttgactatctgtaagtgttttagcctccaaaatgaggtgatttttgcctttttatgtaaagtaaacataaacatatacatatttttgaacaaaatttcctttctcctttgcttcctaaagacactgctgtgtgatcctattatataatacttagctacatcatgtaatcagtcactttgaaggttgaaggtcaagtactggttttcccaaatgtgtgatgaagctgattgtgcgttatgttattataaccctaaaaatacacagaacagtttttttagattaaaaaatataaatatgctgggttttagtgattacaataaactcttcttacgctatttggaatagacttgagtatagagtgactgtttcagatattagacagcaggctgtacatgatagtaatccctgaggcaagggaaacaaataaggccaggcttttgattaccctggcttttgcctggaaacctattccagactgtgttgcggggaagaataccaggcaaagcagagtgaacttgctgagtggaggaagcagattggagtttgaggaggctgaggcagttggaagttgaggttggagttctggagaggaaggagtgatctagaaaaagagctccagaaaatttatataaggccttcttgagtcgttgatgagtagattgtgtggaatagaaactctgcaaataaggcaaagagctgttgaggagctgtgagctgtgaaaagtttgcagagcccacacagggctgggaggcacttgagtaccagttggttgaagtggaaagtctttgttgcgttggacatttgggacattcagtaaagacttggaaggatcacagcttagtagtgaggttaggctgtttctagaggaaaagcttctatggaattgactttaaccaagcttgaaaacaaatcttaaaaggataaaaaggaatttgagataatttaatagcctacaaaaaaaccctcaaagtttaatcctctttaaaggaagacagtaaaatccaggtaacaacaacagaaaatgtataatatccaacatctaatcaaaatatgtcaataagcaagaaaatatgacctataaccaggagaaaaattagtcaatagtaacaatcctagaagtgtaacagatgatggaagtaccaggagttgctaaaatagtatgattataattaggctcaagtatttaaatgaaaacatgaatattagagaaaaaagatgtaaaaaagatccaaatggaacttctgaaaatgaaaaatacgttacgtgaaatgatagatatgctgggtgggatatcaacagattagacactgcagaaaaacatcagtgaatttagggatatagcagtagaaactatgcaaaatgcaatgcagagagaacaaagactggaaaagtgtaccagaataccagtgacatgtggaatagtgtcaggcggttagcgtgtgtattgagttttaggagaaaagaaagaggagaaccgaaaaaatttttttaagaagtagtggttgtaaatgtttcaaatttgataaatgctgtcaaccatagattcaaaaagttcagtgagtttaaagtagggtcaacacagaagaaaccctgtcactggaagatcactgcttaaatctcttgttcctctatagtttttacctttgttgcctgtcttaaaaatagttttgttcttgtagtggtttttttccttctacttttacatctctggtgttacattttggaaacattcttcctttctctcatttaccacagtttcttccatgtttgcttaacatctctttctttctatttttgagacggagtctctctcgcccaggctggagtgcagtggcgcgagctcagctcactgcaacctccgcctcccagttcaagcaattctcctgcgtcagtctcccgagtagctggaattacaggcgtgtgctaccacacccagctaatttttgtatttttctagtagagacagggtttcaccatgttggcttggccggtcttgaactcctgacctcaagtgatccacccgcattggccttccttagtgttgggattacaggcgtgagctgtggaccacgcccagcctttctttcagaaggcttttttattgtgtttagtcgtaaccttgattatgaaccatttaaggagttttctaattattcttattaactgttactagataaaatgttaatttatgttaaccatttaaaaaaaatttttttaaactcaaatttgtccgaataattaaccatttttgtagggtatatggaggccagtatcactccaaacatgaaacagcagtgtgtcataaaaggtggaaaattattttattcactgcatcttttgacacttatatgattttgtaaaaaagtcagttttgaataaatcctatgtatgtgggtgggtagaggtgtctctgtccctggctagtacaacaggaactttgtagtttgagcattggctttgaattagttatgcatctgacacttatatcctttaggtgttgaatacatgtcactgtgagatatttctaaaagagaaacttgctaaatgtgtgataaatactaggtcaatgcttcttacccttttttgtgtcataaactgcatttgagaacctaatgaaaactatggacttttctttgtttgtttgtttgtttgtttgtttgtttgagacagagtctcgctctgtcacccaggctggactgcagtgtctccctgcccacatgtgtgcacttttctaagtaaagagtcctgggccgggcacagtggctcacgcctgtaatcccagcactttgggaggccgaggtgggcagatcacaaggttaggagattgagaccatcctggccaacatggtgaaactccgtttctactaaaaatacaaatattagctgggcgtggtagtgcgcgcctgtagtcccagcaactcgggaggctgaggcaggagaattacttgaacccggggagtggaggctgtggtgagccgagatcgcaccactgcactccagcctgggtgacagagtgagactctgtctaaaaaaaaaaaaaaaaaacaagaaagagaaaaatgcatgcatgcacataatgaaaatttacattcaagttcagggaattcttagttttcatggttgaaatataaagtaataatggctttgatgccacagctatttttaaaatattccctatgttttgtacatgttgtatttaatgatacactgttagacatttcttttctaaaactatatgtggtatttatattgggaatacacagggcctttaagccccacatttccagtaaattccacattgaccttatgtgttcaaccacaattaccaattacgttctccttagtgaggaaagctttaaagttaaaaataggaggttttattttttcttctaaaattttttagactcatttaaatttttctcagtttacatagcttttaattaagaaagttatagttttcatgagacaaacctgtgtgtatctttgattacatctttgatgttgggtcatgttttattacctcttagatagcaacttgccatttgtaaggtttttataattccaaaaggcattgttcctctcaagtgaacaattcttttccctctgttagctaccaacaggtcacttggtcttgattgctggagtgtagacagaagctgttggggataagacataacgtagtctgttcctgctcctgcctgctgcttctgggactcggattcactccgcctgccccaccctgggttgtcatgggctcctttcactctcagatgagccctgctctctcctgtctcagatcctctgcacatgctgtaccttctgtcttagcagccccccactttctgcctcctttttctgtgcaatttcttcggaacttttatgtgtcagttgaaatgctccttcttcagagaagccttctttgttaccatcttcctagttctccaggttaggtcctatctgctggtgggctttgtcccagcactttgttccctgtaatcttcctccatagcataattcataagtatacttgaaatacacttgtgtatgtaattctgtgctaactctccagttctctgtagattgaaagctccatgagggcaggaacagtaatgtgttttttcctctactcctagcacacctcttgtctggtggggtcattgttgaatgaaataaagacatgactgtgatttcccttgaggtgctaatagtgtaatttgacacacaatgtggtatgaaacagataatgtgtattttcacctgtaagtaaatcaatcaaattattagaataaagacccaagaaaacaaaaaaaaacaaaagtgaataaaagaaaatggtgtacatttaacacatttatatcttctttgtctcatcccttatagaatcctgttttcaatgaaaaagaaaaaagaagagttgttgttaattcaaaattaccgttccctagtttgaaaggctgttttctatttcaacacacgcacaccggcacacacccaggctcatgtgaaaggaacggagactcaagcctgatctgatgaggctgtgttagaagtgctgcacattgaccttcctggaacgcagagtgtaatccctgcatttggtacggaagataaatagctatctgaaggagacgatttcagttagaccttttatttgacatatacagataaataaaccaggcagaatccccactttttctctcatttaacttgtagccaagctaggtctccctggagctgaatttagatgcagtatcttatccagagtaatacctttatttatagctgaggaaatttaggatggttaaaaagcttcaccaaagatgtgagtcctagagcggaccagagaactggctctctgaactgccagtccatactttctcctggtctctctctcatgctatgctctctctccacctggagggactttgtcccacaggagaagtgatccttatcagtgtgagctacaagtgaatggtctgctgaagatgggagggccttgggccttagagttagatcaggactccagttatggcccagacacttgcaagatgagccatccttttccctactctggggcccaggaattatgctagtacctgtaggaatccttgggtacctcgcatgtaacagagcacctcccatcatcaataagaattgacctcctgtgcaaaggatccttccctaaaatggttctataaggttctggtaaagatgaaatgagactgtatgatatcgagcatagtacttaccaagcatggtaagtactccgtgcctaacggtagcaattatactgttacagtgaaaattcttcataacttaatgggtaacaaattacagagctgattgaaaacataaacaagtataaatgttttattcccatttaacataattttattgttttttgaccattgtcttaattttgagtcttcgttcatctgtctttttccagctttatatgaaaaggtagcactggagtttaactagtacagagtttttcaatcttccaccatctgtgtaacaccttataatttttgctgtatccttgtaccacctatcctattattttcctttttttaaaatttattctctttttaggcagtctattttagaaggaaactttatcatgatagtaaacatggaaaacctaaataattttgccataaatagaaaataattgtaacaataaatgactgtaagcacattatacatgtgcctccagaagtcttttaaataccacattatgaaaaacattgcatgtggtcttccatcatgctaacctaaagccgttaatcagtatgtttaggttatgcttcttcactcagcctcctggaggaggaatgctaacttctccatgaggatggaagagcagaatttgccgttaaaataggaagaaaagacatgatttatggcagttgatcagactctgtttatggcactggtgcatggatcagatgctgctatgatgattgttacaataaatatttccaagccctgtttcagactctctggtcagaatttcttgtggaagatactgaaatctgtatttttaacaggaaggtcaaaaattctgatgcacataccagttttggcagtcactgttttaaatggcattttttcagcctatcattttgaagttgtttacaaccacaattaccagtgtatctgtaaagaattgcttaattttataattttacatttttaagtttagttttggctcttagtcttttatacctgtacagtaacatcacaattattaagcagtcatgaaactattcaatgtaatataattaagtcttaaataaacttttaattttggaatagcttaatttaaattttctctcttttatttttttaagagacagagtctcactcagttgcccagactggagtacagtggtatgatcatggctcactgcagcctcgaaattttgggttcaagcgattctcttgcttcaccctcctgagtagccgggactacaggtgtgcagcaccaaacctggctaattcttttgtttttttgcagagatttgtgtctcacgatattgcccgggctggtgtcaaactgctggcttccagtgatcctcccgcctctgcctcctagagtgttgggattatagatgcgagccgccacacccagcccctagagtagttttagatttagagacagttgcaaagatagtacatagaattcccctataccctatgctcagtttccccttttattaaattttatataacttcatatatttgtcacgactaatgaaccaatattgacactttgttgttaactaaactcagaactttattcagatttcatttgttttccccacatgttctttttctgttcccagatcccatccagggaccacattagttgtgtctccttagcctcgttggctgttaacagtttctcacactttgtttttgatgactttgacagttttgagaagtaatgattaggtattctgtagaaagtcccgcaacttgggtttgtcaggtgtttttgtcttagtttgaggttacgggtttttaggaggaataccacagagattaagtgaccttgtcatcatatcatatcaggggcacgtgctgtcaacatggcttaccactgatatgttaagcttgatcgcctgtttgttgtcaggttaccccattgcaatgttacttttttttccacctttctgtcaccaaagtgtagcccacgcttaaggggtggagagttcaactccacctccttgagaggaaagtatgtaaattatttggatttttattttctgtacaggagatacgtatgtatgtatgtatgtacctgcctgtctgtcagactgtctgcctatctgtccatccatccatccacccacccacccagccatccatccatccatccacccatccatccatccacccacccacccagtagttatcaatatgggctcatggttgtaatccagtgttacctcatttgttttgttgctcagagtgtcccaccttcggccaaatgggagttctttgagttggctcctgtgtctctgtaacatacctggcagttctgtttttgaatattcctcacttgctggtgatgcaggatgctcagctcaggcttatactgcaacttccttgccctagtcccacaatcagccatttctccaaaattctcttattggagagtggtattgggaaccaagatctagtccctggatgaacgagctctttctgtgccgtcaaagcaaaggtgagagatttttgtgcccaggttgtcctgatttgccttccctactctagtgtccgttttccgtcaccaaatactttgggagaatatgtcatatgctcatatttccttgttttatcctcccagcagttggaactaatgttttgaatgtgtgatgtgtgtcataggccatatttacagttaactaattttgtaatccaaattttaagaaaaagtaacttcagctaaggagatccaggcagctcatctgtcccctacagagatggttcttcagttgcttgatttctaagaatgccaatgatatagaatgttttttccacaagtaaatttaatttagaataaggagattttaaaaaatgttcttatttgcgagaagagtgggtagaagatcgtaattcattcttgagtgaattaacctttaattaaagttttaaacgtttttcttgtttctctgtaaactcttttatgttttgtctttggcataagcccctttgtttgtttttcctcccagctttgacagttttttatcttccaaattttcctgtcttagacctatggttctctttagttaagcctaaaacaactgtttgaatgaatcatgatgtttattttttgttgctttcccttgaatagtttttggttggcatttcatggtagaatgtacccacagtgacactgacatgtaataatttttttcttgtgtttcagggacatgctcccacctgtgctccctgctgcactgctgtgtggtcaggcccaatctaagaaggaaggctttgcttttttttttgagatggagtcttgctctgtggcccaggctggagtgcagtggcgcgatctcggctcactgcaagctctgcctcctgggttcatgccattctcctgcctcagcctcccgagtagctgggactacaggtgcccgccaccacgcgcagctaatttttttttttgtatgtttagtaaagacggggtttcaccatgttagccaggatggtcttgatctcctgacctcgtgatctgccctccttggcctcccaaagtgctgggattacaggcatgagccaccgtgcccggtcagaaggaaggcttttcttacagttttgattttcttctcactatcctatacacatatgatctggtatttatcctcaagactttggatgaagatatatatagacacactcacacaattgttggaggtagtagatttggtaaaaaataaagcacccctgcaatatgtcttattctttgtcttctgtttttaagtactcaagtatttgcaacaaaattgcaaaaataacagaaataattatgtttgtctttttatgtgtaatgggactcatttatattggaatgcccaaagggttctctctccttttttttttttttttttttttttgtagttctcattggaaagtctggttaaccagaattgaattaattagtatgaagtctttaaagtgttttgttgtgttgtatttatatagttttatgagagtttattttctgaaagccttcatctgaattataaacagcttataattatttttatttctaatgatgagtaaaagtttatccatgtgggctaattcgtctctttatatatatttgttttctatctttatgcattcttttttgttttatttagttcaggaccgataaaatatgctatataaatctatgagtgaaacagaagactttataccagaagacataaatcaggcaggcctcatccacttacctacttttccaagacctggtcctattcatttcttatataaaacttaccaactgatgttcacagcatcatgaatgcggatagctaatagtctactctagaatacagaatgtgatacaggcagtgatttttctgtccccaccaattgaactatatacttaacaagagtttctggtttgttcctaaatctatttagatctttactttttaattgtgattgtgtaactcagtagactattatacaaatctatgaaatgtgagtgtgaaagagaattgtagcttctacataaattaacttggaatgctttgcaaagtgtcagtataggtgagtaacattaaaaaaaaattgccttcaaattaggtgtaagagagaactgtgaaagcttaggaagaaaaatcatgaacatccagaaaaatcgctctacaaaagtctttaaattcttgttctattttagagaaatagagtggagattgtagatgatgcattgtgcaacatctgataagccagagagttgactcggaacttccatcagtggacccgcactaaaagacaaggctgtagccctcattaaagtagtggttgattaaaacccactcatgggtttaaagcaaaaataaaatgtaaggtttgtatgtgtggcagttacatattacagtttaacaaaccataccaatgtttaacagcttaaaataaaaaccatttattagctgtcatggtattgagtggtttttctgctacttacggtgttggctgcagagcagggacaaatggagatccaaaatagcctcactcatagggttagcaagttaagttggtgctggctgtcagctgggagctccccaagtttgggctagctagcttctccttcatgcacttctccacctaagttgggctccttacctggtggctagctttcccagcagtacacaggtggccttcttaaggtttaggcccgggactggtccagtgtcatttttgctacattgcttgggttaaagcagtcacaaagtcattccacattcaagcgtagatatgcaggtttgtgaccatgaggaggccggtttcatcagggacccccaaagtaacagctgccacagtatattttttttgtctgcatgtttcattgttaatgtttttgtatgtatgtttaattaactgtccaagcacaagttccagtggcattggataagacttctaaattaaagtgtttacaagaaaacaataatttgattaaaacttgtattcttactagtaagtgtgggggcgtagggatttcattattggcaaaaatcaacaatccttcattcttgtagcctttaaaaaatatattttaaaaatagtgaaatgttattgtattttaaaaggatttggataatgattaaatccaaagtatagaagataaacttacttgatttgtttattcaatcagcaagtagttttgaacacataatctgcaccagccactgttctagacaccggagaagcagtggtaaggatgacaggctcctgctcttcagtaattgttggggagatagcttcttattcatttccataggaaatctttttttttttaaatctacatttgttttaaaaagatgaattttcattaaaaaacaagtctaaatgtctatcttgaaaaataagcaagattagttaggtttgtaaagaccctatgctctgaaacagtgcaaaagttagatagtacatgttggataagctcgaggtttgaccgttcacctggaggtgagctgataaatgttcagctgtagattgatgataaagataactaacattgataaattgactcgtgtaatatggataacttattaataaattggctcttgtagtatgaaccaaacatacaacctcaaactgagcttagctccctttgattaatacttcaggccaagcaagctatacacattgtttaaagaaaaaggaaacctagaaaatctatcccttctgcctatgtccctcctctctttcccccaatagcagaaatctccctaatacttattacctaatagagaataggtggaggtggatgagagaacttcatacagatgaatattatacttcacaagtggttaaaatatccatttatttcgaaggatgtcgctaaatgaagtgttttgggtttttttggcgggggtggtgttggggggcaggggtggcttttgcagaaccacagatgttttcagactcatctaatccgacttcatcattttacagatagctatttcaggcaccattgtggtttacctaatatgtcagagcagaactatttaaccctaagtaacttgaatttttgttttgttttcttttcacacatttttcctctaaaacctacaccaaactcccttgggttgagttcaagacatactttgcctagaccagactgtagtgtaataatagtactttagcagggttttatggtaaaagagtgaaatgttttacgtgactgtcagaagtttagtaccagaaagacatttcacatttgcatgttattaaacacaagtaagacaaatgtttcagggcagctgatgtagaccttgtactactttgctcatcccaaatcattggtatacatgtaaacattctgaactggtcggctgaccacattagctcatctcacatgaacgattacaaaatgaggttttggatgcttacggttagttaattgaaatgatgcaagttcttttgaacttaccactagtatttttctggattttgtgtataagtgttttgtttgtttgtttgtttgttttaaagaaaaaagaataaaactttgcttgatttctttccctcctattaatatgttacttctaagctaaggccctcaaactaagttttctctggctgcttttaatattcttctcttcgtcattggttttcagcaatttggttatgatgtacataacaacagactgggagttttctttatagttctttagctcagagtttgttggatctgcgagcttatggttttctccagatttgaaaaattttcagcccttcttcagagatttgtttctgtgcctcccttctctagttttggactccagtaacacatggttaaactgcttgatactgtcacacagggcactggtaccctgtttttttatttctcccaatctttttctctctgattcattttcaatagtttctgttgctgtgtcttcaagttcactgatgtttttctgctgtgtctggtctgctgttaaacccatatttcagatatattttttatcattataatgtctacttgagtcatttctggtctgtttctttgggtttttctcctggtttggatcatatatttttttctttggtatttttgtttgtttgtttgtttgtttgattgagacagggtcttgctttgtcacccaggctggagtgcagtggtgccagctcaagtgatcctctcgcctccgtctccttgagtagctgggaccacaggtgcatgccaccacacctggttaattttttgtattttttgtagagatggggttttgccatgttgtccaggctggtctcaaactcctgagcacaagcaatttgcccacctcagcctccccaggtgctgggattacagacatgagccattgcacttggctggtaattttttgataggatggaaaacgttgtgaatgttatttattaggtgctagactctttttaaaagaaagtttctttaaatactgttggattttgttctgacatgtaggtgttactaagttgcttggatggaatgtaaaccagtatcttttccaacaagtgagaataccatgttgactgcattaagtaaatcctaagaaaatattaaattcattttaattacgaattataagtatagtggctggtagtaccatatgacattttcctaactcgttttctgtgatgcttaatgggtaaggaaggataaaatatactgtgttttgtcttattttaatattttgtttatgacagtattcatcttcgtttcagtgtgatttttaaatgtttactgctagaataattagataatttagaaatactttgaagtcagtagttgttcattgtgtctatgtgaatgtataaggataagacagatgacttttggttttgtaataaatgcagatcggaaaacaagggactgttagcttctatagaattattacaaggatttattcttgtacttttatttgacagtacagccacattaatttttccatgtgtagagaaataatttgtctacagttggaggttagcacaacacaaatattcttctgggtccccaatgtaaagtcttcataaaagttagcctttttattatatgtactttcttagaccctctttatctgctaaagcacaggactcaattcccatggcatgtagatcccacaaaggtacttctttatttatttttaaaaaatcagctgtgcttgtctttttagatcgtgacgctcctcaggtcggggggcttgatatttggatcactgaggtttgatattatcagtccctcctcacaacaattctcctccactttcactctgcattgcattaattcatcatccacacagtactgctagatactagcaaaacagaccattttatatttttcgtagccctttatttccattactttaattttaaaaacacctttacaactgaatttcctgaaatggttagaatgtagacctttaaaattccagattattagtcttaatagtcttagaaagattcaataatggatgcttcacccaccaggacggctgagacatggccttagcttctgagttcacattcctcctcaccacaaaggatgtgttttgaaagagattttgtttgctatttcgtatctgacttcatttttctaattatcctgttattcactgctgtctggctttgatgtatttaactgactaaacatttatgctatagtttcctggcagttaccattcttatgtgttaagtgcattattatgaaaagcactgaatgagagccctatgctggacagtcctggagattcaaaagtaataaaatatagtcttttcttagtgtttcctttaagtatattaagtgtggaaattaaatgaaaacagaaaccttataatattgagttcgaaagaattcagcagatgtttcagatgttaaaagtgcttccaggcctacaccatgctcaactcctaggtgagcttctctcttaaggtgaagcagatagatgagcaagaactcaggttccctcactgagcacagtgacctcccaaggcctgtgatatgagtggtatcaagcatttagtgaacacttactatattctgactcttttgttaagtgtacattattgggtttaatcctcataggaataagtatttataagtctaagtatttattatccttattttgtaaatgtacacagagagaaaatttgtccaaggtccacccagctaataggcagtacagctaggatttaaacgtgggtctactacaccaccaagcctatgctgcttttcattccaaacagtgttattaaccactgcaacacatggaaaataaataaatgattttggtgcttatagccatgttctttaatcagtcaaatcaactattacacagtgagtatagaagaagtgggtgtaagaaatttcaagttaatctgtaagattacactttattgtgtgatgttatgagacttaaataatgtagtttaaggaaataggtgcatttaaaacgtatttctaaatttgcacatggtttgaagttagctttcagggcatttaactcgcatgtcttgtgtgtacacatatgtttaggagcacatgtgtactctcataaagtatttagagtggtctttaaaatgcagttattaaaaaatcagtttttgacctattagggatcttttgtagatttcagtactgtaaatttttataattctgcaatatttttatttttcaaaaggtaatttattttctgcagttttgtcaatctaattcaataataatgggatcatacattgtagagtagcttttctgtttcccttatgactttgaaatagctttgattttatatcaagatatgaattgccaggaagaaatggattatatactggatataatttggagttatgtttataaaatataaagcatatttatataaatataaagcatattttataaatgttcagaaagaggtagactgtgatggtacatatttggaaagaatttcatgattgattccttctgtttcactttttaagaattgtatttgctctcaatttgtatcattaaattttattttgttagctttgagaaattgaactttgtcaaaatagtgatattatttgagaagttggccagggatagagaattggcaggcagtgtttttagagaacaaattaatgagaaattgcattttgaaggtgaaaagaaacaattttgtttttcctcttttacatcatccttctcccctgcaccttgcttgagttctgcactgtggtttttttcttcccaattttttattgtgttaaaatacacataagataaaatttaatgttttaatcattttcaagtggttcagtggtattaaatacatacataatgtctgcactgtaatttttatcagacaacttaggaaatggacctgccatactttcttggtacttcgtgctttgctgtgtggatcatagcaaagtgctcctatacattctgttttctgtgtgtttcaaagacagaaagaggcgaggcactgaagttcagagcaggactgaacttgcccactcatcaattaagctgtcagcagctagcacataagtacatttttagttctgtctgatttgtatcttctagtccttcgctggtttttccttaaggcgtaagtttttagttctatatttcatttgtgttagaaagagctctataaacaagagaaacagaaagcataacagctctacccatgtggtactccttgttcatggtaggagaagcggcagtcacaattattactctcttcaagcaaaagaaaagttctccttttgagttttcacaggtaaaaatgaggaggagcacagtgctgaagagatttttctgtacaaaagttttacaaagaattatttaaaaaattataagtaaatttgaattcacttaactgtgttgctgaatattttccctgcacactgtctttcataggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaaggtgagtcttgtacttgaaaagaggtgtacatgagagggtatggcacttgattgattctttcaacaataaagttagcaatttcttttatttttaatttgattttaatgctcctgtaaagttcaattttttttttgaattattaccattagtattaataaaattgacacatagttttccagagatagaaacgtttgtcctgagtaatggttaaagccagcaatgcacgggcatttgaagaagtgaaagagggcaaatgtttcccagtgtactaatacaagatggcaactggttacatgggatagatggccttctattctttcagtctcttaggctgaagtttctagatttcctctgcccagaagtggtgtattggggatttgaggagagacagagccaggctgtcttcccctggattccctctgctctctgctggtgccccggggtgctatctttagtgtgtagggctctctttttcatactaagcacagtgaccccacacctaacaaccatgacagaacctgctttctacttttctctttatttaggatcgtaaagtccacatattgctctattagacacggagagtttcgtgctttttctttccccccaacctccttttagtgggacgtaactgttctttttttgtggtagatgaattgaacgatactgcgctgcagcctccttgtaccctacgtgatggcctggaatcttgtggttttagaatttacctgttaatctcagcaaaccacttgtcctaaaacaaatgccatatattcctggaatttattcagctattactgcatgagatgcggattttagtcttcatcttgtctgagaaatttcttcctgttgacctcacactcatttctacctctccctttctgtagtctgtgttcattcttcctctttgttctgcttcctctttctgtagatttcttccatatattgagctttgatggctgttagtggcatcttcactttgcattcccatcagagcccttcctcaagagagcaggagggcaagagaagtgggttttgttgtgttgatttgcttgagtgagatgctatacaagggaagttcccaagcaggaaagagtctttcccacaaatgatttttccacataagatacttcttataaaatttgatttgctgtaattttttaacctgtggcctgtacttaccccttcggaaatttcccactgcaatttgtcatcttgaaaatcatttattgtacattttctcaaagaaatttctcaaatgactatagaagtttcttatctatggtaggaatcagtgaagtagcatctactgaatcaacattagttaataaatatttgcttcgtgttagtaaagtaagaagatgccggtagtacacttgctttttcttgttgattcatactattttagaacatgagttgagaacacaatttccccattttatagattgagaaactgaggcccagggcttcagagcaaatctttttaagtccagaaggcttgagatagtgtcaggactatttgtaccactagttctcctggtactctatttggactttttcctagtacaagcaacagtgtttacgcttatccgaaggcaatatttgagttgactttatggtctttcactaatcagtgagacagccagtcactagatgtttgttgaggttctgttgtcctgctggtctgtgcgagagatagagggaaaggaaaggattggcccttttcttccacaatttttaaaattgtttattttatgaaattatagaattttagagccagaaggagcctcagagatcatttgctcaagttcttgccgtttttcagatgaagaagctaatgctcacagaccctttgatttatagctatctgatagcagacccaggacaccaaaatccttaataagttattatttttcttattgcaaaagattatgtgtttgttgcaggaaattcagaaaatacagacaaaagaataaaaatcacccattaaacctaatacacaaaagtagcttcttttaccatttgtaaaagcctgactacagactctctagctttttgctatatatgtttatgctgtactatctttactattttataatggcttcttaaatttaatgttttatgaactttttttgtcacagaatagcctgtacttttaatttaaatggctgctatatcatttgtagcagcatcttcacagttatcattagcaattactgggtgcttactatcggttaatcactgtgcttaacacctcaaaagaattatcttttgaataatgtaataacccagtgaggtgttggtcttatataatacaaattttgagtatccctaatctacatgctccagagtctgaggccttttgaatacagacatgatgctccaaggaaatgctaattggagcattttgaacctcagatttttggatttgtggtgcttactcagaaagtataatgcaaatattccaaaatccaaaacacttctggtcccaagcatttcagataaaggactttaaacctgtacttattttacagctgaggaaactggctcagagaagttttacggctttcaattttaaatgtctcagtcacatgtatattagaaagtggcttcacatgtatgccagctggtgaactatttcttgcggacattcttgtttatgaataccaagacaaggtggaaatgggacgccagtggtagacaagtgggccattttaatgtcttagtcttggttgtggtggttaatagtctttgagaatttatttgttctcagactattgcagcacagcatggtggacaaaagcagaatcttggttgcttgatcacccggactccagtcctggttccgctatcttctgcgtatgcagcctccatatctcgtttctctatctgtaaaatcatctgccttatagtgttgttaggattatgtattcagtattagttatcatcattattattgtaaactcaggatttcttttattttttctgagacggagtttcactcttgttgcccaggctggagtgcagtggcgcgatctcagctcactgcaacctccgcctcctgggttcaagcaattctcctgcctcaccctcccgagtagctaggactacaggcatgcgccaccatgcccgactaattttgtatttttggtagagacgatgtttcgctatgttggccaggctggtctcgaactgctgacctcaggtgatccacctgcctcagtctcccaaagtgctgggattataggcacgagcaaccatgaccggttgtaaagtcaggatttcttcccaacacttactactttttttcttgacttaaatcttaaagcaaaattaaataattacattgttgacatatccttattaaatggtgtgcccatttttaggaccctgagtcttagattaaatgattgtctcaagtcgtgtagctactgttcctgcttctgtcctgcctggactacacatttccttgtatgtcttcctagtccttcgctttatctcactacataatgctgctagtacattttttttgttactgttgctgttgcctgtctttccttccttccatccttcctttcatcctcttcctttcttttctttcttctgcctttctcacgctttctctcctcacttccttttttcctttcctccctctgttctttccttatttctcctccattctttccattgaatcagcatttgagtgactccataggcatgtgctcttttggaagatgaataagacctagttccaggtcaagtagggagtacacaaatgaccaacagtacaggctcatctggatgcacacaggaggcagtattgagaagacctgggcttgggaagacttctggaacaagtgacatttgtgctgtgacctcaaagctgagtcaggaagactagtatttcagactagcatgtgactcataataatatattggccccctcagtattttgaggagctttttagaattaattagattggtcagatttatttaaaaagctgtccaaggaaatgtgaactgttacattatttctttctcactgcaacagacaaaggatctctgagtcatactattaactttagaactgcggtcagagttggactcatcttttaaatagtcaccaataacatttgcatttttcagattatctattgttgtgtaacaaaccactgtgaaacttagtggcatgaaagagcaattattttattgctcatgattctgtggttcaggtgtgtaggcagggtacaggtcatccctgtcccaggatgtctggagccttggctggaatagctcagttggctggaaacatcctggcttggctggggccctaagtctgagccctcattttttttgtctgcatagtgtctgctggatgtcaaacatccacgatggctccctcactcacatatgtgtctgttcacttgggctgagagagcaggaacagctgagggctgctggcacagttttctttccatgtgatcttcctcatggctagcccagggtggtccttgggtaattggacttcttacacggcagctgtctttcctcagagccagtgttttgagagactgaggtggaaatcgcaggccttcttaggccttagcttccgcggttgtgcagtgtcacttctgttgtgttcttttagttccatgaggctggcccaaattcactgtgggaggcgactgctcaaggcagcggtaccaggtcgggtttgtaggttactttgggaagttaactgctacatgcattcattgtaaagctttggggaattagaatctggtcagtcatactgtctttgcttcccctagccccgaacccgcaaaaatgcaaaaaaaaaaaaaaaaaaaaaacatcaagtacatccctgaaggaatgtaaggactcagaaaggtaactgaggggactatttagaggaagagataagaaccagcaatactggctttttagctatggtagccatgctcatgaactgattatacaggtatgattcttgcaatgttattacctctgtaggctcagagtagctactattgtcatgtatttgttttttataattgtaaattcagatcttgagaaaattgatagccctaattgtggtgcatatgtgtgattagacaattgactcattgaaattatttgatggaattataatagtgctaatttcctgcaaatcattaccagtgacatgttagaatgggaagttatagacaggagaaattagagataaaacattggtactaagaagaatgcctgtaaataagctcttagttttgtaaagataagagagatgcacaccataaatacagcattatggaattttacaaagttagttgaattagaacatccaacatataactgctcttttccacttagtaataggtggaggccattgttctgtgtaaggacatttaaagtaaggtattgtttggatcattataaccatgttccctatagcgtgtttccatagtttcaaacaaaaaatactattgcggggagcatctctgttcatttatctttactcatatatggagtatttttgtagattagatacctagtggtggaattgctgtattgaatggtatgtgtgttttaatttggtagatattgtgcgtgtcattctgcaaaaggacagttcattttgatactcctaccaacaatgtatgaatacctcgtttctttgtattttctgtattagtaatataaaaatctgccagtttagctgtttaaatttgcctatttctcattttatatttatctttactaaggagaatatagttggggattgtggttgaatgcataaggccagtatgaaatttactggaaatatgaggctacatacaagtactatatatagacatttacatggtgtgtgtgcaacctacacacacacagatatatacagcttcagaaatgtctcacttgaatcacagtatttaattgaatgcaactatttagaaaacgtgaggaatcaaagaaagttatcaaagccctatttatattgcaatcacgaggattgtgggtccctggaaactgaatgcagattttattatgtgcatgtgtgcatttttgtaaggagtccatggttttcatcagattcgcaaatgtagtctgtgacccaaataaggttaagaagcattgacctagataacatttaccatgaatttaacaaaactgctcatcctgacatgagttgcactcaaaggataaagccatcagatgcatagcaaattcaaaattagtgcaaaggctacaaggtctcttccacactagccaagaacagagatagtcccccaactccacatttgctggttttacagaaaagactttttaaaaggtcataaatgtcaacaagtttgttcagtaagaggatattatctttgtgcaaatagggatagaagggaggcagtgactcctgtgaggtccacccactttctccccattgatcaaacactgttctgcatgctgctggccagtgggttctgcaggtgcagttaacctccctaacctgttgatgttgagttaatgaaagggagattgtcttccacgggctggcttaatcagaagcctgggagccacctggaggagaaggtgaagcagccatgtccagagtgtgagtaggagaaggctttgggtaggagaaggccaaggtggagcagagctagaactgctgccctggaaggagggcctggtggcttccagcccaaggaatagcaggaggaccagccctacctccagcacctgcccaaggaacatatagctctaggattcactttctcaggacccaacctgactacctatcggcaaatccatgaatgctgaccacgctgatgccttcccagcacctgtctgtgggtaactatctcttaacaggagcccctgggggctggagtgcaggctactggcatctctacgctgccagtcatccctggtccttcccctaaccctgccgaggcccaggaccctcagcccacaggcatctgtgagggagcaaggaagtgaacccctgagatacggccatttgcagggctgtcgcatggaggacttgcctctaggggctcagctggtatgggggcaagggtagggccaggagcctgttgtcggctaaggctccagagaggaccacggccattgcagcagcagctttagatctggtgactttcaggagcacaggaaatcatcttcctgatgcctcggacatggcccccaggtgcacttgggcctcaagtggggctgccctgtgcagccactcccactacagcttgtgcagggctttaagcccagtgccttgtcttggaccttttagaccagtgtggctgttacatagagagttgacgagcagaaactggtatctccacttcaggtgtgggctacttgtgataccagacggacagaaggtggacagactccaaccatggacaggcagatgctctcagggagggtaaaggccttgagttattgtttctttttttttttttcttttttttttttttagagatggggtctcgctatgttgcccagactggcccggaacctctggactcaagtgatcctcccgcctcagcttccagagtagctgaccctcctggtgcgtgtcaccaccacaagtttcaggccttcttttaaagggcttttatgtgattaagtcaggcccactcaagaaaatctcccttttgattaaacaaaaatgagctggctaaggacttgaattatatctacacagtcccttcttagcagcaggatgttagtgtatgtttgaacagtggagagaagaggctgtgtactacaaaatggctgctgcatctcatggcccagccttcaccaaaagctgaaaattcctgtcttattgggaaaactttcttaatttatatgatagtttaaaaaaaggcattttatctaaagactgtgtttgagtgttgggtaaggatgattagctctgcattacctgaaagtctgctatctgacgtcccagttgatgtaacctaccaggtaaactcgagtgaactcagtgaacaggcttgatttcatactgtggtgagtgttaagtttaacaccacaggagctagctgcggtgttatttgagattatgcttttggataatggtagtcattaccaatttatagcaattaagattttgatacgttttggacaatatttagtcaaatataactgtttgttcttaaggttggtttaagagacagtcaaaccatttttttccttaaatgtttgttttctttttaatatagcagaaggaagtacattcagtttatctcatagtttaagtaggtgaaataggaatttaaaagacacccaagccaaaaccctttccagggcattgctgggcgatcattgtcagcttcattttgcatttctattctagcactgccatagcgggatggtcatcagccatagctgggttacagaagtagagcaaatattttgcaatttatatgagaatttgcacacacacacacacacacacacacacacatccctgttaggaaatatctcaaggtgtgtgtgtgtgcatgcatgcgtgtgcctatatatatgtgtgtgtaaatgtgtgtatctgctaacagtagtgaaattagaatgtttgctttttaaagaatatcatactgatgtaaaatggagctggtaaaatggttacaaatcagattcaatctatatagctagtgaaatgtttgtgtcaaccagagtggatttaaatccatatttcagctctttagtctaaacttagcctgactttcagggtcctggtttgtgtttccaggcttccatatacaggctcagtgttcagccacactcttttctttgctgcccttgtgtctcttctttgctggcttcagatatgctcttgccttctttacttcccttatttaagcttccattcttcgaggccccaaatcaagtacttgcttttactttaagcctttacagactagttagcctgtgtaatcttttgtggtactcgctgtcttagcctttccttggtcagttggtactgccttgcaaacacctttgacaagtccaaggatggtgtggtggcaccaacttgggctaggacccctgttctgacattaaccatgtgtctaaccatctgtgttctgtgataatcttcatcatcatgttgttatgaaaattacgacaatgtctgtgaagcccttacctggaaaatggaagctggataaagcaatttctcaaaatgtggagccattgtagccatgtcagagatacgtgcactttagcaggaacgcagtgatttcgaacatacactgaaatttgagaagcttgagctagatgatctctaagtcccttcaggttgctgacttgtctggtattctagttcatcattactctgaagatcatctcatacttaaagattatccatctgtttacatctcatttgagagctcaaataaggctggtttctaaaatttggacaatatgtatatgggagaacataaaaattgcaagagtttgattaaaaatacaattaatacatattctaaagagccatttttagttgtagatggtgggaattcatttgtttgtcttatatccgtcagatgaaccatattgcttgtcattggttcctttcagtttcattataaagttttcttttaaaaaaatttttatgttcttctgattttaccagaattattggtgattggccaaaggaaaaagtgttccagaggtttgctttaattgtgctacaaaaatcacaccatttcatttatagtcacttgggagatcaggtgtcccattcatcaagttattaagaactatttttgtagtcctgtaattagaacttgccaaataaaacattctatatagctaactcctgtactttttattcattttccttttcagaattctgctctgtttccatttgacttttgttaattgcaaaggaatttagtattaataggaaaccaaaaaacaagcacacctgtccatcagtaataggcttttggttgttattaaaaagttccttagtcatgtcagagtgggtaaagacaaaatgtaaaaatgctcagggaaatgactaagtctatagactacccccgcacccaacaccctagtgttgttctcagatctcccttaagtcataagtcccttatgattttatagaggcctaactggtcatcagttgccagaaagcactcttggatttactctctgtgtcagtccattttgcgttggctataaaggaatacttgagactgggtaatgtgtaaagaaagaggtgtatttggctcatggttctgtatgctatacaagcgtggcaccaatatcaactcagcttctggtgaagcctcaagaagcttttactcatggtggaaggtgaagaggaagcaggcatgtcacatggagagagagggaacaagagagagctctcacatgaactaatagagcgaggactggctggttcccgtggggagggcactaagccatccatgaggaatctgcccccatgacccagacatctctcatcaggccccacttccaacactgggggtcacatttcagcatgagatttggagggggcaaatatacaaaccaaatcaccctctccttctgtcacaagtatattattctaaaaatgtagctactgctgaggtagagtaattggtatatcctttttgcacagtagctagacacgagtttgtctattttaagttcgaattgcgtcattatttaaactaagatgtatgaatttatattttgtgtatatttttccaaaaccaacttgggttttgttttggggtgggggggaacaaaaagcttctctgtcccatcttgctcctttcccaatttgcttttccttaaacctactatgtaggtccaaatattaaaccattgctttatctgaacacaaaatttcaaaaaattgtgtaatagactgttttgtatgctgtgagataaacttaacaagatttgtatttaacctataaaagttactttttcaggcttgctgaaatgagattatgtttatgtggaaaaatgggattgtggcattttttcttagattgctttcattgttggaataaaggtctagggtgagaagcttcatctgttattattttcatgttttgcccctggtaagtgtagcacagatttggaataatgcttgtagccagtcttctgggactattaaagtcatttaatccttagttttcacttaggacctttcaatcatagattagaagaacttgaataaattatataagaaaagtaatattttttcactctcaactattactttccaattataaattgtatgcagatagtctgtggccattatcaataatgcaccacattagttctataaagtattttaaaaagcccaacgcctgagccaacaagattgttttttatttcacaattttttgttttctttgactcaaaatcatttatttgggtgtacataatagttaatacacattctattctaggtcttcattgcctttcttctgcacacttttcttggatgttcttatctactatcacgatattaaataatatctgtacatactaataatttccaaatccatttctctggatttctctcctaagcccaacatgtgtgtttttttagttacctatagatatttccacgtgtatgtcccataggcacgtcaaattcagtgtattagaaactgaactcattttctttacctccagtcctacacagtgatacaatgtatatgtcattttgtgtttcccagtaataaagtataatatgaattatcttgaaaaatatagtggagttaaatgtggaagcactggtcatttttggtttcaaaataccatgggttaaccaaatagtatgtatgtgctctgttaataaaggtataaaaaacacagttaaacgcatcagagcaagagaattaaagttggtctaagcaatttttttatataaataagagttgataagcatttatagctagaaacaataaaactgtgaagaaattttcttaaatggactatatgaaaagtttaaagacatttagaagtagattagtactaaagataaaaattctatcttaaaaattttaaatttaaaaaataataattaatagtagtttgtatactaaaatacagcaaaaaatctctatggacagattggtttaaaaccttttttgatggatcataaagtaaatttaaggcaagtttaatataagaaaaaccaagctataagtgctctttgggaaatttgtttaaaaatccttattttaagactaatttgaatcggttaggaagtaaattggttttaagcaaattttcattggtgccttggtttgtggtatattggtttgtaacccatgtaaatataccctattccatcaaatctgaagatatactaatatgtctttagatattacattcacaactaatctcttatatattcccaactaatcacctaaaactaggtgatattatatactaagaaaattatataataatttcttagtataattattatattaatatatataataaaattcttagtatataagaaatatatactaagagattataatatattctaaggtaaaaacagcttataattgatggtgtgttcttataattggaatttttatttatttaaagagatcttttatactttctgatatgtagatatatatttcacttatgcatatatatatatatatatatatatatatgtttaaaaaaatgggccaggcatagtggctcatgcctgtaatctcagcactttgggagacagaggtgggaggattgtttgagcccaggaatttgggaccagcttaggaaacatagtgggatcctgtctctacccaaaaaaaaaaattagctgggtgtggtgatgcgtgcctgtggttctagctacttgggaggctgaggcgggaggatcactcgagcccaggaagttgaggctgcactccagcctgtctcagaaaaaaagaaaaatgtaaatgaaaaatattggcaaatatgtccctaaaacttacttatatcatcattgattatatataacgttctaatttcagagatgttaatgtatgaaaaaatgtgtgtcctagattcaatgaaataaactatgccttgagtgtagagggtagattgagatggcgttataggtttgggcattatcgatatatgatgtggaaatgaatgagatcacccagggagaagagatctaagattagcacttggagaaacattaacattttatgtagtgagcaaagctccaaggaggtatttgaaaagaagggactaacttaaggaagtgtaagaacccagaagcaacagaatgaaaggatttcagtaacgtagagcaattagtagtgttaaaagtgccatacaggatgtatgtgtgttcattttaaagcttggaatcagattatagaacctcttctagatgtttgaaggaagtgggtggtttttgcttttttcgcattaattgtaaatgattttacatggcagtataacatactaagcaaattataccaaattagtctatatgtcttcagtcttgctaattttaaatttaaaatgttattgcccacttgtttgtggcaaaggagaaataaaggaatagaataaactaacgtcagtgtttttgtctgtcaactgtctttcagttttttatgagaataatcttagggtgccttaagtattcttgcatcaatgtgcctaattttatcaatgagaaaagtaatccagataatttacgtgatttcctcttaagtttacacatttagctaatgacaaatgcaggaattaaatatattttctcatccaggtgtccgtcagatctcccatgctgtttcttcctccttaaattgaaggtgattacttacggaaatttggttaaatgatttgataactatgctttgtagcatagagagaaataaacagctagtttaggtaattagttgtgaatataagagaatacagcaaatactggaaaaatggataattttttttaaaatatagaaaatgtcatatatattttttgattcctttaatttttaggatatggtatgcttttttttcttccattagcagtctgaaaatataaatatgtgtgaataccagttttattgaaaatattgagagtagcttcatattttagagttatataatgttctgtttatttttttttttaatagaaaaaatgaatgcaccaaatcagcctccacataaagacactggaaaaacagtggagaatgtggaagaatacagctataagcaggagaaaaagatccgagcagctcttagaacaacagagcgtgatcataaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggaggtaggtttccagtaggtattaatacaatgatatccttagttccatttatttattgcaaattataatgttggtgttatgtactttcatattctaatatttttgaacacaaatggcagttataaattgcacatttaagcatttctgtaaagtactatgattaaatagatctatgaaaactgcatgaaatttagtgaattaagtgcagggtggtatgtggagggaataagttcaaccacgtaaatacaggatggcaaaggacaggctgggtataaacaaaaatggaaggaagaaagccatagtcatggatgaccacaagctgcatgtgagtcaggaaaaaagtccacgtcacactcaggtgtttataaatgaatagggcgcccaaggtcaaggagagagttctttctctatcctttgaagttgttttctctcttttgattagcatgtcaagttttggtcactgtattttaaagagatgtaaattatagagaaatgtcagaatgatcaaggggaaaaagccaacactatctcgcaaggttaaagtgttcggtgcaggtgatgaaagtttaagggaagtcctgatttttgtcagatatgtgtttcgatatgtgtagatttttgtgagaggaatgtgcccactagaggaagtgacttgaaaacagtatagatttgcttttgatagcttgacgtgttataaattccttattgtaaagggtggtaatactagacaagggcattttgtgggatatcattcttgagagtccaaaatagtactgtacaagtgattttgcttttctggtgagtttgcatgttcgtctggctaaaagtgaaacccaaatctttgaaataccttatacccgtgttaagtctgtgattctgaattttagtagctgtatacatacatatgtacaatccccttggtatcagaggtggtttggttttgggacttcccacggatcccaaaatccgaaaatgctcaagtccctcatacaaaatgatgcagtatttgcatataaccaatgcacaacctcgtatgctttaatctcgagattatgtgtaatgccttatgtaatataaatgctgtgtaaatggttgttaatactgtatagtttggggaataatggcaagaaaaaagtttgtacatgtttaatacagatgtagtttttcttcccaaatacttctgatctgcagttggttgaattcatggatgtggaacccacggatatggagagccaactgtatatacttgttatttttatttttttaacttcattttttttttacacagcctggcttgctttaaattcattaacgataaacaacttggaaactatggaaaacacctgaagagaacttgagtttgcaagattttaattttttattctgacagccggattatgagcccttaggaggaacgggttaagcattcacataaattcaggaagatgtttacaacatgaaccagtgctttgtagctatattttaagagatttactttgaatattattttgattagaaatcttaaacatgaatggctggagtggtttaatttcattaaggacatatgttggtaagacaggattgatgtttaatttgtattgtgaccactggttttgaagtaacatgagtgaagaaaaaagtcctggcagtaccaacatcccttggtatctcatcccagggggatttgttccaggacccccatggacactcaaatccttggatgctccagtccctcatataaaatggtgtagtatttacatacaacctatgtgcatcctcctgtatgctttaaatcatctatagattacttataatacctaatacaatgtaaatgctgtgtaaatagttgttatactgtatcttttttgtttgtattattactattactgttttagagacaagatctcactacgttgcccaggctggactcaaactcgtgggctaaaacagtcctcctgccttagcctcctgagtagcttgtattactttttattgttgtattcttatttttaatgttttttcaaacattcttgatctgcggatgcatatcccagggtttcagagggccgactgtataacctcacctctaattcagtggttcttataggagagcagcacatgagaagaggccacggtggggcgggggtgagttggacatgtcgggcttccgtaaactgcttcacccaccctccctccccaaattgtcttccttcctctccaggctcttcgtggtgattaactattgctactaatgaggattgtatcccttagatatgttatagcaagaaaagattgagaacacgtgccctacatcttatattagaactcatgttgaaaaaagacagtaatagtttccccagagttctgaattctcatctgagttgtagttctttggtttgaccaattgagatttcgctgaagaggtcatctttgttatagaagaaaagaaacacgaattcaaagtttataaggtatataactgaaagactttattagaattttgtgtaggttgtttgcttttcaaaaaatgaactacagaagcccctgttgttttaaattttggttcataagatgctaagtgttcatcagataatgaaagagtaacagagagcgaaagtgggacttcttcagtattggggattaatccaaactaacaaaagataaggctctacaattctaattaacttagtgggaaagtaagattttatttttattcccactttaggaacataatttctataaagggaggcgtgtgtgtgtgcgtgcttgtgtgtgtatgtgtgtgaatatgtgtacagtcccccactcccaggtttgttttagtcgttttatttggtatgtcaggaaaagagtcacaattttgaagtccattaactgggtttcatttctcactgtgaccctttcttaccatagaacgttgtggataggaatctttctgactcgaagcctttgcatttatagagtgggtataatactaccttcttacctacctcacaaggtggttgttgtgaggctgaaaaagataggcggtaagtggtgttttcattcccacactgctataaagaaatgcctgagactgggtaattaataaagaaaagaggtttaattggcttatggtcccacagattgtataggaagcatggcaggcaacatcagcttctggggaggcctcagggagctatagtcatgatggaaggcaaagccagagcaggcacttctcatggctggagcacgggcagggtgaaggtgctccattcttttaaacaaccagatctcttgacagctcactcaccatcatgagaacagcaccaatgggatggtactaaacggtcacctcccaccaggccccacccccaacattggggattactattcaacatagggtggggacacagatccacatcttatcaaatggtaaaatgctctacaaatcaaccataaacttttagaagttttattactttttcttccttgaagctaactgtaaatccatatgggtgcaactgtatttttatttttaagatatcttctgccttttaacctctgccaaataattgtacattttaagggcatacattttaggcagtaaaaccttttaggtttgaggacttttttgtttgtttgtttgtttttgagacaaagtctcattctgtttcctaggctggagtgtaatgggaagatctcggctcactgcaacctctgtctcccgggttcaggcaattctcctgtctcagcctcttgagtagctgggattacaagcgtgcaccaccatgcctggctaattttttgtgtttttaatagagacgggggtttcaccatgttggccaggctagtcttgaactcctgaccccaaatgatccacctgcctccgcctcccaaagtgctgggattacaggcgtgagccactgcgcctggctagtgtttttgttcttaattgttaaaatatctgaactgacaaggtaccacagattgtacataatgcatattttgcagtttttgtggtttcgtgataataggaatgaatataggtgaaggattttgtagaaaagaagaaatacacgtgatgtttgatttttcttatctatgtctttatatattttttgattacgttacttataaccagtgtttgcaaagcacatgtgatcttacatttaatttccctttgtaagcatgctttacaaaataatttttttttgagacagagtttcgctcttgttgcccaggctggagtgcaatggcgctatctcagctccctgagacctttgccttgggggttcaggctattctcctgcctcagcctccggagtagctgggattacaggcatgcgccactatgcctggctaatttttgtatttttagtagagatggtgtttcaccatgttggtcaggctggtctcaaactcctgacctcacatgatccacccgccttggcctcccaaagtgctgggatgataggtgtgagccaccgcgcccggcccaaactaatttttctctaaaactttattaatatttcaaaatattttaaaagaactgaactagcaatactaaaaaaaaatctgtttgcagtttgttttcataatatgaatgccataaatgcctttaatgatttgttcaaaattatatgaagttgtagctctgtaccttctgtaaattgatttcctcaggacacatttctagttacataggcagtctctaattgaaacaaatggattagtttccagagtccacttgaataggcagttgtttgggatcttgaaaatacttatctatagaaacagtgttgtaaataagagagtctcagattatcaaatgaaacttatttaaatccatgtaactgaactaataataccagctgcagttttatcctggctgtaaggactaccatgatgggaaaaaataagaggaaaccttaccctcccccatatccatttgtggacccagatacaatccaagatcttttttatattttctcatttatcttcttcttctcttattccattgctgtttagaacatcccaggatcttattgtttgtacttatttttccaccttgctgtaataccagttcttctagtctgagtattgttgatcttgggtcttagggatgaatgtatcagccatttcataatgtatcatggtctctcaatgacagggattgtcttgcctccaactcttgctcctctttcattagatgtgcttgtatggtgacccttcccaaccctgcttaaaagttaacaagagtcatctcagcagtccagtagtttccaggtgtccttcccagcagttactgtagctaaggatgggttttgtaatactatttacagttcaatttagcttagaaattaagaccaagtaaacatatataaaagatttatccttaatatcaaaactactgcatacaattgtattttttagagcaaacttttcatcttggaataatatcagattgatagaaaatttgcaaagatagtacagaattcttatatgctcttcatccagcacgccttaatattgacttctcacttacccaatacatttgttaaaactaatatattaacattgatacaaagtgctgttaactaaactacagacttttatttggatttcccactttttctaataattcccttttctgttctaggaaccagtcgaggacaccacattgcatttagttgtcatgtccatgaatctggatttgtctgatatgttctcatgattagactggggtgatggggcttgggaatggatgccacagagttgaaatgccctagtcgcattacattgtcactgttgatgttaaccttgatcacttggttaaggtggtgtctgctaggtttctccaggagttactattttttcctttccatactccaattctttggaagtaagtcaccacacacaacccactctcaaggggagggaaattaatctctacctcctggaagggggagtatctaatgtattatttggaatttctccagatggaagttttgcttcttctcatttatttggccatttatatcagtatggactcataaatgtttgctgttgtttttactttgaattataatccagtaccattgttactgattttgttgctcaggctgttcttgttttagcccattggagctctttcagttgccttctgtgtcgtttgatatgctcccctcttttgttgtattattttccttttgatttgctttttgaatcatttcttactttctggcaccacaagatgctctgggcttgtcttgtattttccctcgttctgtcctaggatcagccatttctccaaggagctctggttccttttactggataattgtatttagaaatgaagatgtgggcactgggtgtgttcggtgctgttggggtgtcattgcttttaggccttctcagtgatagaattagaacgtacaggtatgtcttctaacctgtgtatacacacagatttataattccctatctaaaataatcatgagttcatactgatgtctttcgctctgattcagcacaaggttcattccgactttcctcccttgcttatctgtaacttacttctcttatagtgagaaacctggctaccattactacaattaattacatgtttgttcaaccctaccatacgtgtaaagtagtttcagaattgctaaccagtacccctgtgaggaataaatttatcaactagggtgtagtgtttcagtcaagttccttttgtctttagccttttatagtcaaaacactattctccaaagtaacttaggtcagcacctttttccttcaccttcctcagtgaggtggtatcatacttttgtaatttaattagattcatttatttcatctgcgttgcatcctgggatcctccaaaatcctgattgactttttaaaatgtgcatactctaaagttcactctgtaatatatagttctatgggttttgtgcaatttaaaatgttaaatacaaaatactgtaatatggttattttgtgctcctcctttttgatttccttatgaactttattttcagaagaataagatgaatatattgtaatgtaatgtacaaaatgtataattgtctgactttgttgcctcaaatactgggaatatttttgttttgattactgtcttaattgctttctttagaattagaaacgatcatgtagttattataaatttaatggccaatgaaatactctttgtgtttggattctaacaatagttgtgctaattttttcctgtacacacaggaaacactgaagaggttgccgtttatattcaaagcagacaaagcatgtagaaactaggaaatcaataacagcagctaccatttattgactctcacagtgttccagactcaacaaccctgtgaggtggtgcattttccaaatgcagaaaccagtttaggtacagtagataactttcacaaaaatcacagagctatagattgttagagggattcaaattcaggattctgggataccagactttatcctacatggtttcgaaacctggctgcacctcagcattacctagagggcttttaaaaatacgtgtgcctagccattctgagagtaggacaagtcagaatctcccagtgggggacacgagcactgacattgtaaacaaacctcctgtgtgcctcacgtgaagctagaccagcaacagtgtagttctggtactcactggaaacactgattaggctccagtgctcttccgccccatgcctttaagatcatgctgcttaatacagttgttagagttaacttattacttgtttcaatcattccctgtctgatttcataagattacaagaactttgtaattgaatgacacactaacaagcacatacttgctcatttgcctttaggttttctgttttcttaaacatacaaacatacaaaggaaagtaggaagttgtgtacattattttggactatagtgagcaaaccgactcaaactgatgtaatatcacaggtaggatagaagtcatcaactttgagctgagaactggatcccgtgataacaacagcacaatagtaatattgagaagactagtagctagcattaactgaacactcgctacatgccggggcaaggaagagggctaagtaacttgatcaggtcacaaatctagaaagtggcagagccaggatatgaacccagagctctggctgtaaagccatgtatgctcttgacagtgtacagtctcccaaagttacattttgtcccacacagtgttttaaatattttttttgacttagtgtctaatatttttaaatgggaaaatccagattttgggttttcctagaaatactgggaagtctgtcaacactgggtccacattcccacatgaccagcagcataagggctccaggttaccacagtatccatcatttgtcttatggccacccaagtacacctgtttacatgacttactgggcctgtgtagaaattgcagtttgtgataggatcccagtatagaatcacagaaactgacttttgaagggtaatgtaaaggctatttgtatctaacacttttttaaaaaacagtatgcttttgttttatttattggagtatatttttgaagtccctgtcctctgtcactgctcagagtaattatcatctggtttatattttctagagttttttgtgattctataaattatgtctttgttatgtaacacatgtaattttttacaacaaatgtgataatgctatacataatcctactacaacttgaagggtttcccccgtgttgtctactttggatctgtccttgtagatatatatatatatatatagctctcgttgttaaattccatttaacaactacatgatattccattctatgaatgtaccataacttatttaattatttcactcttgatggaaatgtaatttttttgcttgtgtaaacaatgtagccacagacattcttgtacacacccctttatgaacttattctgttgtttttgtaagaatgcttaattgaaatggaattgttaggtcatggggtatatgcacattcacatctttgatatgtattgccaaattgctctccaaaaagactatactaatttatacttaaaacagtgcaggagaaatttgatttttcctcatttttataaccatgatcagcaaaaaatgttatttcattgattgattgatttttttttttaagtcagagcctcacactgttgcccaggctggagtacagtggcacagtctcggcttatggcagcctccacctcccaagttccagcgattctcatgcctcagcctcctgagtagctgggatcacaggcgtgtgcaaccacacctggctaattttttgtatttttagtagagatggggtttcattatgttggccaggctggtctcgaactcctggcctcaagtgatctgcctgccttggtctcccaaagtactgggattacaggcgtgagccactggcacccgacctaaatctttctcttcatttctagtgacactgagcctgtttttcatgtttattggccatttgcatgtcttttcgtttgcttatttattttgctcattttctgttaggctgcctttctattattgatctgttggaactatttatgaattttattcatttttctatgatggttgtaaatacttctttcaatttgccttttaacttgtttaggatacttaacactgtatagaaatttcacatttttatatagtcatgtctgttgttattttatgactaccttattttatttgtactcagagattattttaaaattttataattgtcatggttttctttttacactttgaatcagtttgcaaataatgtccatgtgttatcattgttcattatatttctaaagtgttttagtctgtagattccccctgcctttttttttttgccatatatgaagaagcagggtcatttatcctgtagggtctgaatttttatgattgtatcccagttgccccacatgtttctattttctgtgtcttctctgtgaattggctgtaaaatagagtggcttgatcaaattcaggattttttaattggttggttgtattaacactactttcccaggacacacacatatctgactatttgtgccattagtagtagttgatgaacattgcctagattccttaatacattaagggctgaaaagtgaggatattctaattctctcatttcttcttcatttattagcttctttattattcatttcatttattagatattgctataaggataaacttttcctcacctattatatggttacttagtggaatagttgacacaaatggcaagattaatgtgcttgattctttaccttttatttactattttttaaaataatgatgtggtttattgatgactaattagtgttattagtatgattttgaactcatgaatttaaacatatttggtatgtttcaatccatggatgtcattaatgtattgaagtaattattgtaattaatgttcacgtcccatctttggacaatgggaacatattcaattggcttgactccttttttcacagtcctttgatagcttccatgttatttagtgtaactggctatcctaggctgacattgtatatctgttccaggttgagagtcagatatgttttgttttctttttctttttttttttttttttttgagaaggagtgtcactcttttgcccaggctagagtgcagtggcgtgatcttggctcactgcaacctgtgtctccctggctcaagtggttctcgtgcctcagcctcctgagtagctgggattacaggcatgcgccaccacgcccaggtaattttttgtatttttagtagagacgggtttacaccatgttggccagcccggtctcaaactctgacctcaagtgatctgccggcctcggcctcccagagtgctgagattacaggcacgagccaccgcgcccggccactgagaatcaggtacatttttaaggaaccctagttccctttattgagaaatggtatattccaagaccactgtctgtaccccagcattgttcattgcagcagaaattgtggctggtcattgttttactgtttagtgggcagatgaaaacacatacacaaaatgcatcacatgtcctttctgatagttctgattcaaattcaggatttgagaattttgcttaatctcttctgacttaatccatatatcaccacctttctttttttattgagaagcccaatgttctgtgataccaggtgtgacagaatatcagatactgactatattccaaaatagacaatcatctcagtgtgattactggaaaacagttcaagttttgtttttgaccatccttaggttataaccctctgtggatgtaacatcagataactgcattttaaagacttttggaacatttcttctcgtggctctgccactgactagatatacagttagattcttttttctactttatttccaaaataatagctttattgagatataattcacttagcataaaattcaccatttaaagtgttcagtggttctctgtatttggagttgtgcaaccatcaccactgcaaccatcctcactgtgtaactttggaacattttcattgcccctaaaagaagtcctgtaccctttagctgtcacctccacaattcctgtgctcactagccctatctctaggcaaccgctaatctactttctgtctcttaatatttgcctagccatataaatgtggtcatatggtatgtggtcttttgagactggcttctttcatttgcataatgttttcaaggttcatccttgctgtggtatgtattggcgcttcattcctttttatgactgaataatattccattgtatggctataccacgttttgttgatctattcatagatttcttaaaattttatttttaggtattggtttttaatttgtttttataagaattatgtgaagtacttggttttacaagaaaatctaaatgtattctcaaagaagtttagcttctctgacagggatagttaatcttttaaaacattttatgttttatacttctgttttttagtgtaacctttttggaagtatgtagttttgtttatttatttacttttaatgtttaagatgagtttatttcccccaagatgtctttgtattaatatctttacataacacccttaatatcccctcttcaattttttaatctgcttgttcccaactttgagctatattggaattatccttttatttctaaagtttcatttgaagtaattttcttttactgccagtgaaatgccaagttatttcatatgccctttcttttcccccagatggtggtggtgtggtatatctgtattatcaatcatacagccgtgtatgacagtactttctcccccatagctgtcatttagtctcagttcttcagggttgtgtgtgtgtagatagataaaatatttataatagacatgtagatagaagtttcagattttgtttaaaggctcatttttaattattatatcccagtctcttgagtcattctggttgagtgacacctgttctttagtagatttctgagtaagggctcaggaggacagcatttcctgagttctgccatgtttctaacagtttgcaacatttatacttggaagtttgtttggctgtccataaaatctttggtttatattttctttccttggataaatttgttattcattcttttgacaggaagcattgatgttgaatggtctgatgacaatgtgattttttgtttccatttacaagacctttgtttgtttgctgaatacctaaaggatttttttctttaaactctactagttttacagtgttggtttttccaatttgatattttcagatacatggtgtacactttgaataaatagtttagtttgtttgtttgtcagtctgttttttaaatttctagtgagtttcttaacttacagtttcacatttttgcttcactgactcagttctctttgggaactgctctttatatattttggatctactttgcctgtcttctctgtcatttcatttcagatcttttctttttcttagtttctttttgagttataaagttttcttttgttgacctcatttcagtgaaggcattatctgttctgtttatttgctcttatgtgccttctagtttgtttttgatttgggacgtaaaattgatttgatttttgattaaaaaattaaattctgagttctatcactgaggttttttttctaattctaatttttgtcattattttatattttttatgattttcttaatttcttttagtttatttcagaaatcggtctacaattctcatctgcttagtggacatatctttctggcaagcgctcactgtctggagggttattctcctttttctctctctgcttatggtaaccttgtgctagattctactacagttcttttctgttgcttatttttaaacatgatacttgtttccatgaacttaaaggagagagggagttaggaaagtgtttgggattggggctctgagtaccttcttctcaagtttcaaaccatcttctctgttattgtttgaggtctgtggactgttcttcttcccatgttctcgatctcctcttctctttcctcctgttgtcctttactggggagttggatttcactttttttcctcgatgtggagccgagaattcctggaagggaatttggggtactagttttaagatattatggggcctaaaccactccagccctttcagaccttactgccaaccccttgccttcactcatgaatagtgccaaaatcattcctaatttcacagaagttctctgtagactctgtgagcttttcatagagcactcatcatgacttgggaattgcctctttacgcccttcagacaccctgttaatttcctctgcttccctccgctaatgctgataccacatggctcttggaactgttcatggttttcccaccacctcttctctttggggagtcatgaccaccccttttcatctagttttgttggaggtttgtctcacagagttttggttttgctgtcctcattgctccatttttatgagagggcgttgaagggaaattgaaaccctgttgccaccactttttcccagaattctttttttcagtttgacctgtactaaattgccagtatttgaccattttcaatgaacgaaagtgggaatttttatatagtttaacctaatgcagagctctatctttagattttactacattgggaatttctttttccaaatatattgttcaacatgtatttttgtgtttaatacatactttgatttcccataataaccagtaagaatttctaaaacagctgcataattttagaaatgaatacttgtgatactgtgaggtatagtatgaggtaagcatgtcattatttttctgttaattgcttataacatacattagataacccattattttccaacttcttaaactgctgcctttttttttttacattaaattctagataattgggtatgtttctgtgttctgatctgtttattactgtgcaggcttattctattttaaatagagtaggcttattagtaaggtttggtatcttgtaggacagtgttgcccattgtttcttttcagaagtttctgtgctgtttttatttttgcacattactttcttccacatgggctttattatggatttgtcaaatccacacaacatgacatcagaattattattgtaattacattgcatggtcttaatatagaatctctaagatggagagcaccctttcaatgattagaagagacacaagatggaaataaagattttattacttgcaggttctggagggtacacggcacgcctacaggccgctcatgcagaggtcaggaagtgcagacagggagagagggagggacccatgggccaatgccttcgtggagtccaaggtattgtccaaacaggtttccctcaggaaggtttaattggtggatttaaagcaagcaggcacaaattccaggaggtcacgctgttacagaggtagtcacagtgctgtgtctgcactgtccatgagaggtatgagggtcagggccagtgaaccagtctgtgtgtagctgtccatagggaggtggtcactaggaggaagttgtataaggcaggtatctggatcagccacattgaggaactgggaggcagtgtagaactgcaccctgtgtcaagggtgacagagccctgcttctgctatgtgaaggttccacttagattcaaagtgcataccaaggcaacataaaattatgagaatttactatgcattttatccatgtccttatattattgaatcttcctagtttggctaggcttgatctggggttttacactgtgtttgatgctgtgctcttcactggaataagatgataacagatatgtgttcctgcactgcactgtccctttctccgctcactggttttattgtaataatttggaatgcaagatccaggccttttctttatagtgtacttaaaattgtgtttttaatatttcattctagaactcgaattgtagtcagtaaccaaattatcatcatatagttgtatctgcctatacagattgaaaatcccttatccgatatgcttgggaccagaagtgttttagacttcagctttcttcggattttagaatatttgtgggctgggcacggtggcttacgcctgtaatcccagcactttgggaggccaaggcgggtggatcatgagatcaggagatcaagaccatcctggctaacacagtgaaaccccgtctctactaaaaatacaaaaaattagtctggcgtggtggcgggagcctgtagtcccagctactcgggaggctgaggcaggagaatggcgtgaacccgggaggcggagcttgcagtgagccgagatcgcgccactgcactccagcctgggcaaaagagcaagactccgtctcaaaaaaaaaaaaaaaaaaaaaagaatatttgcagaatggataccagttgagcatcccaaatccaacatgtcagtgctcaaaaagttttggattttggagcatttcagattttgggtttttggattagggatgcgcaacctatataagttttgttaaatttatggcttttctctttgtttgctatttttctttccctatcttgtgatttttttattccagtctagttgtcatttaactagactctaccataaccatactttgaatagttttttagagaaggtaagtgaattgtactttgagatcatccctattcagaggctgctgctgctttacatcttagtggtgttttgactatgccaaatgcttttctccccttttccttttgttctttatggaactctgatcttacgttagagccgctagatctgacttccatgtctcttgtttttactcaaagtttccatttcatcttttctttttttttttgctctgagttatagtaataatttctgcagttaattctagattattaaatcagttttagcagtgttcattctattttcactgtcttcttgagtttatttcagaagtcttaatttattattttccagaggactttaatgagatctcgtattagagtatttttattgttctctcctgttttctacattaaatcggtattaattgagcccagctgttctgattcttccctttagtctcctcttaaggaaattgctgtttcctctgaagtgctgaatttttgaaacatctgctcctctctgtctggacatgtattgacataccaagctcctccagcaggaaggggtttcctctgtgactgtggaggtctggctgttggctctcccaggcaatgtggtcttgcacttttttgagaactagggattgtgcctttggctcattgagcccgtaaacaaagtcagcaggctgggactgtttggaatgccgaaagaattatttagaattttatcttagaaagtttggtgaattttatagagctttatataaacattgttttctgatatcattataccagaggcggtggagggaagcatttacagcgtctaaagcctttacttacacataccttaagctgttaaccctgaatatctgagacaggtctgttaatttagaaagtttgttttgccaaggtcaaggatgtgtgcgcctgtgacacagcctcaggacgtcctgactatgtgtgcccaaggtggtcagggcacagcttggttttatacattttagggagacatgagacatcaatcaatatatgtaagatgtacattggttccatccagaaagacaggacaactcgaagcagggatggggcttgcaggtcacaggtaggtaagagacaaaacgttacatttttttgaatttctgattagcttccttatgcatcgatctcagtgagcagagggaacaggatgggaggcaggtttaccctaagcagttcccagcttgacttttccctttagcttaatgatttgggggctccaagatttgttttcctttcacaaccctgaccacatttattacaagtaattattttagtggttattttagaaattcttgcctgttagggaaacccaggtgtgtactaatttaagtgcaaaagtatgtattaaatgtagaaggataaattaatcttgttttccttagtgctaatgcagattactacgtggaaacggtgtgttcttccaactttatattttagtggttatatactaacattgtttgatgtcaggttataatagactaaacgtctgtgttttaagagacaagaattttttcctttcagacgtttaatcttgatggtaattttatactaagaagaaggcatatcctcgtttctgtcattaagtgtatctcagttatgccaagtatatgttattctttttgaaaatcaaaacatccacttttaaaactgtagaccttgtcaatctgtcactaacataattactgttggcattaggagtacaatagggaatttgagaactaagagcttgttaacaaggttgatgacatcatatgttccattctttagtgttagattgttaatagctggggaagaagaaacactggcacttttataggagtatttacctattaatttattcatcaaacataagcatctattatgtggcaagtaccgagctaagttttagagacccatagttaactggagataaacaatctttttcatggaactgatggtctaatgggtaaatagataaaataatgcattacagtaaagcatgataaatacaacagaggaagcatttgcaaggcacaaatactgtgagaaaagggagagattaaatgagttatttgaggcaatcacagaaaacttcatagaggagggtggcatctgggcttcttcctaatgagaggaagagttcaccagggacagaacactgtctgcagatcagaacttctgataataaaagggattaatttgtgcaaaagcacagaggcaggtttgttatgggtaaaggagaaaaaggtggtggcaggagataaggatcaagatctatgcagagacctggccattaggctaaataaaagtgtctgacacttagggctgtcagtgaagcattgcattttaaattagaagggctaagacaagccttggaacaaaatcactttgtgggttattgagaggtcagtggattgacgcgttgtaatcagaaaagcagttgaagatccactgtgagttaaggcagagggtagaggagaaggtggatttaaggagtatttagtagaactgataaagcatgttaaacgtctgcatgtatggttcaaggaaagaaaagtgtggaaggccatgaatgagcattaattagtgaaagccaagctgtccgttggaaatgggaaaacacagaaacagggaatcatcttgaagaagataatagccgtaaaaattagtccactctgcagctgaggctctttgtgattccttgagtcctctgacagttctagatgtgggggtttatgcaaacctgacttaagatatggcttcttctatttgctgtaaagcaactaatggtccagaaggagagaccaacatgttaacagtagtgattttactaatgttatatgtagtatgtttttagagcgtttttcccatgtgtacagcatgctgtttaatcttgttaagaggtagttgatggctctatttttaaaatgaagaaatcaaccctgagagactactcagtgcttccagaatcacatcgctaattgactcaaaaccagcttttctgatttttggacattggttgttttctcattaagccacaccgtctctatcatgaaagtcaaggtaaactcagggtttagagtattttagtggcatgctgttgggggcgagaagaaagtcactggaaaggtatcatgaggtgaaccttgaaaactaaggattttgaagtggaaaataaagaggcgagcatttccaggtggggaggcagcatgggcagcgaggctggtgatggcacacgtgtgtgagggttggttgagagtgtcacgtggaggcaggagagaaggcagcactggagggtgagactaggtcatggagggtcttccatagcagctcaagttgtttgggccatatttggtagatgagcaggtcgggggcagcacttggaagtgtcagatgagagtatcattcatgaatgcagcaacaattactgtctgctgtaatcagtgccaggcgtggggacggtccttttagtatagtggtaaggaagtgaaagtccttgccctcaggaagttctgtccccaagttatggtggagtgtgaaatactctgatggcagggagtaggggttctggtgaggaatgatggggaggggagaaatagctcccatggagcagggagaaggtgggtgaggaccaaagggaggagaagcaggggccttggggagccagggaggagtgaccaggagcagagagagtgctcccaacattccagatcccctactttatggggaaaggtgtaaggaatttgagaggaacagctaaaagaacgggggtgggggcggacaacgcaacactagggttcccgggaagcatcacaaaacggataactgagtcatgccaaccaggttgatcttaacgattttttaatttttctgtcagcatcgttcattacagctcaggggaacaaatggacagaagaattagtggaactgattagtttttatgttttcataaatggctacttaggatgagctgttatttgattttgtaatgttttctctaatttcagtaattctctggtttttttcccagtctagagatagttgtcgatagtactgtatataacctgaaaaataaagtgttctgatcattttaagtgtgaggcaaaaatgttaaagatgaacctgattctttttctaatatacttctttgatcaaagtattgcaatttggttttggttctcattatggtttccagcattcttagaactttttggatctatgttgaaaatgttgaagttattaaattcattaaattattaaatattcttttccctgtaaaattagaatttttgtagatttgttagcacattgtagagaataagagtttataaccacaaccgtagaacgttgtctcgtatgctcttttaatctgtgcctgttgaatttttgttatagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcaggtttgcttcaaagactctttaaaatatttagcaattattatattatcctacaggcttatcatttttattttgagagttcctttttttttcttaattgtcgcaaatagtgaaaaatgactgtttgtccatggttttaagctgtatattttagggtaattaaaaatgttctttatatgcggtcctcaaaggtaagattgtggttcatcctttctgtcatccacttccttgttctaagtattttaaagtttcagtctttgaagactaaaatttaaaattcattcataagaggtagagtataagattcttaaatttatttattttttctatttgaagtacatgtaaacagataaatgtctagaataggcatggggaggggtttggactttctgcttgcttaagcagtggtatggtttaaacagtagtgacagcttatgatttcttcgttgttgttcattctgggtgggatcttacggatgtttgatatcccaggagcagcagcggaatgggtggaagcagttgtatccagcagagtgagtgctgaagagggtctgtatttattatttatgatattaacatattgatattcaccatataaagtaaaaatttccagaccttgtccccaaaagaagaaaggttggtatgttttttgtagactgtacgtgtctatcccatagggattggagggctaagagctacccggctctgtgaatggtaagacaaagcataggtgagcagtgcagattgaggaaaggcaggtgaatacaggtcatacagtaggtacaaaataggatttgtttgtttaattaggagtagaatagaatgactaatgaaagtcatttggagattgtcccctgcatctcatttccatccctttggttcatacccagcaccgccagagctctgtttccatgttagctccccttccttctcaccctcttgtttctggttattgtcgtgctgtccactttggccttgcttttaactcatcctcataatcgcagtggttatctaggacattttgggaaaatacttctcagcttccttctttatgaaagaaatacttcagaaatatagcctggtaaagcaaggtggagtttatcttttgttgatggggctattgtgaggactaaatagtaatgtatgttgtaatactttgaaaaataaaaacaatacttagattaatgtagcactgctagagtagaaagaaagcagaaattttggtttaaatgcattcaaagatcagttacaagcacctaagtgacatctttaatagagaaattgataattatataatctgaacagaacactttttgttagatttaactgtagccatagctctcttacagtggataattactttaaaacatttctgggagagacttctgtcaataaaagcaatccatgtttattttagaaatttagaaaagtacaaaaaaagataaaaaatcaaaatcaaaaataattgtaaaaaccctgttattctgacattcagagataactgctatgacattttggtgtatttctatccatttgtttttcctgcacatacataacttcctacacatacaagtaagtatgtgtgtgtgtgagttttttccctgtaagtatttttcaaaagcaagaatttaaatggctgcaacagtattctactgtataggcacatcacaatttatttggttaatcatcgatttaagtaacattgtgataaatatgcttgtatagaaatcttagtttagatctctgattatttctcgagtgtaaaacataatagtatatagatgagtcatacatttttagactctagaaagtttgtatcagtttacctttccattagcggcagtgaaggtttggctaacatgtatgaaaacgaatgtgactgtgtgatctcatattacagtccctgtttattagaatttgcgtacattgtgtctcagtctttttattaatgggaagggctttccagattgtctcatttcaaccttctgcccacgtttggcaggttattacctattagatctatatattgcaaatttgcccattttttgttttgtttttttctgttgatttttatctaattccatcacataatattaagtcggttggttggttttggtggtcattatttgatggtagactgggccacaaatcacagtaggtaaactatgctaaattattgcgaaggccacctgctttgtggtaaaaagtacctttgaatctttattatgtttttgatcattaggaggtttttctttctcacatttcttgtaatgtaaattagtagaaaaattgattttattctatgggatttactttctatataagtttgttgttaagagaatttattttagcaaagcagtaattgcctatatggtattttctctgtgtatccatgctgtagtattaaattcttttattttcactgttttgttgcttctcaattgagactactaaggtatttacataaaatgaactgatcaagaatctagaaactattgtaggttttttagaggcaaggttccctctgagttttttgaagatttaagtaggaagatataaaacacggatcgtctggttggagtttatggctgctggaacctgtgtgtgttgttttgcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtcagaagcagtggggaggaatttttctttctttctttgtttctttttttaaaaaagtaagcctgtatttccttgttttgcaaacagcgttggcatacatattcagataaacttctctagtaatgaattatagaaatgatccctgaaagtatagcttgtgtgtgtgtattgcggagggcggtggtggtgatcttgaatcagagtctttccatctggtattagattacatttgtttctctgaaatccacatttaaaaaattctcaattgtttttaagttggaagtttttgacaaacgttaacctagttcattctttacttgtagaatagttcatcttatggcagaatggcccagaagtagaatcaaaatatggtcctatgttagtgaaccgtctgtcatcagccatttttataatacctaggatgtgctagggaccttgcatggctctgggagtgttgaagatcaacaagacactcgtagtctggtgggactaggcatggtagatggtaacgcccccgagggctcagtgccagcagagaagcttgctgtgttgtctgggaggcacttccagtgaggaagctgaatcttaaaaagatgagttaagggttagttaaggaacctggcacatttgaggacttgtaaatagtttgattgggcaggagtagacctatttttattttgtcataaaaagagacctcctgtcttctcacttacactgaatgtgccctgtgcttttaacctctgttcacattcttctttcctgttagaaatgccccctcctccactttatctgcctatttaaggcttactttcaggttttatttttctctagaaagctttatctgacagttttaacttttagtctgtgtttataccttctttgaactctttttagcagttacagttagaactatatggtttaacatttaaacagagactcttttctcaggttgccctaattagactgaaagcttcatgagccaagggctataacttgaaattctcttgttttccatagtatctgatagtgttcatgtatcgtaagtacacgttagattcattagggtatatgcatagatgattacgtaatgtgacaggttaatgaaataataaaactgtatcgttgtaggtggggtgcattcattcttgcttaacatgtactgtgtcctgcctaaggatggctgcagcacctacagataccactctcactttctaagcgggaagaaaaggggaaacagaccttaccagctaagtccagacctttttatcagagcaataggagctctcctggcaaccccacccagcacatttcccctgccttttgttgaccagacctgttgcatggcctcactgttgccatggaggctgggaatgcacatgttgagctttccagcctctgtagtagaagtagagaaggaagaatgtggctgggaatgagacatattatatctggcatattgcaagaaatcattttaatgagttagaagttattctctatataaaagacctgagtgtgtaaaatggctgtattttgaaatactatgtatttattttcttttttgagatagagttttgctctgtcacctagactgaaacgcagtggtgtgttgacggcttcctgtagtctcaacctactgggctcaaacgatcctcctgcctcagcctccctaataactgggaccacaggcgtgtgccaccacacctggctaatttttaaaaatttttttgtagagtcagggtctcactatgttgcccaggctggtcttgaactcctgggctcagtgatcctcccgccttggcctcccaaagtgctgggattataggcattagccaccacacctgcccactatatatttcttatgtcaaaaaaatctttatcttgaaaagttgtggaaaaaagcaacaagcaaattattatttttctctctttatgggtaactaaaccagaagtttaagaagacagaatatgctttgcttcgtaaactgtgtttgctggccctttatcctgtagtggcaggggagcagggtgaggagcatcaggcatgtgaaccacgccttcctggtcagccagtttctgtgccattggtgagcctgtgtgatagtggaagtctaggctaagtgacttaccaacattcacagctagttagttttagaaaggcttagagtttagttttggcattactgtcaattatccacatctctcttcttacagatgaaaaaactagagactgtcagtgttttaaaattatggcctataatgtgctagaaggatcagggcaaaggtgtgttctgaggactaggggagcccaaacaaaatcagtgtttctattaggaaggaaggaaagaacagcaattgaattggcagtcaaattatgtttaacacccttgtctggaaacccaccgaaaacagcaaatggaaaaattccttcttcagagaaggaggaaattggccacaatatcctttcccatacccttccaaaaataaaaagacttagaattattcgccttgaaatgtaaactaaaatgaaggtaaacccaagctctaaatacgtgtccgccttaggcccagaaggcccacccagagattaactagagccttgatatctaggggtgtgacagccatgaccgaagctgagcctgtctctccagggattctgttgttgactgaagagctgcccgacagaaggagcgcgagctataccgcagccttctctggttgtcaggaagactgccgaatgggagctctcttagcagggggaggggaagcagtgattagcaagttatgatgcagaaattctgtgaccttgggggctttactctgcgttaggacatccactgtactcgaaaaactgagacacttaagcatgtaggtcaaaggaagtaacttggtgagcatttggaacatcaaatctaaatcaaagctgtgaattgttatctcatttcctgggtccctggcctcagaagtaaccaagacaataaacataataatacatgatgtaggaacatgtgacagccttaaggaaaccacttaaaaagatttataaggattgaaaatatgaaaatgataggcgagatgtggtagttgtagaagagacacaagagagctcacatgtacacaatttgagtttctgcagaagaacaaagagcaaagaagcagggaagctcttaagttttcatcctacagataattattgggtatccactgtgtgccaggcaggcaccatgcggggaccaaggaactagtgccgagcgtaaactccctcttagagtttaagaataggggggtccatggtgattgtagaaccatgtgaacaagactacagctgagaaaaatgccctcaggaaaggcacaggtcttttgtggactggttaattcgattcaactttttgtggaggtcaggcttctctgaggggggagcattgcaacttatcggaaatttatatacattataatccagtttaggtaacagatgaaaaacgtagaccaaacaatactatatattgtagtttctgtaataagagattgttttaaaaagcgtatagactagaaggaaatgtgctcagttcatgatcattgttgcctctggggagggaggaaagagatagaagtgaagagagaacaaaggagaaactaactttctggtaccttatttcttattgaaaaaaatatctacatgtaccccggaacttaaaataaaaattaaagaaaaatcaacaagaacatatctaaagcaaatatgacaaaatactaacatttgtttattctgggtgatacttgtagaatactttttagaatttttttagcctctttgctttttaacttataaagagagggatcaagagaagcccctttttggtagcaggtgcggtccgcttgggaaaggagcctggcaagagcaaggcaccgcaggcagcctgtgggggctccagctgcaggtggagagtaggctgggggtccagagcagatgtgagaggaacagttcaaggccattccaggaatgcacatgcaagtccttggattagagggggtaacatacattcagaaagaagtataaggattcaaaggaaacgtaggcagtgaaatggcaggactcgggtggatcaaatgtgaacaaggtgttgggagtgactgtgggtgtccagctcctgcagctgtgtgagtggtgaagatgtgagtccggtgaggagttttaaattgggctgagggcatttgaaagccctcaggcttgactttgcaaactaagggaaagagatgggaaaaaaatatatatatgtattaatatgtatatacgagaaaagggtgaggttcctcagacttctggaggagatgggtctcaaactcaaagcacaagctttgggattaggaggaacagtagttcctctgctataaagaagggaggaagagaggatgtaaccctgtaggtttgcatgtttgggaccaggaagattttataccaaatgacttctatttttgtgtggagaggtagagatcatctgctgagaatgggtggtggtgggtattggcagttggaggaaaatggggaagtttcaaactggtggctctagacagaaggaaagtgagctaagtagagatagaaatatgactcccagaaatgttatgtggctggtgattatgactagtccccccagctccttgagtgtgggcagggggaatgggatggttaggcttaagccagctttggggtcttgaccaacaggtgagatgaaaagacagtaaggggctgcagggtgcaggcagcagcggggacgccagcatgctgatagcagtgcagttgaaaggataagcccatgggatctgaactgaagccagaggaaagcgaacaaaggaaggggttgtgagttgcagaaagatgagcagtcagtggactgggttccagacagggctaaaacaagttgcagtggtagtggttgaacaaatctcctggaaggaggagagggggctttattatcaggtgtttgaactggtgatttgggggttggagcagttctggcaatgacaagatccaaggtggaaccccatcaaaagtggagaaagggccactggagatggaggcagtcaggaagctggactgaagaagtgttcggtgggttttccgcatgatgctaagccacggcagggtggccgagcccgagatggaggaaagactgttagatgaaggccgattagaagtccataggtgacagtctgaagagggggccagtggtgtggctgatgacgtaaatcttaaaggggtagggtcttttgttttgctttctaaagaagaatatatacaaattatggtttaaaaggagcagttggagccgggtgcggtggctctcgactgtaatcccaacactttgggaggccgaggctggtggatcacctgatgtcaggagttcgagaccagcctggccaacatggcaaaaccccgtctctactaaaaatacaaaaatcagctgggcatggtggtgtacacatgtagtcccagctacttaggaggctgaggcaggagaatcacttgaacctgggaggcagtggttgcagtaagccaagatcatgccattgcactccaacctgggaaacagagcaggaccctgtctcaagaaaaaaaaaaaaaaaaaagcagtgggaacaggaggaagctgactttgcagcctttgagtgcatagaaagacagagagttggccggacgcagtggttcacgcctgtaatcccagcactttgggaggccaaggtggacagattgcctgaggtcaggagtttgagaccagcctgaccaacatggagaaaccccgtctcggctaaaaatacgaaattagccagttgtggtggcgcatgcctgtaatcccagctactcaggaggctgaggcaggagaatcgcttgaacccgggaggcagaggttgcggtgagccgagatcgtgccattgcactccagcctgggcagcaagaggaaactccatctcaaaaaaagaaagaaaaagaaaaagacagatagttgccccttgggggccgcaaggaagaagctgtcctcaggaaggaaaaacacggagatgggggagctcaccaagaagtgaaagggcggttctgagcctcgtgttgaggacggtagacccatgaattgcagattctgcacacacaactctagtcataacagacccagaacttcagagtcacaccacacacctggaggatggaggactcagacacagtgaacgatacagcagaagagagttgtcttgagataaagaatagacttcagatttgcctactgaaagttattactagatctcagaaaaatatctttcccaacaatgaagtctgagatgtagcctggtgaaaacactgaaacctaggatagagaaaggaatcctgtaaacatctgagtgtggacacccgagtgtagtcaccttcaggatgtgggagagcagtggtgggtgggcgctcaggttggcgacagactgcttcacgctgagtcacactcggggttggaagggagtggagtgatgtctgaaaagttccgagagagaatgtgtgactcaaatatctcctaccccgtcaagctattcttttaagtaaaggagtccatagacagggttgttctagaaggtggccattgcaaacctgttgagaaaaactgcttgatagttgaaccctgctgaccacgggataaatccaaaggaggatttaagaacgggaaagctgttgtaataggacttgtggtgggcataaatcccacttcagaacaactggatattttggttttagatcatcatttatatgttgcaagccttgaaaacattttatcacgcaaatccggatgttaggaaggggtggtgcgaagaagggtgttgacgtcctcctctctgcacataaggcaccatttcaagctaaagtaggtcattaagtgaagatcctaacctcttaaaggaataatgttgacagtacattcataatgaaaagttctgggtactgttcttttgattttttcccctttattgtagattgtgaacatttttgttgttaggattttgaaggggttgtcaataatatgttaaattgctggggagttagttttgtgattttttaaaaaatcctcatttagacctcagctaacagtggtgagaaccttgcttctgtcggtgctgcgtgcctgtgacagcccccggcccgcccccactttaccctgctgatgtgtagctttcaggtgagagcgctgagttgccaagttctactttcaaatgtctccctttactttttgtgttttaaggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctggtaggaatccttgtgcttctgaatgcgacgctcccaccttctcactctcacaccatttactcactgattctctcctatgtgtttgtatgtttagttacatgaaaattgcagttatccatatctcatatgtgcaccctcttccaagttttgagtggtgtttctcagtcaggggtgattttttccccttggggacattgggcagtatctggagacacttgatggtcatgactgggaagatgctcctggcagcgagtgggcggggggagggaggctgccgcacattcacggcacacagaacagccccacaacagaattatccactcagatgtcagctttgaacttgagaacttctgccctagaataaactctttttccccctaataaaaggaaggagattgtaagtccttcaagagtagaatatacccgcgtatatcagtcttggtggggacatgcagaacttaagaagtattttaagcatttttactgccactgtttggggaatgtagtgctcatcacagactctctttatgaattgggtgtatatagggtgaaggaatagaagtgtaaacaagggggaatcatgaagagagcagtgcagagtcgcagggctggtctgtcagttctaggaaatgaacatcttgcatgcaagcttgggatcgctgggcacaggccgcgtctccgtggtctttgctggtggccactgcacctcggacttgctttggctcagatgaggatcagtgtccttctgtgctttagattctgctgctgtcttttggcaccaccttctcccacttgtctcatcaggcattttattttttctgtatcccttttataaagtctcattcataagagcatgcctattctagtcctagaccccattgcattttgtctcttgtattagagcagcagcttctgctgcctaccctgtctcctggtcccgtcagcgtgacttctgcaggactctagctttagctttgttcttgactctgccgatttctcctatgttcagtctcggaatctcgtatccacttctctgttctaatggccagttctttttacatcctctctctttatttggagtggacagtgaacttgctctcctctcataactccatccgtcaggctgtgatccccaggctgtctttgcttgtctgttcagcttggtgcccatagtcagcctttttaaaaaaggcattcattgtcatttgcaacatgtctccccccttacttttccatgattctgctttgcctaattccttctgtttgcattttctgtttccaacctgtcaagctttgttgaagaaatgtttttaaaggttactctttagtttcactacaaattcatgttgtttagtgtcactgtaccctcacttcctcttgtcagtctttgtgtttctatctttgcttgtccttcaaattccctagagtgcagtctctggcctttgctttcatgatcctcgccctgagaagctccagggctttttcattcccccttcttgtgaacagtccacttttattctagttctggactccactgcattttatctgttgtattagagcagcagctccggcttcaaacactgtttctcccagggtcagtcggtgttggaatcagcgctgactcctttgtttcctgcacacactacctcgactctttttgggtgccctttgagggtatatccagaatctgacctctgcctctcaagcactccacacttccactcttcccaggttgtcatttctcacgtatgttattgcagtagctctctaaacagtctccctacttctgcctgaagcctcctagagtttattctcaacaccacagcctgaatggtctggttaaagtgtatgttagaccattgtcttctctcaatttcccagtggctccccatcttactcaggaaacgtaagactgcctaacaatggcccgcaaggcctgacatggtcctatttctcattacgtctttgtcctccttctagaccctcctgtcctgtgctcgcttcccagccacagtggcttcctcactgtctcgggccaggcatgttccagccttaggcccttttcaccagctggcccctctgcatggagtgctcttcctcccagttattttcatgacttgtttccccacttccttcaggtctttatccagatgttaccttctcggtatatttaagatggaaattcctacccacaactccttagcttttttctctgttccttttctccatagcacttaccaataacctgaaatacatttcacatttttgttttatttattgtgtttctccatccactggagggcttttactggttttgtttgctgctgcttagtacgtaataggcactcaatatttgttgaataagtacattctagtatttttgtataatgttctttaaaagcattgtttccaatcagacccctttcccaatcagatattttaaaatttactctctttgcttatcaaacgccaaactaatgagcatgacatccattgccctccacagcatggccgcaggactttcccctgtccctttgtagcctaaatacccactactcttcagattggatgattttcttttttcatgaacatgcttgcttgactacatcttcatgctttttaatcatatttattgttcttcctggactttccttccgccttttccattttcttcctcgcagattttccttttcccagtattagtccacctgttaaaattctgcatttgcctgcaaggcccattgcagggctttctggacatgaagccatgccttcaatgggtctgaaactgtgccttcggggttggtctttctcctcctccgacaagcctagcacttacctcctgctgcatctgatattagttctgtgcttacctgctctctgttactagatcctaagtttttttccttgaacatcctaagtcagtaaactgtggttgaattttacttcactcatttagattcattttatatactggggtgtacattttaacactagtatttagaattgtgtactcaatgagaaggatcagccagatagagtgtttcatgtttattgactatacaaagctaattgtgggggaaatttgtaaaaacagttgaatttaaggaattccctttccctcttatcctatcatttagtttgaggccattttatggaaaatttccatttagatggaaataacatttgtgtactaattccatagctactatgaatacagtttaagattttaaggtttatattgagatactgtggtagtagaacaaaggtaggtacatgtcataatccagattcctatttttccacgtccagggttttatattaaaagaagagaaatttttcatttttgatttttaaaccattagagcagtagctgagcctttcaagtttctcagtcaagaattaggctatgagtagggacagttttcttctctgttttatttttatttttgttcccttagtgacattgcaggaatgctgctgaaatctacaggaagttttttagaatttggcttacaggagagctgtgctgaattttggactagtgcggatgacagcagtgcttccgacgaaatcaggttggagttgtgcttcctttccccttccacttcttatctcgtagtttccttcctcatggtgagatcctagaaggagccttgttcaaaccaaattgtgttggcctggaagaatttgggcagtagatgtaaagggatttatttataactgccttgtcttttcatgtgatttcttagttatggttttatgtgaaattttctttgaaggggaacttagaatttatttagtgtgataaaaatagtgccaactggctgggcgcggtggctcacgcctgtaatcccagtactttgggaggccgaggtgggtgaatcaccaggtcaggagttcaagaccagcctggccaagatggtgaaacctcgtctctactaaaaatacaaaaaaaacagctgggcgtggtggcacgcacccgtgatcccagctattcaggaggctgaggcagaaaatttcttgaacccaggaggcagaggttgcagtgagccaagatcatgccactgcactccagcctgggtgacagagcaagactccgtctcaaaaaaaaaaaaactaaagataaagagataaagttgactgaaaaaaatgagtagaattttctttatttacattgtctgggatgccttttatattagtttctgttcttaaaaaatctgtgtagtggtccattaatacattttaatgacatttggtacatttttattcttagtgcattccttctgttgaactttaaacttaagtgtatgaaactatggtttttctctgttgaatttcctccagttctgtgcagatggtatttaggtcgaaacttttgaaattgctactctttgtggtatatatatcaggcgtatagcaactttgtggccatagaatcagcaaggtcatatgagtcaaacttggcgaaagctcatatagaactgacttctccaaagcgaaaatgttttcgctcaccattcaaggtttgatgaaaaacacattttgagtttcagaacacctggtatgtttttatgccaaggttaaagaaagaagttcccacatggtttctcacctgggaaaatattgaatagctgagaaatggaataaataagtttgtaggtctcacagttttgagagctaacatggtgggttcaaaataaccccaagcatgtagattccaaagaaacatgagaaggcaggaatgaagatggtgaactagagagcggttccagttcagggggccatgggcagtggtgtgctggagctgcttctcccggcttgagagagctgatcatgcacatctcttcccatttcattgctcagtgacatcatactgctgccttgaaattagctatgatgggagtatttacaccacagaaatcggcatgcattacataagatagtaatttagggtcacccagttgttaaatatttcccagatcacactgtatagatttctttttagattacgagccaggagttaagaacttaaccttaaactccaagaaatgatcataatgaaatgttaagaaaattgagcttcctattatttgaaggttattaaatgtgccctgcttacattgaaaggatatgaatattttctacaaaactgtcaggagcaggcttctgaatgttttgactacatcttcaataatagtttgttcccatttaaaaaatcctcagtctttatttattactgtgatttggaatttgcttcatctttattgttaaatccctcttgcacctctggaatattccctaatgtgttctaactggacttgaatccacttggcaggaggtctgttatagagatcagtcgagccctgaaggagctcttccatgaagccagagaaagggcttccaaagcacttggatttgctaaaatgttgagaaaggtgagcttgcaatcctgattaattagtaccttttttcttgtttttcttttatcttatttttttaatgctaaccgtaaagaagtttctttgtaactgtgatcctaggacctggaaatagcagcagaattcaggctttcagccccagttagagacctcctggatgttctgaaatcaaaacagtatgtcaaggtaagtacttcaaatgttgtgattgaaacattttgcctttccttctttattctaaaacaggcagactttttcttgaaggtccagatagtaaatattacaggctctgaaggctgtaccacaaccccagttgtaagactgtcctgtaattcaccagtggaataatgaaacagtctttttcatacttgacttactaacttgtcttcagagtgtagataaataataaaaagtttactcatgctgtttattaatttagttacacatatttaaaataatgtgtataaggagataatattcattttaaattatggttttgtttttcacccttatatttcctgatgcagttcaaaggttttacagtgaatctttgacatcaagatcctggtcatcactagagccactttttgagtcagcaactttactccactttaagttgttggagatttagcacagttagaatccgtatgtgatgtcatcactggacattttatcccaagcccacagttgtatcccgctcccatactgagagtgggagggatgacctgcagcgtgccaccacatgtgtaccctttgagaaactgatctcaaggagccttcttgtgatgaacccctggctccctgccctggaataattagagaatctgtattaacaatttttgcctttttcccaagccaggtgactttttgtaagcatcacaaactagcagtggttgaggttctttcaggctgccttgcctccccgtcgagtattttctttgttgttgaaaataaagcagtgaggaggatgtccaataatcggggagactctgtaaggcctctcctccagtgcgttcacagactctcctcctcctgcctccttcagtcacactgaagccggctacctgcagttccctcactgctccaattcatgcccttcccactttccctttcccaaacctgcctctcctttcctaggtttgttttaaataacctatttctctaatgtacagtgttccttaagattttggattatgtcttttgcaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtacagctcatctccatctttgcagcagtgttacttcaaggacttttagtaagaatgaactgttagctgctcatgaatgaggggtttgactaccctagtaatcacaagtatatacttcccaaaaatatgcctcaatgtgttaataggtcattttgcagcataatttgtacaatatatcattctgttaagttaaattatactggaatacttgaaataaaccatctatctggtttatatcttttcttagttcagtcatgtagttagatctgtggagctatgatctaaaaggagttatgtcactaatataatttgtagttctagaaatcccagttctccaagtactcaggtttactggttatttaattttaattttttgtagtgaaggctatcccctccctacctaacagggacctcgtgacagtttctataactcattagttataaactatgagaagctttctcatttatctgtgttcagcttaggaacagtcatggtgagtgttcatatgcaccttgagctcagcctcaccagaactgagtatacactggcctgctgcatccctcaccccaacaactctgcttttatattccgtctcagtgaatggttccgcgttcactcacatgtttaaaccagaagtgtgacagctaatataaattcagcctcccatctttccagttaataccttgccctggaaagccagaagcatttccagtaaatgatcctttccctgcatccccagagcagctgctgtagtcagcactttaccatccctctcctgaactattggcagtttctgactttgagtttccctgcttcaaacctcaccttctgtctctccaattctgtgtttgtttttgtgcttctagaatgatcattataatacatctgattgcatcacagatctacttaaaatactgcaaagattcttcatctcttaagaacaaaagtaataaagtcttgatttcttaatgttttatataaggcccctcatcttatttctgtcttattcctacattttccttcttcatatgctgctccaatacacacacacatgcacacatacacacacacactcacacacactctgcactggcagtactgaactacttgaagttctaggatatctcaaagatgtcatgcctgcagtcccaaagggttcttctccgtggtgctgaatatcccagctgtcaatgcccactgaagcgtgttgctgtgtaggagaagctttgcttaaaaatgactttctgattagatggttgttggcctggtatccctgagattggcattgtttttggactggtgttgaactagaataacaactagtaactgggttggtttttatgtcctgtgcttgattttcctcccaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaaggtattacactgtcctctacattagctgagatttttcctttttgatgaaagtcagtgtgtggtaatgtgtgtaaggtaatatcatccaaggaacttgagctcctgaattgcctgcccactcacctctcttcccaatacatattttcttatgtctaaactacatattctgagattcttcctgaagctgtagaactttataattggaaaggatagagaattgaactttatgtgacttattcataatggctacatgactggttagtggcaaagttgaaaatttaataatttaggtctcttcattcccagtgtaaatttcattctcctttcacaatccccagtatttactagaggtactccatatcagcagtgtgtaatagaagatttatttattgttttgtttaataaataattcaaccaaattaaatataatagaaaaaagttgcagagaagtacaaaggcctttcaaagtttatgacaagccccagcctggctgtctttttccattatttcctgtttttgacactttctattttgtatcccatgtatcagtcttgatctcatccacacttttccaggccatcagttatgtcttctcactcacattaaggcttaacttcttgaagaagaaacattctctgaagttacaagtcatttcgtaaacacttgtttttcttctgttggtctgatttgtctgatttatctataaacatttattaactaaatatttaggttatctctctctatggattgctggaagaatattttgtaaccatagtaaggggattgcctgatggagaccttgtgtgcactcgtgtgtaagggtgggtagagagagagaccgatttggagctattgtgatgttgctgacagaggtgacaaaagctcgagccagggcagggcttctcagcctcttggatgtggatgtttgggcccgtaactcttggtcgtggagggccgtcctgcgcattgtaggatgtttagagctagggcagggcttctcagcctcttggatgtggacgtttgggcccgtaactcttggtcgtggagggctgtccggcgcattgtaggatgtttagagccagggcagggcttctcagcctcttggatgtggacgtttgggcccgtaactcttggtcatggagggccgtcctgcgcattgtaggatgtttagcagcatccctggcctctactcaccatatcccagtacttccactttttcctccaaattttgaccatcaaaaacttctctggacaacgtctccagacgctgaggggagggggagaaatctgccccagaagagaacccctggactagggagtagcagggaaatgaggacagcacgatcggaggaggtcatctagaagtacatggactttttcactctgtggaattgcacccgtacttatggttgagcaaccgtccaggaggagaaaacaacaggtggttgatgtataaaaatattgaagataaaagcatctattccaagagcagattataactagactgtatcattttaaatgcatttttttctcttctatttaagaatgccaaataaaatgacataatttcttctatatttggtaattcctttaccaagtggctgaattgtttgtagtggttaatgtctgtgtgatgatgaacgaaatcttcctttaaaatgtggtaagtattgtatgatttgcttcattttgcattaatcatggtttggactcttcagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgaggtaggttcaaaataagaggaaacacggtacaatttagtaattgcttgataacttacagaaagtttttggaaccttttacagtaaatctgatattgtaatcatagcttaatcaagaatatcatcttatatcactgctgtatatcagagatgttagtttacttttaaactgttaggtaattgtccaacttttattttgtgctaacagccatctacttacattttaaaactttaaagagatgttttatgtcataaaagcacattcttaatttaaactcaggagtaaaacatttatgaaactgcattttgaaacactgtactttccataattcttcatactattcaaaatatagaaattttaattggatttcactttttgtttttagaaaacattttagacatggcattatagtgtgtgatattatttaatgatcatttccttaatgttgatatacatgaaatcttcttacagtatcataaagaagttgttcgtttgatgtctggggagtttagacagaagataggagacaaatatataagctttgcccggaagtggatgaattatgtcctgactaaatgtgagagtggtagaggtacaagacccaggtaatgaccaagtaggatgtttctgaaatgtgtcatgtgggcttggtggtatttgttcatatatgttctgtgggattctttttgagcagacgacacagaagggaacactctaaactcttcggtgatcaggttttttttaatggaaaaatatgtagagaaaactgcgtaactcttgggaaaaaatttttttttaaatttgttccaaatttgagttacctttaagggaactcatgttctcctttgacaagtcttcctgatgactaatgtattttcctccctcatgaaatttattcattaagaaaccattttggaatttgcaggggtgaaatgggtgaatcgtctgtgaggctcaatactagctccactaaagtaaacatagttattaaagtgtcatgactgtgtgagaaatagctgagtgttctgtaatttgtaatggagggatagcatggggcactttcttaaagtcattaagcaatttctccaagttagagaaaacacatttgctgcatctgagattcaaagtaggaactttgtgttacaaaactcataaatacttgttgaattacaaataaataattgttgaattacagatggcacctatcatgtctaaaatcctcttccatgcttcccattggtttcaaaacaaaattaaattttaaaaaattattctcctttccaaaaggtcacgctgtaaacttactgaacccaagcaaaaaaaagtgtcttgtcctaaatagtaattataattatgttacttttcagtattgtacagtctaaaactgctacagcgttttcttggttgttatgtgattactgaactttttcgtgtaccaggtgggcgactcaaggatttgattttctacaagcaattgaacctgcctttatttcagctttaccagaagatgacttcttggtatggattattctaaagtttttttcattataaaataagccagtcactccttattttctggttgtatatgttttatatgtaataatggtttttttcatgagatattaatctcagcatatcatgtaatgataatgctgagaaattaaagtactcctcatagcagagtaagattttttttctttttgtaacattagtgttcaactaagtcaatgtctggtttgtaaaccctggcccttctaaaatatttgtgagatttatatttttactgccatcatagctgctgctttggggcagaacaaggattagctcttttacctcagtgtgcatcattttgagagcatcatgctcgtgttaaatattatcactgttagtctgataagtgtcatcagattagcatgatattgctcaaagtgtgaattcatttattttattctcccagtagtagagacgattacatgaaaagttctttgcttgtacacgttattgtgttatgggaaattgacagctaatttgcttttacttataaaaatgaaatacactgtattattttaaattacatacaatttgtgtttatacctattttcttttaaactaactgaaaatattttgggtagcatgtttttaaaaatatactgaaaattaatttgtgctacttacataattaagaaagtatgcatgttttctctttacctttcccattttcttttggtttctagagtttacaagccttgatgaatgaatgcattggccatgtcataggaaaaccacacagtcctgttacaggtttgtaccttggtaagacagccgttaacagcatttcttctggaacataatgatttgagtggacagatcctcttgtaattgcagtcgtttaaaatggtataagaggtgttttaacagtattcaggaaaacgacaatgagagggacagaaatgaggtgtgtagatagagaactccgcagcaacctttctaaatctgacaggaagattaaaacgtcagccatacgctattccataccagccagcagtattcaattacacatttctttctataccaacactaccattcttttttcccccttaccatcttttctgatggggaggaaagactggaagagggcgttgtctgccaagcaacaggaactgcccctgctgcaggtggctgcagatcacttccctgtcccccgttcctcacctttgaggagagcagtgtccatttctccacagctttcccaagtacccatcttcccaccagctgtagtaaattctgatttggttttactgtttaaaaaatcaagttaagttatgctgctatatatattacttcaattacaatttttggttacagtttatgtacaattttacagtaacaatgaatgattaacacttttatagtatatgttgaaatgttgaaaacaaaatatatgtcaaaaaaagctgtgtcttatgccgttcttgagatagtttgtaaataaaacaaaactgtatttgtaagtaataaacacccaagaaagaaacttagaaattttatgcaatttaaattacacaaaatataattcataaatggtaaatttattgaacactaactgtatttcatatagggtacttgctggctgcagaaaattcagtagaatgggttttaattgttggttttttaatcttcagtttatacctctttttctcccaaggttgtcgtgaaaatgaaagttaacatttgtaagactatttgagcattttatataaagcatgctattgtcttatcaggttattgcttaagctgtgaataattttgattttctgatatcctaaaacacttctctaagaacacatgatcgataattcagtaagaattactttaaaatattttattagataaggaatcattttcattgtggaaaaatcacaacatagaaaaagtatctagaaaaatatggaagatgttcatttagaaaatttatcaatgtagaaaaagattacaaaagacaaaataaaaatgactcatacttcctgaatccaaaggtagtcccgggtaacatctgagtcgctcatctttcaatatgcctgccactccaaactgcagtgggacagttaattaatagcgctctctggagactcacatggtcctttgtcctctcagtcactatgggttagtggaactgaactgtcgggggcctggacagcaattttcctggggctgctcatttaacatcattgagcctctctttttaatgaatgaaactggatgctaatgaggattaaataagtaataacaatgtgtaaattctagtgttccatacgcaacaggggtcatcatttggttttgtgttcttttcttacaaaagaaatgaatgaaaatgagagcacatcaactgtcattttgttgttattgttgcttactttcttcctttccctctgttgtaagcacataacaaataacaacctggtatgtaagcttccatattttctatagattcatatagtcacacaaatgcattctccctgtacctttctctgtgcccatttcatcacacagtcatatatagggtggttcgtttacaattggagaaatgtctccaagtcaacaggtattgatctcacttgttcttttcattggccacactgtggccgtcatgaatgtactgtaattctttctaccattttttgatgggcttttgtttgttttggctgtgaaaagcatctctataatcagtgtttaccagtagtgaaatttgaacatccattttgcttattagctatttgaattttctttccaatgaagtggaaagttttgcagtgttacatatacctactattaaaataattgttttgtttcatgcaaaacatgtgcacatggttttttaaacagaatgtctttatttgtaggaaaatttttactaatttttgactagttcccagtatctttgctcaattaaagactcaccaaatcttttgtttttttttaacctttgttactattgaatttcttccatttgttactattgaatttcttccatttgccattgtaatagctaggataatgaatcagagacacaaattgcctgagggttttttgttaacaatcccttaagttttgttttgtaagttctgtaagggaacttcagatctctccatttttactacttctgtctctcttgtttccccttattaataggaaacaaaatcatgaagaaacaggatttccatttaggataaaacctatttgggataaaacatatataaactaaaattattaacatgaagagaaactatgacattaaaaaaatactaaggagggttaaaacagagtggtaaaagtgaagaagagaaaagcatgttacggagagtaggcaaaatatgacgcatgtccactaatactgacatctagttattgggaaagtggaattatcagcatatttgtaatcactaggtaagatctctaattttaaattttatctagttttaaatttttattttaaattttattcatatttacctattaccagaataaaagaaaaagagaagaaaacatgctcttgaaaaaaatgactcagttaaatctacctgatctggtttaaaggaactgaataaaactccatgcactcaggacaatgacagtgacctcaaaggcaggacctcttgaaatgtcgccagtgaccacaatctttttaacgtgtagacaacataaagaactcctttttattagggagataccacattttcatgtatctctaaaatgggttaaatcatttgtttagcttacattatgtatgttttactccaggatttttaaaaatgttttttgatggagaaaactgttaatatataatagggctttactgacttttaaaaagtgacattttccataatatttgtatacgtaatattattttttacttatataaatggacttaccttggtcattggccagaataagtgacattctattttccatttgactgtttggtttgatgattttctgtggaccatattaacaagttgcatttgttgccatttttgctggcagccattcatcggaacagcccccgtcctatgaaggtacctcgatgccatagtgaccctcctaacccacacctcattatccccactccagagggattcaggtatttggtgcttatctagtcatttgctttacagagtgccctccgatatgcatgctcatacttttgaaactactagatgcttgctctgagagctaaataccttttctgcattgttcgtacgtaaaagctcttacttgcattatcttgaaacctttagtcgcaaaagaaaaaggcatgcaaatttaaaacagacctgtgcctttcaagataacttcgtttctcagcttatttataacctcaagctactacatgctttctggctgtggagtcattttttcctttcctgcctttgaaaaataaccttcggaaaacaaatttgaatatggatagtgtagtcaacatttgaaaacatactaaatatcactaaaagtggagaaaaactggaatgagctttccagattcaatttttatctgcatatgtaattacaaagcaacttaaacactaagtgaattcagaaactatagtacattcacgataactgccttgaatgtggtggcatttctgcatcttgaggtagtgagcaccttctctcgcctgtataatcagtttttaaaagtttaattttatttgacaatatttgctagataaggaccacagttttttgtttttttttttaaagctttgaggggaccggggtgcggtgactcacgcctgtaattccagcactttaggaggacgaggcgggaggatcacttgagcccaggagaacagcctgggcaacgtagcaaaacatcatctctacaaaaaatacaacaaagataatagctgggtatggtggccgtgcctgtagtcccagctactcaggaggctgaggcaaggaggatcacttgagcccaggaggtcaaggctgcagtgagctatgattgcgccactgcactccagcctggacaacagggtgcgatgctgtctcaaaaaaaagaaaagctttgaagttaggttttttcttttttacacctagactcaaatctcaaagaacaatttgcattttatatttttaaatatatttcacccccttgccatattttatttttaattgaaaacaattttcaagtccgttccctcttctcacatgtgttcctgaagcttttcttcttgtcttagcactcggagcatgccttccgacgcgcggagccatggcagccctgctgctgctgctgctgctgctgctgctgttgctgccagtcggcccagcccctctggtggtgactctgtgctgcccaaatccatcagcagtgcccatgataccaggtagtctcaccccaccagtgtcccgtaccctcaccaccccttacatgcgcttacacagcaaccatagtgttagggtgtgtgccggctgtggttgggcttctttgctgtggcgtgtgagtgatgctctagggccttccgcaggttgtcacggcccagaggctctggcactgaccaacacgaatggataactgtctgatgtcagtatttctttggagctgatattagccaaaatgactaaagactttgcgaagaataacttgatggagtatcataggaaaggactggtccacaacagaaggggacatgagcattttgcctcacagagagagcctggagtcacaaggtggttaaaagatggcatctagttaatgatctgatgtggtaacattttattttttgggaagatcagttttctagccaaatactctattttaaataattgttgattagaagtagtttatagaagtggaaaaatgagttcatggggtttgtatgtcatatggagaacagatcagtacttgagagaactctcagacaacttggcaagccccagaacaattaagtctcgcattgtcttttgtgtaagtaaggagggtcttgtaggttttcccattctggttatattttggcagaggatttcatcatgttctcctatcctaagtggaggaagagctgttgttctctctcaatttcacacttgtacctaagtaggaggaacgctgtcagtattcccatcttccaatgcaagtcaaaccaaactatgtaggttgggggtatgtgatctaaaaagatcaacttctgatagaacccagggctctgtgttcagccccgaggagaaaatagtagagttaacaggaagatgatgcctggctttagattttaaaacagactaaaatgtttttacacttactttagtaacagtctaaaatttctacaaatatttgcagtcatttcactcattaaaataattaatacttctaaattttagtgagaaatgtctataacctaaaaagtaccaaagcattttacagcttaagcagtcaactaaaaaaattaacaacattgaacaaattcccatttagcttcctagtttttacgtttagagcttttcatggcaaatatcttcatatatgcttttatatccctgtgagggctgccaaaactgtcttctttattcatacagtacagactgaagagaagtgatttggcctaaaacacagtcataattgaggagggcattggccaccctgtgccccctgcatcccacacctgctgtgtccatgttcacatgagactgctcccgaactggacaatagggagtgacctccctctttttaaaggttgatgcactgtgttttaaggcatttgtaagttggtagtgtggtacattatgtgtattttagtataagagttaaatactacagttacccttttcatggagtttagtctttgcagaagcagtttttcagcatttcatcttaaacgcttatcagtagcatttcataagtattcatcttaagtttgtacatacttagacaatcgttgatgtttagaaattttaatagtatcatagcatggtatcttgaaggacattttttactcaggattcccgtttactttatgaccgtctgtgtgtgtgagatggtaggtagagaagagcacagccacgtgaagaggtgtggggtggttaccagactccctcctgcattcaagccctgcgtaagcctcagtgccttcacagtgagcctggttcatgggcccgtgagtcactggtggattcggcccactgctcccgaggcagacttcacatacccaagggcttgtgtctcaacacagctgtgggtttgtgaatgtgccacggggaggcagaatgacaccagtgtgtgcatccctgccacagccatggggtgtagcccttgcccgtcttacagatacatcaaagttcaacttcacttgaccctagaggtttcaataagtatttttaattgattttacttgacctaggaaatatctgttctgggcttaagttatcttatcatcgtttgtaaaaacactttgcagtggtgctcttgctgaggcttgctcctgctggctctcaagagctgatggcgaatgtttgagaaattttgcaagttgttataccacagaaattggcaaactctacaacccacctccccatccccgacatcccccaccagagctagtcgttcaacattccccaatatgccacttcatgagtatatgttcttgctttttacccgtgcaaaaatctcttaaggacatggaattggctagtctcacttgtgggaaatcggaaaaattagaggtgtttagtgacttcttggtctcaccagtggtctttgttgctgcttaggagtggagtaggcttcctcacttcaacaccagtggttttcccgtcagatagtgccgaattttttatgaactatatggcagtagaaatgtccccatcacttcagacttaacaagtgctatactagatttgagggcttagggaaataccagaaaaaaatgcatattttataatttgtaaatgtctgtgcaatagatcatgttgccttcaacctatcaatgtataataagagcataaatgctaccatacttcattataccattcacttaaaaatatatactaaatgactttaataaactaatgccatatttatttgaggttctttgattattcgaattacaattttaacacattccctatttagttttaatttttactctttatgggttcattctggttgctgaacatttcactttattctggaaaagcacctcattaactttgttctttaatatattaagcttcctgctcttttgcacttttgcttggctactgcttgagaaacctttaggtattcccttccattttcttactaagagatttggaatcttttggaccatgaaatcattttagtactttaaatgtaattaagtacataaatataatttgatggtaactttaaagatcagcaagatttggttaataacagttttattcaccctgggcttaagttatggagcttttcacatgtcagtaacatttcaatagtgttgtgtttttatttctgttgttaatataagacaaggttttatgcaggcaggtgctctcaggctcgggtgttggctatggagagatgaaaatggagccctccttccagactctagagctctaacagactccagaggacggtctccacagcagcgctgttcacttagggggctgattctggtgggtctgtcctgtgcgttttccgctgcccactagatgccagtagcaccctcccaaaagtgtctaatacattgctggaggcagagttgttcctggcaggcagagttgcccccagttgagaattattgctctagaaaaatctcgcagatctttcattttaagttctattgaattgatagctcaattattaaaaatattaaaacaggggttccagcgttcctgaaaatgatcgattggcttccatagctgctgaattgcagtttaggtccctgagtcgtcactcaagccccacggaggagcgagatggtgagtgttttaaggtgttagctgcattcacaaccagtctaatcatttgtctcagttcaccagtttctgttgttaatgcctttatgaggattccttgaagattcctttttttggtcctttctaaaggaatgaagagtaagaagcacagagctttatgagaagacttactgctgagcacattggccttttaatacagatgcctttttagccctgttagcattttataggtctacttttgttgctttaaaaatattattattctagatattttaactgttgaatacttttattcatttaaaaaatacaaaagtgacactgtgtttgttgatcgtatgtgaaagttttatttataatgcagccctcaggaaccacattgctgcttccattggagtagggctggggctcctgaagctaacatcttgaatgaagtccctaaggaatccactttttgcacagtattctgttgtctgttactcgtgaaaagatgagtgtagttaaaatcctgtaaccccattaacttcttagttggtgcaatttttagaattgattgcaaagatagtttctcacacctacatcaaacacactaaaaattaataaccagaaaggcaaacaggttgcttttaaccattacctttcctttcagttgttctcaaataagcatatttatttcataaatcttaatttgtataaaaataacttcctgcagaaccagcatatccaagaggagattcaagtgggtccacaagaagaagttgggaacttcggacactaatcagccagagtaaaggtgagagaaagagtgttgaagttaaaaaaaaaaaaaaaaaaaaaacacgattacacataaggggagcagtttcaggtaaaacttgatttagcttctgaattattaggcctcctccattactattttgtgatctcacagctctgacatcactttctatcatgtactgtgtttgtgtacatttcctatttctagtaacaaactacatgctcctttgggtctataatatgttttactcatctttatattcttaaagcaacttagcataattttttgtccatggtaggagtataataaacatttgtgaaataaccattcataaattagacattgagggaaagaacttacgaagcatgtgattaatattatcaaaagaacaaatagcagaaaaatcattggtctagtatttaatgatctataaaatgctttcatgtctttttttgctcaacaatattgagcagtaggcaaaatagatgttctctttttataaatgatagtttctaagcagcccaataatttggccaaggtagtaaatgagagggtgaggaccagaaggcacttgtctcaagtctagcgcactccatggcagcttccctttgaactttgtgtgactgaccagaagagtatttgtcttccaaggcctagagatgtctggaaggattttgtggagggaggagactgggctggccctttgaagggatggcaggtctgcagcaagccaggaggcaaggaatagaaggaagtgtgcacccagaggcctcgtgactacaggggagagccactgggcgcagatgccaatgcaggagaaactggagagtgaggggagatcagatcatggacagccatcagtgactgcctaagtaatgaaggctttgcccagaggtggtgggcagccccagaggctcttgagcagctggtgtgtttgggatgtgggaggctggggatgagtaagacgctgagatagtatagtctgctagccagaattgaggagaaagtgggcagattggttaaaatgccattgcagaaattcagtataaataatacgatactggactaatgtgggatttaaaagaggtaatggcagcaagaaacaactttggtgcaaccactgacaagcctggtgacagagtaggtgtgtgttgagggttcaagtgggggagttttcctaggcttgagccgggtgacaggaagacagtttcttcagtggctcacatgtaatcagcagttcccacggataccaggtctttgccatatttttcaaatcaagtactttgtggtcaagtaaacttgggaaccacttggaattatgtttctcttgtgagagttacagttcacattgacatattaaagaccaagggctgggcacggtggttcacgcctgtaatcccagcactttggaaggccgaggcaggaggatcacctgaggtcaggagttcgagaccagcctgaccaacatggagaaaccccatctctactaaaaatacaaaattagccaggcaagatggcacatacctgtaatcccggctactcaggaggctgaggcagaagaattgcttgaacccaggaggcagaggttgcggtgggctgagatcgcgccatcacactctagcctgggcaacaagagcaaaactccgtttccaaaaaaaaaaaaaaaaaagcaggcacagtggctcacacctgtaatcccagcactttgggaggccaaggcaggtggatcacgaggtcaagaggtcgaaaccatcctggccaatgtggtgaaaccctgtctttactgagaatacaaaattaactggacgtggtggtgcgcgcctgtagtcccagctacttgggaggccgaggcagaagaatctcttaaacccaggaggcggaggttgcagtgaaccaagatcgtgcccctgtactccagcctggtgacagagggagactccatctcaaaaaaaaaaaaaaaaaaggaatcttgagaaatttttttttaagcgtttctcagaaatatttgtcagtggagcccatggcctcactgctgtcaaaatcttgccctgtgctgggtagatttgcagtgttgtatattgaggtaaaggaaacaaacttggatccgtattttaaataaatgagtgtaataagaaattataactggaccattataaatcttttagaatttctcttttcagattaaccttagagtcatcccagccttcaaggatctcttcatctgagccagaaaacataggctcttgggtagctaattaggatatggtatgaaaagtgttgtcatagagaagtggacaaaccatggttgtcaatttatgggttgtgaaccattagtgggttgtaaaattttagtaggagtgatcaacattttttaaaaaagaacaggatgaaatcagaatcacatgtagtaagggtaatagctcacagaactgttaaatgtgtgaaaggtatttcttagtatgagtcatgataaaacaagttggagaaatagagataaattgcctgtgggaaaatgaggaataatggcaatagctaatatttattgagttttactgtgttctagcctctgggctaaatgctttacaggtattatttcatgaaatcctcacagtaggtctgtgagataggtatttttatctttattttacagattaggtttttaatgtgtgaggaagttaattaccttgcccattgtcaaacacctagaaaatggcgaggccagcattttatcccaggcattttgattctagagccctttttctgtactcttcccagagaagggaaaatccttctcatcagagatggcttcctagaagaggcgtggcatttcagctgcactgtgtgagtaagattcactcaacagatactcaggtatgaataagatactttaggcagagggaaaggtgtaaaagtaatggaagtgaaaagtaaagtagtttggtgtgttctgtaagagtctttcagtttggctagtgtgaaaacatagaaaagacaaactgggtccaaattctgcaggggtttggatatttggttagtaggtagtggagaaccatgaactaagttttttggttttttgttttttttttttttgagacctggtcttactctgtcacccatgctggagtgcagtggtgcaatcttgactcactgcaacctctacctcccgggcacaagggatcctcccacctcagcctcccaagtagctgggactacaggcacacaccaccacacctggctaacttttgtatttttttgtagagatggggttttgccattttgcccagtctggtcttgaactcctaggctcaagtgatctgcccacctcacctcccaaagtgctgggattacaagaatgagtcactgctccaggcctcgtgaattaaatttatgtaggacagtaacatgatcacattttatgttttaataatatggcaaacaagagtgtggaatggagagaggagaaactagagacatgtatattactgcaagattttagccaacgttcttgggaaaggaaatcatttttgtgtgactagcttatattttatgtgtgtactgtataaggggtggcatatgctggaatgagtagcgtttgaagaactttaattcacctgctgtttatctgaatagataataagctttgctgtaatggagtgctaatatatattgctctatttttattggtttgtcttttggaaactgacttgataacagtgattgggactaatgaggttttggttctctctgcagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggtaaggaaattaaggagcatgatgtcaagatagtccctgttagaagtagcaatagttatacttctttaggttgaatcctatagagttggcccttttttcttgtagacatagcaagtatgcattgttatctttttgcaaagtggtctggattttttttggttgtttaatttgtaaaatgtattctaagagcaatacaaaatgagattttagaatgagaaagagatttctaaatgattcattgcattggattgttttgcttaataaccctggaatttgccagtggagaggtaccaaaatttgacccatttgttctagtttctctctctctctctacacacgcgcgccacacacacacacacacacacacacacacgcagaacgtgatttgaagagagactggatacaaatgagggcaagacagtcttcttttctaaaacattgcctcattaattaatttccaggtggaattgcttcatgtaaaatagtcgtaaattatgtgagggaagaagtcttgtgtttcagatcctttccccacttaaatatatttatctgtcacacatctaggtctgaagggggcgaacacagttgtatgaataatatgggactttgtcagcctgaggaaacctgatgtttccttggagctatcaaggagggcaaaaaccactgaaaacaatcaagtactttataaattggattaattattgttatcagtcttgtccaggcacatatcctcttgctttaatgtcccagaaggtatgttaggggaatgtttgctcccacacactcctggacatgtgccagtgaggaagacaatggtcaggcttagtcctggctgttttctgctgctcccagccccagccaagatctccttgaggggtgtgagggctcagaggtgtgcaccaaggctgcttttattggtcattttcatgcttctcctggaatttaccaaagtcggttctgctctatttaaagatacttgtaggtaagacatattaaagagattgcctaaaactttagttatcagggaacatttagaaaaattttggatcttgcaatagtaaactgcagtaaacataattatagatatataaatatacgtccaaaataattggacagtattattacaagtttaaggaatgtaagacagccccctgcagtggctggaagtgcagcttgtttgcattgttcacaggagaaggccagtatgggaaggtgtacacctgcatcagcgtcgacaccggggagctgatggccatgaaagaggtgagtcacctggctccgtggggcctttgggcctggcggctctgggtgatagaaattccgtatagacgctggtcgtgattcagttctctgtgcgtagagctgtcttcagcaccagcactgcgacagtcaggaccaaccaggcagatgcactgagataacacacacagacagtgaaggggcttacgattccagagaggataataagtcacagacagttctaacagcacaggtgtgagaagggcctatgagggtggcagagctgagtctgatgaaggcttagaggagaggattaacagtagtgtcttatggggacacattgggggagaagataacatttatgataagcttcagaaacaagtggcattgaaaccgctggaggtaggatggggaaagggccagggaacctgaagtagaaacaggactcactgctgtctgtggagacatccggtttgacgtggaaggaggagaggagtggagaggggaggctccagcgtcttgcacttgccgtggagccgcgtcctcctccacatggcgctcctcactccctctcggagcagggcctcttcctcctctgtgcccgggacctacccgcacttctatgacttcactctagcttggctaaaaacttcctttttacttaattttttgttgtttttaattgacaaatcatgattacatatatttatggggtgcaaaatgatgtttcagtgtatgtgtataatgtagagtgattaaatcaagccagttaacatttttgtcacctcactttacagattcgatttcaacctaatgaccataagactatcaaggaaactgcagacgaattgaaaatattcgaaggcatcaaacaccccaatctggttcggtattttggtgtggagctccatagagtaagccgaccctaatgccactctttgtgtgaggaatcagtgagggcacagaatggagtcctgttctacatcacaggtcttctcatttcagagcacagtaactttgcctaattctcaggaaatctccatgagttacatcatttctgccttctctctgaaactagaggagttcctcctaaaatgtaagttgtagactgtagtcattaacccgacatcataaagcactgaaacccatcctgccattcagaagattcttctaaaacgccccttacaccacttcttgtgactttttttccgtttttttgctgaaccactgttgagtacactgttaagtaatactggtttttttcttgtatgtatttagggagccattgtgaaatgagagaaaattcaaacctcaaattgagtttcctccttgtgtttagaaataaacacgtcgagggaaagaggataacttggagcatcgtggtgtagagcatgagcttccaggggaagttggaaatggatcatttttaatgtttttacaaattatgtttaaaaaggatgtgtttcagtacttaataatgtatttgtagggacagccctgttggtccctgtctgagattatatagcagacttaatttcagaggataatagaaattgatcccctgtgatttggagatgttcttatccccaagagctgtataattccagacagaggaggcaggcagacacctctatagaggacttagaaacgactgttgtgagacacattcagtgctcaggatggcaagtgtagtataccgttagaaagaacattcctttggggtgtggcctaggaagttttccagatttttcactagcgtacatctaaggaaaaccgtaaacacagagctgccctttattcctcccacaggaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtaatcccacacccgcctggctgctgtgggccagagccactggtacccagcccgtgggacgtgctctgaagacgctcatcccattcccacatatgatttctctagatggaaatacctttcattgaaatacgcctctataaggatcctgtattcagaaacaaggtagaactcatgtctctctacccaggagtccgctctttctgttcaacactgcttttagagaaatctgttttcccaaaatgaagtttgctatttttataagctgatttggcatagcccgtgtacttaccagacattcgtgatcaaagcaaccttttttttctctcgtgtcaggattcttgtctatttatatatgaaaatcatgaatatgtaaaccgacagtaaatcagatcagaagtgcacatataaatttgaggctacgtttttgagacaagaatggggtttgtttacacaaaccttgaaattgagttctgctgaaggttattttggccatgctgatggattaaaagtgctcttctcatagcacgaggggaatagctgggcttctgtctcagaacggtcaccgtggcatttgccttaaccacgccatgcccctgacctttgtatttgcaagtcttgaggataattaaaatggggaagtatttttgtgcctatttggccctaggctgaagagtttcattctgtcctgtagtctgaggctaacctaaacacattaacttaggaaccgacctgacttctgaccagggacaagacccagtgtgggaggttattttggattacaccagtctgctttggtctgggtgtaagcattgttcgtgctctgtaatgtggctcaccctgaatcacccagcatacaccggtctcattggctgcctgcctgtccgctaccttgctttggtgtctggggtcatcctgatgttggcttaactggctctgtaccaggccgtagcactgcctatttctagtcgttctgccacagacaccatcctcagtctctgtccactgtcacaaaatggtgtttgcacgtttgttccgtggcaggaagagactcccttagaatctgaagcaggtcagctcactggtgtcttatccaatgctttctagttcagcatggctaagaaggtacagatgtacagtcgctcgagaagatcaagctgcccctcgtagtcaattgtggggagcatcaactctaggagcactgagttatgaggattcgctgttgacctcagctcatcagatggctgcttgtctaactccattggctctgtgttgttgcttttcgaaggaggtaccatagaacacaatgccagagatgtgtgacttagttggagcaataatatcttgcagcctagagcaaaaggccaagctgtcctgagagatgaacagtattcccaaattctaactagactacaagttaagcatatatgttgcttgtaggaatatttgaaaattgcagaacagttttcagtcacgtcatataaatgcaagggcctcagctgggactctgaagaactgcagtgcgtgtgcagctctcatctacatgtcgcttcctgtttcagacgctgctgattgtacacatctctcattctccagactgccaccacaacaagcacttgtgttttgtatgcagtttctttttaagtatctctgtgggttattaatgttagaatgtatgcatgtatttcagttcagaatttattggtcaaggctacctgcactggtgttaaaattttgttgctttttattaaaatttgtgaataaggcttacaaatcttcctatgattacactttgtaagtcaagtttcataagcctttcgattgtttagcttgtgaatgaagttcctggtcgtttagattaccatgtaaccttgcccacattgtgtttcagaggctgcgtaacaactacttcttttctttttaggtgccaatatcttccttacctcatctggattaatcaaactgggagattttggatgttcagtaaagctcaaaaacaatgcccagaccatgcctggtgaagtgaacagcaccctggggacagcaggtagggaccagcctggttgttctttgcactctgacttcatgcagcctgcttggggcctgcatgttcccttcacctttgtttgtcagtagagatgggagagcaggtaaaggttttcagtcgtgagaaggaccacttcctcacacacttgggctcccacgcaagagcagctgtcacattggtgaattaaatgactccttttaggttacaggagagaggaaagcctctttttctcaccagaacaactcttttgttgtttgcattgtttttcttaaaacttaaaaaatgtagacattgtttgtgctctgtaatgtggcttaccccgaatcactcagcatataccagtctcgttggctgcctgcctgtccactaccttgtctaaacaacactatgattaaatggtaatgattcgttttgatcacttagtgccatgaaattttgcctcctcctttgcaggttaaattttctattttcattgtgaatacaattaatttgaaaatgtgtacattcaaaaatagtcttttaaaagagaatttgtcacctaaaaagtttgttcaacaagttgacttgaactgtctgtaaatttttgatatttcccattacctaatgcaggaagataatattgtacaatattaatttattgcttggctctattaatacatgttgatgtgtttataacccattactctcaacatatctgtgacttttaaagcatacatggcacctgaagtcatcactcgtgccaaaggagagggccatgggcgtgcggccgacatctggagtctggggtgtgttgtcatagagatggtgactggcaaggtaagcggagcccccacacctggcggagcaacttcagaagggcactgtgcattaacagaacagtagttatggattgattatttattacaaacactgtggacactaaatagcgaacgatattagatacaaaaatctgatccatcaaaagattaagacaaatgacaaaccaggaaacaaatatttgtaagatatctgccacagagaactcttatgagtgaatttaagaagcataaacctctaattaaaacacagggaagcaagcagttacaaaaagcaacattaagttggaaacatgtccacacaaaaacccgcacatgaatgtttacagcagctttattcataattaccaaaacttggaagcaaccaacatgttcttcagtagattattcatacaaaggagtatactgagctttagataaaaagaaacaccctgtcgagccacagaaagacatggaggaaccttcaatgcatgtggctaagtgatgaaagatgccagtctaaaaagcctgcacactgagcgattccatttaacgacattggggaagaggcaaaaccacagggacagtagaaagatgagtggttgccagggacgtgggggaacagagagacgagtaagtggagtacacagaatttttaggggagtaaacctactctgtaggatacactgatgatagatacatgttagtatgtgtatgtccaaacccatagaatgtgcaacagagtgaaccctgatgtaaactatggacttcagttaacagtagtgcattgacattggttcatcagttctaaaaaatggagcacactaacgcgaactacacatagtagaggaaactgtgggacagggagggggatatgggaactctctgtaccttccagttaatttttctataaacccaaaactgctctaaaaagattgtctgttaacaaaagaaaacatgaaaagatgacagcctcattaaccagaattatatatttaaattgaaatcatttttttttttacttagcatatgagtgactttttttttttttttttttttttttgagatggagtctcgctctgtcgccaggcaggagtgcaagtggcatgatctcggctcactgcaacctccgcctcccgggttcaagcaattcttctgcctcagcctcccaagtagctgggattacaggcacctgccaccatgcctggctaagttttgtactttggtagagacagggtttcactgtgttggccaggctggtctcgaactcctgacctcatgatccgcctgcctcagcctcccgaagtgctgagtgacatttttaaagattgagaatactatcttttagagagtatataaagaaacacacatgttttggacagaaattccatgtggtagggctgctccggagacatttccaatctctatcaaaattttaaatgtgcatagcacttaaaccaagaagttttctgcttctgaaaatgtatcttatgatgataatattaatgagcagttatacaaatgtaaaaagacacgcatgaactgcacatggtagcttaccgtacacatacagtattatagcaaaaaagttagaaaccttcatttctaagttaaaagttagtgttaagttactagtaggaaatcagttaattataatgtagctatgccttgcagctgctgaaacagatcacatataagtgctcagtaaatattagctagcattatttctattagcattaaaatagaaaggcagttgtgatatctgtgttattccagtaaagccacacataaaagaacaggttctcatattgaagaatacatattggcaatgacgaaacaatagtttagaaattagaatgccatacacacttagttccttcccctgtgaatctcatttttcataggatcataatgaaataagctttgcactaatgcaatttttatttttcaataaggtagcatattaaccatccctataagagaattgggttttatagacttttttatgtcattttatatattttttagttgcatgatgatggcttctagatactgttggactaaatagtgcaccccaaatggagtaggcaaactatgctggccacctgttttataaataaagttttgttggaacagtcatattcatttatgtgttgtccatagctgctaccatgctgccatgagattagtgaatagttgtgatagagatcatatggcctgtcaacctaaaatattgtttggccctttcagtaaaaatttgctgtcccctgatatatattaatgatgagatgcttaaaaacagactgaacatttgcgttgtttgtggctgtgtaatattaaaatctgattttttaaaaacatcttttttagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttggcagattactggatagtctttttcatgtttaagtgtttaagttctgttttgcatcaagacgttaatgaaattttgaaactttaaagtagctatatctgaagtggaaaggaactaaatgtattattatgccagggatttttgtatgtgttttttcatttggaaaatgttcattgaggttcttccacttgatctgttttgatggtgcatttaagatacaccagagacagtaaaatggacttttagatgggactggatgaaagagtttccactcttgagagtgtatagtctacttggagggtcaagacggtaatgactaatcattatactgagagctgtgataatggtatataaggttactcagaagaggaatttaattaagtcagccaatctcagttcttttttctctagaatgaggtaccttagttgtttaagagccacagccaggtcagaagtgggggagggggcatggaagacaaagtaaagaaacttggaaacgctcacccttccgggagagtgggatggtcacagagccctgtgtaggtagatcctggtgaacacaggatgtggacaagggcaggaagataaggctagaacagtaaccaggagcaacatgaaggagtttccattttattataaacataaatgatgacatagagttttagaaagatcactctagaggcaaaggaattgagaaggttctgatacagccaaggggttgggagagggcgttccgggtgagtgaacagcggcatttaagagttagagtgccgtggctgacccctgattggatgtgaaaggtgagtgaggggaggagtctagagtggctcccaggtttctggtttgtgtcatcaggtcacagactctatttgccagggtagggaaagaagcagctgggtgaggggtgggtcgggaggtggtgggtcctctttggtggatgaagcttggggtacatttggagcatctgcttggagatttcacatgggcatttggatacctggggctggcactcaagagggattttgggtagggcacaggtgtgggagacagaagtattgctgggagggtccacagaggacaaggggatgagaacagagccctggagaaaagagccttgcaagggccctgcaggagagagtccctgggaaaggaaaggaaggggcagaagagtggggtgatgctcttattggtaagtgggagtaaggggcaagcagcaggatcagctatggagacattagggatttgtaattaaataacaatttatgtcttagttatgaagtgcataacaatttatattgacctgagagtgcatataggcgttttagaaaatgctttcattagtcagttcccaggcttaactttagagcagtaacttacctctgccattgttcattacatttcttaagccttgccctctgtgcccagtacagtgctgggagcatcaggatgagtggatggggccttccccgtaagactcatactgcgcgtatgcacaagcacacacctggctctgcaagagctcagctctctcctgcttcctcacaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaagctcagttatattgtcttttaatggttaacacttatgagccaacgcagtatgatacagaagtctgtcattttcactcatctgttcctcaaaaggaggagcacaatcacgtgtgctaaagatggtcactgggttcggcgtctctttaggatcgcctcgctgaaaagcaaaggaaataaatgaagcaacactaatgacgtaaggtggttccttttaagtagtttctattaaccagcaagtttataacagatacaagtttaagccttgttatcacatgttgggagttcactttatttttaaaccaagatgtttaggtgctaggtcagtgtaaatactgctgaatgatctgatgagaaagcatctttttcagaagtaaacatttcagcatttagctttccaaaacagcccaaattatacatcattggtgttttttttgtttttgtttttgctattaaattttttaaaaagattgaccatagagcttcctgaaatctttttggaagatcactgactctcactccttacacatagccattgaccctgggcaagtaatttctcaagcaggttttgtattaatcttccttcagaagagtagatcccttcagccaagaagttaatgtccagagaatattggcatcacaaaaggatttatacaaccacttagaattttaagacttcttaaaatacagctttttgagttatattttgcataatatttgaagggtacaattcagtaacttttagtatagttacatagttgtgcaatcatcaccacagtccaattgtagaacattcccataacccccaaaagaaatctcatgtccatttgcggtcactccccattctcacccctagccttaggtaaccactaaacgatttcctatttctatagattttcctattctggacatttcatatacatagagttttataatatgtggtattttgtatcttctttcacttcgcatatttctgagattgatccatgttgtagcgggtttcagtacgtccattcctttttattactgagactgttagactgccacacatttatttatccatttgctagttgattgggttgtgcccactttttggttattataaataatgctgctttgaatattcccatagaagtctttgtacaaaaatgttttcatttttcttgggagtagatttgctgggtcatgtggtatatctatgttcaacattttcagaaacttccaaactgttttccaaagtggtacaccatcttatacccccactagcaatgtgtgagggttccagcttctccatcccctctccaatacttgcaattgtgcttttttttttttataatgtccattctagttaatgtaaagtagtatcctgttttgatttgcatttccctaaacttccaaactgttttccaaagtggtgcaccatcttataccctccgactagcaatgtatgagggttccaacttctccataccctctccaatacttgcaattgtgcttttttttgataatgtccattctagttaacgtgaagaggtatcctgttttgatttgcatttccctaatgatagtgaacatcttttcgtgtgcttgttggatatcttctttggtgaaacatctattcaaatcattttaaaattgggttattcatcatcttattattggtttgtaatagtttttttatgtgttctggatataggtccttacaggacatatgatttgcaaatgtttttttttccccagtctgtggcttgtcttttcattttgttttaacaatgtcttttgaaaaagtactatttaaaaattttttttgaagtccagtttatcaacttagtccttgttgcttgtgctctcgatatcatatctaagaaatcattgcctgacccaaggtcacaaagatttacatctatgtttttttctaagagttttggagttttagcacttacattaggcctgtcatctatttttgattttt

SEQ ID NO: 12545 - DNA, 163662 bp, Human
  misc_feature (1)...(163662): n = A,T,C or G
tgagatgtggctgcaggtgacaggaggagagaggttcaatggcttgtttgctgatgaggacgatgacacaactttcacagggttccttctgttcagcagccagtgacagaggagagtttataaatctgccagaccatccatcagaatcagcttgggatgaacttattcagatggttttactttattaattcctccaattattacaataatcataaaaaggtgaaaacggaaaagttattcccaaaactgattctatgtaacttactatttttccaggagtaaatatttaaaatagctgcatggtttattctaatttatttcacatttcttattcctattatctgaagaatcctttgtctgtgcatttcttgtgggaagagtgttttgatatcattttagtgctctgaggagtcatatgaagatgtatccctcatctgtgtttctgaggacattaaggggaaattagagggaaatgtttattccatttagtactagtaacagctttaagctggtgatgctgtcacactccagaaagctgtagacactgctcattttgtctttttttaaaaaatgtatttttaagttctggaatacatatgcagaacgtgcaggtttgttacataaaaatgtgctgtggtggtttgctgcatctgtcaacccatcacctatgcaggtattaagccctgcatgcattagctatttgtcctggtgctttccctcccattttgctcattttctaacctaggttttaatcaccattctatccaacaaatcattgtttgatcattatttgccagacatgaatctctacttgttttctaggatcgccctaataaagtacacaaactgggagtctttaaacaacagaaacggactttctcacagttctgtaggctggaagtttgagatcaccgtagcagcagggccatcctccctccaaaggggatacaggaggatgcagccttgctgcttccagcttctggcagctggtggcagcatcactccagtccccgcctccatcttcaggtggctgtcctcctcctgtatcagccaaattttcctcttcttacaagaacagcttccctaatctagtatgacccatcttaatcataattgcaaactccatattttcaaataaggtcacatgtacaggcaccgagggttaggacttcagcatctattttgggagacacagttcaacccaatctgccctctggttcccaaaattgatttccttctcatgtgcaaaatacattttcgcaccatgtcaacattaccaaaagtcttaacactttccgcatcaactcctctcaccatctacatcatttaaataagctacagaggagacttactgtgtgattcatcgtgtggcaaaatgtctctccatctgtgatcctgtgaagcgagacgagttaatccacttctaaaagaccgggggttggagggggagacaggcatagggtagacaatccattccaaaagagagaaaggggaaggaaaaaagggttcacgggtcccaggcaattctgaaaccctggagggaaaatcccattagacttctttcactatttcccatctaaaatttttaactgagctatgcaagagtaaaaagttaccggacagagacaccaaacagagaagtgcaggataaatttaccaagagagtaggttaaaagggaaacttctccttcaggcctatggtgggcatttcttgtttactcaagtacctgccgtctctcaaagaatatctaatgtccactggaattcgaatatgtcatgattttactcgcgcccacccctagtcaacttgggagggaagcgcaaccctagccttttcttactctggacacagggggcggtaaaccgggagggcggccgagaaggcgagggggagcgacgctcttgctctctggacgacaacgtgcccacgtcctgaggccgcgcccagacccggaagcggggccgtcacgtggggcggcgtgggctgctgccttggaaacgcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccgggtgagcggcgcaggaggagctcccctcagtccccgagctaagccgacccctgctccgcgcggccagcaacaatcagggcgagattgtttgggcctgggaggaggcgagcagcgaacccaccttttacagtggcgtcttgtgtgcgctctcgatgagggcaaggtcacctctgctttgaggggccgggtttagtggtctcctacccagagtgtcgggtccgggaactgcttctgcatgagccccttgctccacgtgaatctgaatagttcgttctggcagtggcggtgaattcgtcctgccaggacccgccctctgcatacactcaggcgcacccctgctaaagccctttagctccagcgctacagtcctgccttaagaggcctatccctgtgcgttcacaggcggcatcacatggtctttttgcaaggacacggctgcctgcagtcgagtaatggtaatttcattaatacctgaaattccatcatctattaattaatttatttcaaagctttgggctttcttgttttaaaacacaaaactctgttgagacgagtctcacttcccatagtgccatggaattggtcactttgatttcttaccccaggaagtcactagcctgcgttgtctagtgaaaggtgagaggaaggcaaggttggaaaggacttacctgatgcctgttctacttggagtttgtacattttgtccgttttaggttaaggattacttttatttttgccttttaaaatttcgttatactgtattgccttataaagacaagtctagggtattgttgcactgagctaaagtgtgtgattcttgttttatctccattatcagttttgtctatttaaaaattattttgtgtgaaatttgctacaccaccttccttaagggtatgtagtgttggtattaacatagttggtgtgaagagacctacttgtaggcgctgagcagaaagacgtgaggggaagcctgattttgggtggatgagatataactaattttagcttttatttttccctttttgtatcatgatattcggcactgatagcagattttcaaattttagaattgatttttgccttgaaaaaaaaaaagccttattcagttttttagcattatggtcactggtaatccgatagttagaattcccgagagcaatatgggcaggttgtactgggaagtggaagtagtctgtgcttgaatcaaattaaatcagtataaagatgacatttgtttttggtcctgattttcctttgtctcccactgactttcttttattttattttttatcttgtaatatattttgaagagagattactagcttaacttcatccatcccttcttgtagaaacagtagggcttgtcaggcctgaaggtttacctgttcgtatttctgaaaatctatgcgttaagcacctacaaagtgaattaacaaagcctagcatctgctccggtcacttgtttctttcattgagttcccccatgtgttagacattctattggatagctggttaaagaaatgaagggcagggctcttgggtctggaagctcaccttttcaggagagaagactttcaaacagataaattgtaatagagaagtatggaaaagtgtgggctttacagatgtacagagcgggttcgagttctgtctttcccaatattaatttgtgacctcaaacaagttttttctaacgtcttaaagcatgtgtcctgatctgtaaaagaatgatactctgttctgtaggattgtgtgatttaaatgagaacctatgtaaagtagcaggcacacttcatggtatgcagtaggtgcatattaaatgctttttccccctgccttcctgagtgtgctaacaagtgtgattgaataggtaacaagagaatggtcattaccattagatcagtgatttttgtttttatcaagatattgaaatgtctttgtaacgtataaaatttgctcccagtttcagcctatgattttaatatgttcattacatttttctaaaatatctattgcttcatagtcaactcatcctccctatttgatagttatagaataattggtactatgtactgagatctcaccttgtcagctgctgctgttagtactttacatatacttattacctgtatccatgctgtaaggtatgtatcgtcattcccattgtacatgatgaaaaaaatatttctcctaggaggagaaataacatgaccagggttataagctaataataattatggctaacatctataaatgctctgtgccaaacactgctttatgtatatatatatatatatttacatatatgatctcatttaatctttgcggccactcttaggttctgtagaagtgacagctggattttgaacccataccattgttgttgttgttttttccggaaaataattaaaaattgaagaaaaattatgttctgaaaacatttttagtgtaatttatgtggagtgatatggggagtatgatagtggtatctgtgatcacaggtataacatgatacaccaatgaaagtcaagatctcctttgtgataaaagtaattttagtaaatataaaaaaagcacaattttgaattttggttataaatcagacgtattctttggttctaagggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggtaaggtgctttacctcagacttgaagctacctctctttcaacttgttaaaatttaagtgaaatttatcctttgttgtttactattaatattagattataaagttaaaaatgtctgaaactgagatccattgggtataattttttatgatgaaatatgtcattaggaatgggaaaatattataggaaaaggtgatatttagaacttgtactttaatacgtatgtttaataaaatatacatgtaatatataatgaatgaatactaatatagcaaatatttgctatatttgggtaatatatatttacatatatattcatttgacagagattcttcatttatgaaagtgtctcccaaaattctaagaacactttatgtgtacatttacaacaaaattcccctttttcttttttttttttttttaatagagacagggtctccctgtgttgcccgggctgatcttgaactcctagccccaagtgaacctcctgcctcggcctcccaaagtgctgggattataagtgtgagccacttctttttcataagaggtgtgaaaaccagttttaataaaccttttcaggaatgcttttttttttttaattaaaaaccaagttttgacatcaaaatgattgtaaagactttttttttttaacattttaaatttgaaatagaagtgtatacctagatctcttcagcaactaggaaatccattgctgagatagcaaaattttcttttttttttatttttaatttttgtgggtacatgtatatattcatgaggtacatgagatgttttgatagaggcatgcaatgcatagtaattacatcagggaaaatggggtatccatcccctcaagcatttatcctttctgttacaaacaatccaattatactcttctggttattttaaaatctacaattaaattattattgactgtagtcaccctgttgtgctatcgaatagtaggtcttactcaatcttcctgtttttttgtagccattaaccatccccacctcccccatgccaccctgctaccctacctagcctctggtaaccatccttctactctttatttccatgattcagttgtatctatttttaggtcccacaagtgagtgagaacatgtgatgtttgtctttctgtgcctgacttatttcactaaacataatgaccatccatgttgttgaaaatgacataatctcattcttttttatggctgaatagcattccattgtgtgtaagtaccatactttctttatccattcatctgttcatggacagttgggttgctttctcatcttggatgttgtgaacagagctgcagcaaacatggaagtgcagatatctcttcgatatactcatttccaggaagcagggtttcctatcagcttgaaggagctgactcttggttactcttgtcaaggaaagcagcacacacaatttaaatagtgatcatttatgatcctgtctacatggtatagaactgcataggtttttccctcacattcagtcaatgttgagcacgtactgtgtgccagacactgtctaggcatgagggatacatgcaggaatgaaacagacacaatctgttacttcatggagtttatattctggcattaacttgtttttggaaatttaactagactgtaggccctttctacagcctagttagctgaagaagctttccctggatgagctgaggtaaccttctcagcatatctccattttcacaagagggaagaaaggcactgggtgatgaagggatgtgcccgctgtcagctggccagcgtgtggtgcagctgggctgccagcccaggcagggtatctgtcgagctcttcttctttctcctgttccaaccatttcagggctggctggctgctcaggtctcatgaatccttacctggaaaggttgcaaagtttgttagcctctccatctttaaaaaaaatgtatacttgtttttaaaattattatacagtaaaattgacttcttttggaggatggtacagttctatgaattttaactcgtataaatttgtgcagccctcaccacaatcaggatacaaagctgttccatccacccccaaaaatctccctgtatagccacacccccccccgactaacctctggcaaccactaatctgttctctctccctatagctttgccttttctagaatgtcacataggtggaatcctgtatacctttgactgacttctttcacccagcataactcatccccatctttattttttttccttttttggaaaatttccttccacccatacaactgatttgagcattaacacctttcagatgattatatgttcaccacaagcctcccgctcttaagaaaactgataaagtatcttactgtaaagggtttttccctggagtgaagttgcaggctctgagtagttctgttgtactgggtttttgttctgtgcctccagtatgtgcataggaaatgtgtctttgaatgatggggaagctgtggaaacgcactaccaaaaggaggtttcataccctgttcacctaattgtgtcacagaaatcagaaaaggaaaatctgtgtcagtgaatttcactgtatcgtcaaccctccagattgggggatctgtggagtcaaccaaccttggatcaaaaatatttggaaaaaaaatttgcattcatactgaacatgtacagactttcttttcttgtcactgttccataaaacaatacagtgtatcagctatttacatattgtttacattcattaggtattacaagtaatctagatatgatttgatgtatggggtgtgctgtgtgtcggttatatgcaagtactacaccattttatatcagagacttgagcatctgtggattcgggtatctgtgggaggatcaaaccattgtccattgatactgaggggtgacttggcgtggctgtcacaaatcccagaattcactgtgtatttgttgtcttagtcttcatcttaatcagtattctaggatttttttctacatttttgcttttgatcttcactaaaagattttaacttctctgcgctatatcttattttgacatttttagtatttatcatgtataataatatctcattttgaaaacttaaaaaaaaaagatgtgatttgtatatgtagttctctgggtataaaagaacctttctctgttctgaatttttaagatattacctgccagtaagattatctgaatttttaatatcttaaaaatatctgaatttttaagatattacctgccagtgagattagtactgttataaggcaatcgttttataaactgtttttcaccaaatagtcattttattttgttttcttttttaatacagtttttatgtaacaactgttttcctcatcactattacaaatcagtttttaatatgtatgctagtgttttgaattttaatattgattataaattcacaacccgtagattagtaatttgtaaaaaaaaaatgttgtaaatttacataactcatttttcaggtactttggtactaatgttattttatcgttaccaattgttacaacaaatataccaaactatggatttaaatgttttggcattaaaaactatttgataataaaattaagaaattttatcttgtggtgattttatttcatgttatagtcacattttcttggcaaataaaatatgtagtgttttgtagtttctctgctttttgttacagttgacatgaaaacaaaaatttagttttacatcattttatctttttaaaaaagaactgtcactcattttaatgtctaatgacttaagtagcagcagcagtagtagctgtatacagtattacatggagactacgaactcatattttattgaaaggactatgaagagaccgtgcctttgttttctgcacaaagactaccatgtagttaaatcaaagactagaatgtagttaaatgggttttgaaactatactatgtgtcagttaaaaaaaaaagcctttaagagttgttttctggagataagttaacatgtgaaaaccatactgcaaagaattttagccagaaagttgtagaatatttgaaaccagtgtctgctcttttgaaataaagaattagagggcgtggtggtgggcacctgtagtcacagctacgtgggaggctgagacaggagaatggcgtgaacccgagaggcggagcttgcagtgacctgagattgcgccaatgcactccagcctgggcgacggagcaagactccgtctcaaaaaaaaaaaaaaaagaaagaaagaatttgcttggtgtttatatttgaaagagaaaaacttttctgaaataataaaagtctttttttggagtgaaacaaacttggtttcaaggaataacagaattaaatgttcagaaagaagctgctttgctttactcgcttaggaaaaagtcagtaatggaaatgcatagggcaagccaatggcacatcttaaaacccagttttcattttcaccctcagatcctggaagaaagcttctcatcaaattcccttttggttttgtctttcccctttattaggctgattttgtgaaaatcgctcaccctgagccagcattcagagaagctgcggaagaagcttgtagaagtattggcaccatggtagagaagtatgtgctgttcccctccccacctccatgccaagtcctgggtgatccggtttcatggacttgtgccgtaggcagttttgtccatagtgcttgtcccccgcccagcagggtgggaggtgtgtgtgaccaggggtggccggagggaggtctcaggacaggccattggctcaccttgcaggcaggcactgggcctcagggctggttgtctgttctctcagtcatttccttctctgtaaatggggtcataaagttaaccctgcctcagggtccttgtgagtgttaaatgagatcaatgtaaaggtgtcacttgataatctgagatgacagacacccaggattcttgtcatcaccattatcacttaccttaaataagggctttttagtgtcctagtggcaagttggacttactagattatcgcttgattaaattgctgttgcatcaatggctgtgggccacggggcgagaagccaaaatgctctataaacagtgtccttgtggtccctgttgagttggaattaggggagtctagggaggctgtaaaagtctgtgggagggctggagcatgctctggctgaggctgtgatagagtgaattattttaaagtgattttggggtaaatgtgagtatttttaagccacttataagagctccataatgcttgttaaaataactgaatggtggacagcgctgtattccaacacacttagctgcatggcaccatgccaggcagtgtatagagctagggagagccctgggctcgccagcgtggatttacaacagggaaaagggggtaacacgataagacaatttcatatgccagaaattgttggaggaggagagtgatggcttctctggttagacgaggcttccttggaagacccaacgcttcaggatgtgcagctgctgcttttccccaggtcgccaacatttgttcactttggcacaatcgtgtgtgactttccccatagccgctgaaaaccaacttgcgtaatgggacagaacggggccctgcagagtgcagatactgggcatgctgacagggctgaaagtggggactcccctgggagaaagctttgcctctcggggaaaggcccctgggaaggagtcagcagtgggctgcctgctcgaggctctctgcatgctgtgtcctgccgaattagacgtgggctggtctcatggacaagcactcttcattttgtcggaggacaaatacagactgaagtatgggctttatctcagggtcttccaacataaaacatactactgggagatttccttaaacctctgcagtgggggcagtgcgggcagcctctgagctactgttcctttgccatggagtggctccgtgggtgagcaggttgggaggaggtaggcctccacactcactctctccctgacttctgggatccgtgtgtgggagtctggcccttcttggtgagtgtttttttgatgggtaatgactatctacgtttcactagtatttgggaaggcccatgagaatggtagcagaaacccttcgattcatataaatcttaagtgtttttttgtgaaccaactgaggaacaggagtatccttgagtctctgagtagcgactggtgagtggttcttacaaccttatccctccttgaagacctacccagcagggtgcagattgtatctagacccagctcactatttagttttgagggggccatggcatttgcatttagggaagaggactgggttcctgctagtggtactatggggtgggttgggaccactgcccagcattgggccctttgctctctggatggcacaactgctcaacagtggccatggttcattcacataggaaatgtgtgctgcacacatgatctcatttaatcctcacggcagcctaaagtctaaataacgtgtccaaggtcccacagcagtaacaaggccagtcttgcatcccagttgggtggctctgaagcctgtgtcctgagctctcccttacagtgtttttaaatttaaaaattagctgggcgtggtggtgtatgcctgtagtcccaactgcttgggaggctgaggtggaaggatcacttgagcccagaagattgaggctgcagtgagctgtgattgtgccactgcattccagcctgggtgctgggtgacagagtgagaccctgtctccaaaataagggaaagaaagaaagaagggaaggaaagaaggaaggaaggatggttacactgttcctggtaggttatgctgttcagcttctgggcatgtgtgtggtacaagctgacaccattcttttcatgtaaagttaaaaataaggtattagaaaatcatctaattttttaaatttctattttttctaggttgaacacaaatgtggatttatatcaaagtttgcaaaaattactagctgataaaaaacttgtggattcccttgatccagaaacaaggtactcactcatttctttgccttgattgtgactgtgactctagaggtgaggttgggagactctccctcagggcctctgtacttgcagcctctgttgtctggaatgttcctccccaggtatctctatgactcctgcactttctctaggactccactcaaatggtgtctcctccaaaatctttgcacagggtcagactctaccctctgatcctgatttatttttcttcatagccctcgttccttccaacgtatcctgtttgtttatttgtctatcatctatctcaccagactgcaagctccttgagggtagggcttggtctgttttgttcccagctgcatcctcagtacctacacattcatggcatgtggtcagtgctcaactaatgagtggactcctgtagacagttaataattacacttagctttatgctcaaagttccataattgatactatcagaaaatgtaagcaaatcgattttatctactgggaggatgtcaagatccttgtaatgatttgctttggttcattaggctacatttataaatctgcatcaaaaaggccttacttttaaatcaacatgttagaatatttgatataggaacctagatatcttatttctttgctcaaatgcaattgtgagtggagtagggtttgtccttaacctgcttataatatgtatgtcataacacagattaattttttttctcatttgtttgttcctgtttatctacgttttgttggtgggacacttcctctgacaacttgattctttctgatcctgtttccttctattttgtctccatatgtggcttattgaccccaaatgaagccattttctatagggaccaattgatcatccagtttgctgttaatctaatacatgagcagcatggtatgtgagtaactcagtctttgaggggttattttcatctgcctggcaggtatgcaggtacctagtggtgtttcactttatcagtcctgatgctcaggacactagtgaagctagctgtgtcatcacagtagtttaagctttatcgttatattgctttcattagcaaagcaaggaaaagtcgaatgcctattaattgtgccagatttatacggaactggtactgactttacataacaacaaacaatgttaaaaatagaaggttattcataatctctatttactgaagatcgacatgcccctgtttgtgtataaagaattgtagtgggctagcagaccattttagatagaaaggacttgtagtgataggatacataccacatttctagatattattaaaaatgccaatagggctttttaaataataaaatgataaatatattggggaaaataaactgggtagaatatcaacagtctagaaaagaaaagcaacttggaagtaggagagaagaagaatttgaagtaataattattgcagtatcgtggcacttagatatcattgagtgttggctagcacccagaaagaactatattttagaaccatgcatatggcaaaatataagacagtggctaaaacaaagaattaaagatttaataaagtcttgtaagttaatgtacagagggaatgatttaaattgagtaactcatcatgttattcttagattcagtccttgaaatactagtctctgagatgttcagaacttttctcagaatggttccttcagtcagtaagtttggaaatctgatgtatcaatgtatttccctgcttgaagaattttagtagtttagagtctctgagaagccaggccataaagaaacctgtttaacttggggtttttccaaagccattaagagctttcatgtatgcaaagactataataagcacattctccagaaaatataatggagggaaaattctagttgcaagaacagccaaagctgtaacacacgttggaatgaacttgggaaggtagagtgcagaaccgcaacatacacaacacctaggaagcatgcaagcgaccgaaatggagaaacatgctgtattcttaaggaagaagaaagctcagtaatgtttattactataagtttaatgctatccaatttataaagaatttttttattgttacttaaaatgattttgaagtcatagagaataaatatgccagaataggcaggaaaactctcgtaaggaaaagtactaaaaagggacttataccagatagtagaacatataaaaatgctgtatttaaagagcgttatacttaaaaatgccagaatagtcaattagatcaatggaagaatagagaaattttagacacagacacagatacataaacagtaagactatttggtatgtgataaaagtgtcatttcacatcagtagggaaagacttggttttcaggaaatgatgttagaccaatggataaccatttggggtaaaaaagtagattgattaaagatttaaatatttttaaaagaaattataaaactagtggtaatcttgggatatggaaggtctttcttggcatgatacaaactcatacaacagaaagattcattgatttttattatataaacattgcaaactttggtaaggcaaaacgcttccacattcaaagtcaaacacacaaatgttgacaaatggttctgatatgacaaagagttaatatattatctatgttaagagacctttcaaattactttaaaaaaagaacaaaaaccccccttatagaaaaatgggcaaaagattctgtttgtgaaactctcatttcacaaaataaggcatagcaacagatggcccttaaattgatagcagtgtgccacagctgtaacagtggcaccaagtgtgaagtgggtggaactgcatctctagaatggaactgcggggttggactttggcttcagggctcactaaaccctagttttctcctttgtaaaacggaaataaaaagtacttcataagaatcatatgagatgtaagggaaataatttgtgtaaagtgctctgctctgtacctggcatgagacccaccaccattaaggaaagatagaatgaagcaaaactttttgtcagccagcagctgacaaagttgaaacagaataagaatagtagttctggtttgggatgatggatcctctctagttacgggtaaattgataagacttcatggaggagcatttggtaatatatatcaatgtgcatactttgtgattaatttcttggaatttatcctaaggaaacaaacaaggattaaaaactgtaacaaggatttttattatattgtggttcatgggagtgggagagtaaaaacatttgcagtctatataacaacacaaaacaagcatcaaaagccaactttttgaagaacgtttaaagacatggagaactgttcaatgtttgtgatataattttacaagaaagagcaagatacaaaagtatatacagttgggccttaattattctaaatatataatataacattaaaagtagattgaaaggaaatacaagaattttaatagtcattatctttgataggattagtgattttaaatgtttcatatgtttctgcattagttttgttacataatagacctatattgtgtaatacgataaacgtacactataaatttccattcaaggtatatttgatgtaataatcaggaaggtaaatatatctattttgaaaactcaaggaaagccaaaagagtagatcaaatatttgattatttccattcaatgttgttggttttttttaaaaaaaataccattgacaaaaaaaaaaaggtgttacacttgaaattggttccaagcatgaagcaggagtaaaaagaaagaaaacaattctcattagccaagaaactcagcttccagcacagcatcaaagaatttaatattctaaatagctgctactggctagaagaaaaactaaaaatctcatgcagagggcctttgaaaaattgtccaaatataaaactgttttatgtttttaattattgggatttggattgagttgaaataaataattatttattacaaacctgtggtactaaattatttattacaaacctgtgtactaaataaaattattattattatttagtacaaacctgtggctttcacaggtttgtactctctgaataaaggaataagctcttacatgacaagccaatcataattgtcagtcagataggtgttttgcctgatgtttgccttaatatctgaggatattaagctccttgtttaaaacaaagtgtgtgtgtgtgtgtgtgtgtgtgtgtgtgttttgaagaaacttttggcagtgaggctgaaaaagacttatttatttaacaaaaaaccacaatttttttgttagcaatttttattacctgttataacctggggctcatttcatttataggcgagtggctgaactgtttatgtttgattttgaaattagtggaatccatctagacaaagaaaaggtacatctttctgctgtttttttgactcttccagttttactaacatttagttgataccattattgctacagtccttgtatatattgcttgaatttgcatattgcaaaaacgtgcaggtcttttatctgttatgaaattcttctttagattgtatttgaatatagtcccctctctggaagttgacctatcacaccatgataattcagaattaagacaggcttgagccaagtggagtgttttagataatcatggaattaggatgagataggcaatatcaggaaagactggcaagtgaatgggaaagctgatgtcattgaagattggtagtacagggaatatcacataagaccttacataagtgtatttatttatattatacgtgtgtttgactgatggaacaagcatagattacacagtgtttacactgggatggaggccttctacctagtccatccccttcattttacagatgtggaaacaagacaaagtgatttgttcaagttgccatcctaactaacaaatggccagtgttcttaaaatttctaacactggccactgttctttctagcacataacatcctgagaaaccaagtgcctcatttcagttgtaaattcagagttggaagaacaggagggacttgacaccattggaagttcagcctgccccacagtctcccccactcacctgcagtctagactattatggctttttgtttatttgttttaaacagtaatacatttttcctagtaaatatggtagaattaaaccacttacctatgaagagattaagttatcaaaatatctggaaaagcagaaggcagggccttggaaatatgtatcacatacaatagatgttaccattttgataggtgctgagtttgagtaatgctgtaacccctcacacatctgatgtgtttgtgtggcattaaaggttcagcatgtgattcctggtctgaccctgagccaggacgtgccttcccagcagcccatgaggcttatgggctctactgtaaactcacattgcctaaggtgaccacgtttgccgctttccacatcaattcttcattaatacttctctgtaaaataaaatttgggagttagttgtattctttcccttcctaatattgtcatatcttctaaccaagtccttgcattgttcctacagtcctgcatctgtctgcatcccaaaagcaaatcaccttgattcttatcaccaaacacccgggctgttctaaaggcctctgtcttcctaacagtgatttaacatcaactgagtatttgctactttaaatcatatatttctcatcaaatcctcacaaaaattttgagcttggtgctactattattcctggctttttttagaccaaggctgtagaggttgtgggacgttattttgtaagccagacagactccagagcctccatggccagcatgtcaccatcctgctggtcagtcttccccgtctgtgaacactggattagttttcataaagtattgatttgttactttcctgcccagaatcctcctgtggacttcccattgtctagtgaagttaacatgtaacaaagagctcacactcgtggctgtgctccggctgtcagcccctcatacacagtgtcctcccccatgtgtttgctgtcctcctcctaggcctgctcaccaggtttccctggctgaagtccccatgaaggcttcatcctcacgccacattgcgaagcttttatcagtcccccaggtggaattttgtattcatccgaacgtattttacttatttcagtcatgtggcattcttctttaccttttgttgatgatgatgctgttattgttgtgttgcttatctaacttctaggcttacaaaggatcaagaacgtggatcatgttttttaatgcatattagttttggactcagtaaaagtattgagtgaatgtatgacaaatcatgataatgctagctatcatcaagtttgatatcttcagaaggaaggttgctagtagagaatccatgtgaatagttttaatgtatcctcatgaagggtgcttttgaaattttgctgacaaatagtatatgttcagtttcaccagcatagacattgccgcttttatctaacatatgattacagtgtagctcctctttccccgggagcagctcccagggaacccctcaatattgaatatgcaactaaagtaaacctgctcagtttttcccttgtaacttccatgtttgttctcagaggtgctccactaggacaggatataaagtagacatgttccatttttcaaaagagagaccatgaaataaacccaccaacaaaatctataaatcatcaaagcctatgttctttccagttggtttcttatttatttattattattattattttttgagacagagtttcactcttgtttcccaggctggagtgcaattgggcaatcttggctcaccgcaacctccgcctcccgggttcaagcgattcttctgcctcagcctcctgagtagctgggattacaggcatgtgccaccacgcccagctaattttgtatttttggtagagacggggtttctccatgttggtcaggctggtctcgaactcccgacctcaggtgatccacctgcctcagcctcccaaagttctgggattataggcgtgagccactgcacccggccttaatttttaaggtctcatacaaatataacttataagtttaaatgtaatagaaatgtttatttttaacattatttaataacacagaaatttcatagaatttttcaagagttcagattattgtacatttcattgttaccacagaatgatgaagtgatatgcctggcagatcattgaagttggcatgaactcagttttgatttttccagaggttttatcagtagataaaatcttcaaagtagttaattttatcacattttttttttcaaagtaaaagttttgaagacaattttggaactgtaatgtgatttcaaaatcttgttcatcttttttgttattccacttgttaccattaggtggtgataaatggccatatcaaacaaaataagcaaagagaaatctggactgtaaggaaatgggagtctcctaaaacttttttccatgaaatttgaattttctatattgaaattctggggatattgatatatactcaattttttcagcatcttatcaagcatgcctctacatcatctatgtttatctttaaaaagtatattagtattgtggcttaatcattttttaggagcatagaacagtttagaacttgttaattgctatctcctctcccagaaagatttgtgtacactttcacctgaagcccaacatgagcccagtgcggagcctgtctagttttttggtaaccagtaactgaaaattcatatgcagagcctgtctagtttttgagtaaccaataactgaaaattcatctgcagagcctgtctagtttttgagtagccaataactgaaaattcagcccttctcctccagtcagcctaattatgtggtttctagtttatatttaatcttagagcatttatggcaacccctttgctaatacacgttttctcaggttattgtgtattacaaagatatgactgcaagattaaacctaagcagatgtgtccgcaccatccacgtcctcatcactgaccatttgaaggcctggcaggagcaaggaccatgtgccacatggcagggacacagagtagaagaaaggaccatgccctggggttccagtctgcttcttagacttcactgtatcattctgtagcagctcaagcacatgcaaaatcagaactttattcccccctgagacagggtctcgctttgttgcccaggttgcagtggtgtgatcgtagctcactgaagccttacctcctgggctcaagtgatcctgctgcctcagccccacatagggctgggactgcaggcgtgtgctaccacacccaaaatcagaacttttaaaatgtgcttcccccttctggaggctcactacacttttgcaaataactgtttttttgttttttgtttttttttgagacagagtctccctctgtctcacaggctggagtacagtggtgcgatctcggctcattgcaacctccgcctcctgggttcgagcgattctcgtgcctcagcctcttgagtagctgagattataggcacgtgccaccacgcccagctaatttttgtatttttagtagagatgggatttcaccatgttggccagactggtctccaacccctgacctcaagtgatctgccctccttggcctcccaaagtgctgggattacaggcgtgagtcactgcacctggcatgtgtttttcaatgttgttaatttcaacaattagttatataacctagacataaaatagaactagaagttatgtaaatcttaaaacatagaaacatcagaaaaccataagtatgatctttttgttagaatattaaatatctgttaaaagtaaaattaatatattatttataatatagtaacaatatattcattttactaaactaatattttattaagtgataattcaacaatatatatgttgatttgacatatttatattttgtttattaaattgtgaaatattaattcaaaacgcctttaaataacttttactcctcctgcatacagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtatgtatgtttcattctctttgttgtttaggtcccatttgtgtgttgctactgttttaacccaaaattcagtgataatataatagtatccttaaaaactttttagcattactaagccctaaaaatttaacttgtggaattattaatgccataaacactttaaagaatgaaaatgatttaattacttatatttcatacaagactccttatttttaaagtatgattaataacaccattaactgacattctagactacagagacttttaaattcatgcagccttacttctcctggttaagacgctttatagcatagagatccacgcactgggtagaggtttgccccaccgtacctcagaacagtaccctagagctgcagtcaagtatgctgttgcatcccatgctattttatgactctggaagctttatggcctcgtgtagaccattgctttattttgaaagcagtgatcatctgcagatcaagtggtgagcatgagcctgtgttattgttgcataggactgtgtgatgatatttatagccttcaccatttactttttaaacgtaggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccaggtaagcctgtttatccaacatttaagggcaaaataggatttttatgaaactgagcttttgattttaaatagctgtaaattagtgttctatttttaatacatgtagagaaccatttattgagattttctatgtatttttataggaaccatttttaaatagagctaataatttggcataattctgtccaaccaaagaattttattttatgtgaatgttgagagtaaaatcataacctaaattttcattttgatgttagtctaaattgttttcattttaacccagtttctgtgctgaatttgacaaattggttagaattagtgtaagagaatgaaagatcagtatgtttactgaggtcaaggttaaatgtaggttaggtcatataaaaaacacacagtcagataagcctccttttcagagagaagagtactgcttaggaaggtttgtgctaggtgaggtgttacggaagtgtgtcgttgggtttgtcataaacttgccttgtgctatgttgagttccttatgattcataatgtctaagagaaaatgttacacaataataatataaatgtacataatacgttttttcagaagcatttattaacttacagttgtaatttaggtggtgagtcaggagtagggtggccgtgatgatggagctgcgtgagactcaaggtcttggcagtgaagttgcaagacttagtgagggtgagagggaggaggaggcattgtggtgggccccctgggtttctggttgtacatctggttagacattccactcaccgacagaggggacactgggggcagatcacaacctgaatcctcgcttgtctttattccttctgtgcttatcccttctcaccctagcatgttcctctcttctccaaagttctctaaatgcactcaatcttacttcttactctttcgtaaacaactgtttcccttgacctgtcagggctctcggttaagctacaggcgtgtcacgctcattgcggcctgggttcccttgctcgtgtcactctcctatggagagcagcttttcttcctggtctgcctgttaaaatcttaccccgtttttttagtgctcagctcaaaacccacctctttcatgaagctggttaaactttttcactttccttggactcctttgtccccgaacccttaaaacacttacaatttttttcatataatcgaagctcctaaacagatataatatgtatgttatgtattaaatgtgtgtttttagtgtatgttttttctttttttgtaagtatcagtttggtgaaaagtatgtttttctgtagtcgctgttgtcaacagtttgattataatagtaccatatttttattttatatttatataaaataataatattagaatatcattcagtgcttatcctgttgttatctcatttccttcctctgcagctttgtgaggtaggtatttgtattcatgtcacagataaggaatctaaggttaggttatattgctaaaatgtggcagaactgaagcctaaacacatatgctacatttatggttttccacaggctgcttgagacctaatgccctatgttttatatcatctacatcccccttttgtttattaattcagcaaatatttactgattgcccactgtatgtcagatattattctcggtcagggaaataagtcagtgtacaaagcagaagaaaattcctatccttatgcagtttacattcttgggagcaagggaagaacagtaaagaacgaaataagtagataaagtatgtggtatgttattagttaatacaagccatggagaaaactgaacagggaaggggataaggtatgtgggcatgtaggctggtgttggagttttagagagcattgtcggaaggctcacttagaatgtggaatgtgagcgtgctcttgacagacacaagcatgaggctgtggctcttgaggggagaaaggtttcacgcagagtcactatcaagtgctaaggtcttgaggcagaaaaatgcctgccacgtttgaggagggcagagtggctgaagcgcagcgtgtgcaaggagagtggcgagaggtgggaacagactgacaaggggcggcattaagtagagacttgatgcaagtgcagcaggtcactgtgggggttggggcagaggagtgagatgatctgactccagtgctaatggtgagtcagtgctgctgttcctgagagaagactgcagcagggccagggtagaagagggcctgtttagatgctgttttgcagtaaccatgatgagaagtgttggcatcttgaccaggtggtagcagggaaggtggtaagatgtgatcagattctgggtacagagtatttggaagagggagccaacattttcgacctaagcaactagaaagagagtgagttactactgttaactaagattgggaggaccggaaacttggtttgtttcaagttaagtttgagataccaaatgaggttcaagtggtgaagttgggtaggcagttagatggagtgtggagttctgagcttcatatgtaagtctgaacctctaaaatgagattctgataccactaagagagtgaacttaaagaacaagtccaaggactgcgctctggggccttcaagtttaagaggccaggcatgtgaggaactgctagttaacgctgccagatgtaacggccactaagggaggtggaaagtgattacagggtgtggtcctggaggccgcgcagaaggtctgtctacaggagaggggagagatcagctgactcatgctgtggccaggtcagatgtgaggagggctgggcatgaccactggctgtagcagcgtggagctcactggacctgcagcacccagctccagattccgtgactggcaggtcacccttgtgcactaagtgcttggtgtgctgatgtattggcagggggctgttgtgcacatcatcacataagatgtgctctgggtccttgaggatttaaagcttagttgaggagctggatatatgcatataaaaagataaataataatagaggttggcacgttttcggtgtcgatggagtagtacagacaaaacaatgccatgggatttaggagctcggggcatttgtcagatgcatctgtggctgtggaaggcgccctgagggaaatgaaactgtcatgcacagtgatggagtgagtcctcagcagagcagaaggaagacagagaggctgactgaggctaaggcgggcattcatgtggctagtgaatgaggaggtaactgcggtgaggcacttagtggggggtttcaaactgaatcttaatatgacaattctctgggggcactaattgaggcaggccagatgtggtgtctcatgcctgtaatctcagcactttgggaggctgaggcaggcagatcacttgaggtcaggagttcaagaccagcctggccaacatggtgaaaccccatctctactaaaaatacaaaaattaattgggtgcagtggcgggtgcctgtaatcccagctactcaggaagctgagacaggagaatcgattgaaccctgggaggcagaggttgcagtgagccgagatgggacttctgcactccagcctgggcgacagagcaagactccgtctcaaaaaaaaaaaaaagattaattgaggcagattcttcacatgtaaaatgactggaagaataagatgggtgaatgttaaaacacggttattaagaaataaaacgtgtacaagcatacatagggattcatttgaaaacagtttggtatggtacctggaatataatcctaaaatgagatttcattgttgactaaataatgtatttgttccccaaaaattcctattgttgtttcatatggcacatgagccagtgttttcagaattcgtatacacaggacttgttaagtattgacagtggcaagaaacctcatggtttgggtttaggttaaccaccattatttatttccttagtcttttatttcactcaaaaggagataacttaaattgaagagagggcaggaaacttaaaactgtataaaagattatctggaaaatacaaacatagtgtttgtggtgaactaaaatacatatgaaagctctgtacacataagtcagtgataaaaagtgctacattcagaaatacttgcaaaacatttcctcttgtgggaaacggtgataattctactgcactgcctttatgggtttgtaaattatgacaactatggcagaagtattttaataaaaatactttaaaaattctatcagaagttatatttatttttcttattttgctatttttttcatatttatcctgaatagattattctacagttgtatataacaataaaattgttatcaagaaaaacattgatcttaaaaaatttatttcagggaattatacttctacactgcacctatttttatgaacaaagcagtctagatatctctttaaaactctgaaaacgtcagacatgtctcagaacttttttttcttacacatatgaatagatagaaacaccttgaaattttgtacttttttctttagcctcccattaactctttttttttttttttttgagatggagtctcactttcttgcccaggctggagtacagtggcacagtctgggctcactatagtctctacctcctgggttcaagctattctcctgccttagcctcccaagtagctgggactataggcatgcaccaccacgcccggctaatttttgtatttttggtagagacggggtttcagcctgttggccttgctggtcttgaactcctgacctcaggtgatccaccccccgccctcagcctcccaaagtactaggattacaggcatgagccacctggtcccattaactcttttaattttgggatagaatctgacgctgtggattattagtatgccaatttaatttttttctgattaaaagatcgtcatcacctagaagcatttactatatgtttggtatatgttggtagctctacttccctttgaaaatcatcactttaagggaattgtgggatatagattatgatcatcacataataattttaacagatatgttcattttatttcacataattgaagatattttcttttggatttcgttttagagactgtcatgcagttccttgaaaaactatctgacaaactttctgaaaggttagtttttattctactatttagttttttggttatatgttatttagtctttttaaagaagacttgatttataaaaaattaggaagtgacctagaatataagttttggcatattggaccagacctgtctcactatgagacatactttaaaaggccatagttgtcttccttatgtgccattcttgaaaacataagctgtcccctttcattaaacaattgtttttagaaattcatctttcatttgcactttaaaaatctttaccaaaatgtttttgaaactatttattttaacttgtaccatgaattttatgacaagttcataaagtagtatttctcttcttttggcctaaatacaggaggctcatggatgtggtgtctttttaattttgtgtagtattttaaggatgttctatctcaacatttgtaatttcaagctgaagtgttctactgcctttggtgtgtccgtttgttataacaagttgagtgtcccttatctgaaatgcttgggaccacacatgttttggatttcattttttggggggaatttggaatatttgcatatacataatgagatatcttggggatgggacccaagtctaaacacgaaattcatttatgtttcatatacaccttatacacatagcctgaagataattttatacagtgtttttaataattttgtgcctgaaacaaagttttggctgcaacctatcacatgacatcacatgtggaattttccacttgtaccatcatgtcagtgctgagaaagtttcagattttcagattagggaggctcaacctgtattcctgcctcccctgcccctcccctgctcagtgccttcgatcatacacttgcccttcactggccctcttctaggccttagttgagaggcagcacacctttaggtactaaggattctaggaagaagcagtcaccgtttgtaaaaaaggatgatgttttctctttttctcttgtaatgctgtctaaaattttgtttgcctgttgtggctacaccaacacattggatcttggctcacatttctgttttggactataaactcatgccttagaactcattcttctctagtttggattatgtttataaattctaaaattttcttttaatgatcctggtgaaccactgtgtctttgatacaataaagaaagagggttagttatgcacttattgaggatttatcctgctttacttagttaagtgttagtagtctttctctacatagctatagattttagagcaagcatagcttcatcattttacaggtatatataggaattaattccaatatacatgtcatattctacaaatattaaatacctatttaattattgaccagctagagtttttccataggggaaaaatgactagaaatcttaaatgtagccaatgataaaattcctttctaggagttaatttgttaagtctcttttaaaggtatagcaaaaagtagtgatttaaagttggtgattaatgctttgcatatttgtaatgacattgctagtttttccaagctttagtactcttgagacatttatccaccatgatgctttttaaggtagaaattgcagtaatatgctgctttatatattgttatttctcatgacacttaggtaaaatttggattaatagtgatttatgtgtgcactactaattgtatctaatcttatgaatattggaatgtaacataagcaaactagtcctttcataatgtaattgttaaaattttgtcctaacaagtaatgataaacctgttttatagaactctgaaagattttgagatgatacgagggatgaaaatgaaactgaatcctcaaaattccgtaagtatgttggaatatttttattataatatagacagtctgtcaactgaaatcaatatcttttgattcaggaactttcttgtgataggctacaggtccatttagtcttgtttctgatcctcggttttggtgaataaagatgttgaaatatttgattcttatgtcccaaactgatgttgcctgtacatacagcatttttgttgaggagtcaacatattttatgtatatacactaacacaatgtgtatatattcatgcaaagactgctttcattctgtggaatgttggcttctcagtttgaagcagactttaaggagactcagtggaggcttcatctggcaggtggcaattttaaccatcagtgttaatgttgcagttcatttgcttatttgttagctaatttatggtgcccaattgagtatttgactaacaaagtataccacattctaaaaacacttaagtgttgttttcaatcatatgattatatgatcttccttatgtgatccaagagtatagacaagtattgttatggccagaatgctgcccaggtgattgggggagtgccctgaaaagtgtcgagagtccagatattaggactcattcccatttggttctagggcactacaggattgccggggttgtctacaccattcttttccaaatgctgttattaattcttgacttagttgctgctgccagagccatagtcataaggaagatttagggaaatgggccttgcagatttacaaactgtttactagcttcccagatacagccactaggaaacagattaatcccattaaactcagcgatgtgtagagtagcatgtcagtctgttaatttatggaaggagctgtgtctagcaaagtaactactggtagtcatctgcacagtcatctgcacaccttgacctggtaggtaggcttatttgggaaaccagataataggtaagaatttagtttggtgactatagaaacagaaaaataaaaaacaaaatgtgttgccaaaagctaattcagtaaaagtgaatatgactttaaactgttatctgtagatatttgtatatagcttatggatacaattattctgcagatatttgtgaaatgcccaatctcctcatgaagtccctgctttggtgaatggtgccaccattcaccctgctgctctggtcaggacctatacttaatccagaccagtggttctcaaagtgtggttcctggaccagaagcagtagcatcacatgggaacctgttagaaatgcaaattcttgagccccacctcagacccactgaatcaaaaactggggtgagctccacaatctgtgtttcaacaagcaccccaggcactgcacactcccctcccccataatcatttgttaggtcctgcagattctccctccctgtgaactcttgtgtcttctcctgtgcccattgccatagcctgggttgggatcattattctcacccagatggtaactgggattgcctaactggtttctagccttttgtttttgctccactcgaagccgtcttggattcagacagtttagccatgtatttagcccagtgttaggcatagaattggttgtcaacacttatttgaactatgaatgaataatgaatgaatgaatgaattgccaccagagggatttgtctaaaaagcagatctgatcttgtcactctgttgtttaaaattattcagtagctcctggttattctccagtttcccttcctactaccctgctgctcccgccaagccctcatgatttggcccttgcctccttctctagcttcatcttctgctgcccctccaagccgaggctgtgttctttgctctctcctaatacctgtgtgacgctcatgtgatctctattcacttagttttgctttctttccttgctttgctttctttgattctttaatttgaattaatatttacgtgccggccacataaatatggcatggtgagcagcttccagtcatttacaaacaccacctacaggaatgcctttctccctttctcatctggattaactgcttctatcataaaactcaattcaggctttgccttcttgagaacatttcctaaccttccgctgtgatttaaatactcttcttgtgggctgtgttttacatggcacaatgtagacatgacatactgtcctctgattgttgagtcacttgcccttctactgcctaggctatcatcctcttgtttttgtctgattacagcctgcactctgtctgcatctagcagatagcaaataatcatctgttagagaaaatgtgtgccaggaccagaacactgtggggctagggttccatggacgcagtccctgcccttcaggcactcatgaggagaaagaaaataagcctacaagtatcttaggttgtcatgcatcccatgatataagtattaccatggaatatgggaaataacaccttgttattggaggagattatgcctaaactgaaatgttaaaggataatggtaataaggagagtagccaacatttgttgagcccttactcaatgccagatattctacttaatagtttaagtacattcagcagtcttctttgggaggtactgttgattctttcaacaaatatttactgagtgactaccctgggccaggtactgttcaggggacaggaatgtaatagggaaggatgcaaacaaagtccctgtcatcatgcagtttatagtctggtatggattggaaacttgagcccaggcagtctgtcttcacagcctggtctcttaaccactcttttgtccacctggacacctagaaggaaggacagtcattcaagtattcaagctttcccttctttcagtattatgtgccaatcatcaaaagcaactagtactatagtacttctttatgacatattttctttgccaagattagagttaattctgccttggttacattttaaattgctgctttcatttttgatatctacccaaagcttcttgcttagatttagaaagaaccttaatcttacctttagtacactcatcttacctacagtgtgttttatggattaatacatgggttacattttgggaaaaatttcattatggctaatataattcgttaatgtttacttttgttagataccacttcagaatgacatttgtttgtcttttccccagattctggggtaggtcttagttatacttcactatcccttgattacagggaagtcaaaataaggagccaggtattttctgccaagctatcaattttttaagggattctataaaattgttctgatttacatgaacagtagctggtttacattctataggctggccacgttgctgataaaaactatgaaagagtcagtagctttccttaacagtgaattattccattgtaggaagtaatgccctgggaccccccttactacagtggtgtgattcgtgcagaaaggtaagtttttcaagaaatacccgtacaggaaaaggaaaaaggaaactaatgtttattcagcagctactgtcatccactgagtcgcccacagtacaaacccttcccctgacaccattctttctgctggcgtggtctgctccactcatgtattcttcagctgcttgtatcatttccttgtttaaaattctacaatctggtccctctccagctctgcccttgcgtagctttctggttctcttcctaggctgtgagcattgctggaatccttgttgtatcccattgctggcccagagtaggggctcagcatgtgtttactgaaccagtaaaggaataaagtggtacatggcgtggtactacgttattttccttttttttttttttttttttttgaggcggagtcttgctctctcccaggctggagtgcagtggcgctcttatgttttctcatttttatttggacacatatattgtcaacacattattggtccatctggaaggatataaatgaaataaagatttaaggaacttaagttgacagaagtactcctctggcttctatatcctcctgtgtttattatattggagaaaagtaggtatgcccttctctccctacagacacactatttctgtaatttttatgttataaacccaagaaatagagctcttttcacagtgaacacactttaaaatgtttatagctgaagcaactttatatacccaataggagtttttaaaaaaaaatctcagaatcctactctttaacaacttattaacatttttcccttgtagttagtttttgagatatgctgtttaagtaggagagttaaggttgatttaggtaatagaagaaaatgtaagttttttgtttttttttcctcattaaagcataccagcatgtactgtgatgatatgtgtatttatttggtattaagctttaaaatatttttattactatgcattattgaagcatcaagtaaagcatagtaggtacttctccaaaataagaagtatttgcttaattatttatttcggcatttgtcataaaaacagaaaacaataactttctatattcttttctataccagcaggatgaggtagcctaagatcaattagtgttttgaagcacttactcacttaattttcatttattttcctctctttggtctccatctatcactgttgccaaaaccatttttacttacaaggcataattgtgtcctaacctttagttaagaatatttggtcagttactattttttatttttatttttcattaaacaactctttttagagacagggtctcactttgtcgcccaggccaaagtacagtggcgtaatcatgtctcactgtagcctcaacctcctaggttccagcagccctcctgcctcagcctcccaagtagctggcactacaggtgtgtaccaccatacccagctgatttttaaatttttttgtagagatataggttcttgctgtgttgcccaggttggttagctaccatttttttaaaaatgtatctcaaattcagcatcagtcttttttttagtgaaaacacataaactgttattcaaagtctataataatttggttatggtaaacaacgagggtttagaatatatttgttttacaaaattgttttctggttgcagaacttgaaaccctgctccctatagttgcattaaaaaataaaatgtctcttttaaaattctgtcaaagaaagatttggcttggttgtttcacctgttaaagatgtagcataaatcagtaataaaatttatttgtactttccatgtttatgtaaagcatttgatttttgacattggagagtaatgtaaattaaatatatttgatattaaatattctaatttttagaattctaattttaattctcaatatttagaatattaaatattctaatttaataaatattctaatttttgctactctcatttttatcaggtattcctttcatatcatgtccccgatacctgattattttcattaatgccttggccttaaatataagtgatagttttttcactaactatactctgtaaatatagcatgcccaaatggtggttccgaggtaggagatcagcaggacttgttttctggtcacaacctcctgaccagaacaggatctggtccaaacagaatgaagtaaagaaaccagcccagaccaacagatggcaaggaaagggatttctggctgccctcactactcattagcataattcactcccaccagcgccttgacagtttactagtgccaaggccaatgaccgggaagttagcacccccttcctagaaagttctgaataatctacccccaatttgcattaacccaccccttaatttgcatttaaataacagtgggtataaatatagctgccaacagcccacaagcctggctctgggcgcactgtaggatctgatcacaacctacttttgttttacagaaagaaacatctctactcacatttatttgttctgatttttcttccaccgctgctcttcctccacagtttatcccagccaaacccctttctgtctcaaaggcagaacctctgtcaggggagcagtgggttcccattgcctccctggtttgtcttacacatctgtgacatcttgccaggtgtccatgaagctgctgagtctgcactagccttgtgtagctcctggctccgctgtgcttaacagcctgtgtgctacacagttgacctgctaagatgttctggatgttaaatgtgtcttgtcaaccatattttaaagctctgcaagaacaaacattctggaccctcagtaaatacatactaattcatagcccctattcaaacttgtatctagaccagtaaccatgaaaagcaatccagtgatgaggtttttttagaaagagaatgccatgtttttgcatgacatgtttgcagtgctcactggttgatggagtcttccacctgcttgctaagtccttgaaatcaccaggtatgctgggaacacaatgtagtctgccagatatccatgtggggctttagcttattttaaagttttaatactaatttatttatttgactattaactcagtaaaagaaccaggaaaagggatgcagaaatgcatcagaaggggttgtaagaatcgggttttaaaaatctattttaagtagcttaataggctactgagttttggtttgaggcttcagtaatcttgattgacaagaggaggctgccgcacaggtaatggatgagaaaagaaaggaaaaatatcataggttgggtttggggttagaagagtggaacaaagtgaagatttctaaatccttgttaaattcatcacctttcaagtaaagacttaaatgtgtggcttgacacaaaatgaaatatagaaggggctttccttgattcgagcctttttttcaagttaacctcagggagtcttttgcttttatgttaaatacctcagatttatttcaagtttttaatgttcatctaaagaaaagaacctgtttagaagcaggaggagaaattaacatgttttaaaagtgccaaaggttgatcctggaaaataccgtagtagtataagtgactgtcagcaagtcttaaagagcagctcatttttcctttttaaagctttattgtaagattcttcatggaagagtaacattacgtctttcagatacaaaaataaattattttatttgaaattaaattttatttttgattaggcaatacattcacatggctcaaaaaatcaacaatgttaagaagtattaattgagaatactcatctctacctctgccccagaagtcaccacttttaagttgtttaatgtatccttccagtgtttggattttgtttttgatgctttggaaacactatttcttttctgtgagtaatgagtttcagtatttcatttattttggtgctatttttgtttgtttgtttgtttattgtttttttttctttttttttgagacagaatcttcctctgttgcccaggctggagtgcagtgatgtgatctcagctcgctgcaacctctgcctcctgggttcaagtgattctcctgcctcagcctcccgagtagcagggattacaggcatgcaccaccacacccagctaatttttgtatttttagtagagacagagtttcaccgttttggccaggctgatctcagattcctagcctcaagtgatccgcctgcctcagcctcccaaagtgctgggattacaggcatgagccaccacaccctgccaattttggtgctatttttaaattaggatatcactgggaaagggaattcagtattgtctattccttgctaagatatattcttaaaatctcaagcgcattcacataatgaaatacagatgttttgtgttttaaactattcaaaaaatgggctctcacagaaggactttttttttgatgtgagaaatctcatgctttgttagtataggattagtgatcttggtagttttaaatttttaaaaattaacctttattatgaaaactttcaaaataaacaaataggaaatggatggctcagtcaaaagaaaaagaacaaagaaaaaattgtttaagaaaaaaatgaattaaacaaacagaagtagagcaatataagtaacctctgcatattgatctcccagattctacaaaaaaaaaaaaaaaaaattagcccggctaattttttgtatttttagtagagacgaggtttcaccgtgttagccaggatgatctcgatctgctgaacttgtgatccgcccacctcggcctcccaaagtgctgggattacaggcgtgagccaccgcgcctggccaattaccaagatttttctatgtttgcttcatttgtctcttttttcagttttcttctttctttgctcttcttttccttcttccttccctccctgctttccttcctttctcttttctcattactaatgtacagtcatgtgccacttaatgacagggatacattctgagaaatgcatcgtgggctgggcacagtggctcatgcctgtaatcccagcactttgggaggctgaggcgggtggatcacgaggtcaggagttcaagaccagcctggccaacatagtgaaaccctgtctctactaaaaatacaacaacaaaaaattagccgggcatggcggcaagtgcctgtagtcccagctacttgggaggctgaggcaggagaattgcttgaacccgggaggtggaggttgcagtaagcagagataatgacactgcactccagtttgggcaacagagtgagactttgtctcagaaaaaaaaaaaaaagcatcgttaggcacttttgtcattgtatgatcttagagtgcacttacacaaacctaagggtatagcctacacacacgcctatgctctctggtatagcctgtcgctcctaggctacaaacctgcacagaatgttaccatactgaaaactgtaggcagctgcaacacatgataagtatatatgcatctaaacatggaaaaggtatggtgaaaataggtataaaagataaaaaatggtatacctgtatagggctcttaccacaaatggagcttgcaggactggaagttgctctgggtgagtctgtgagtgagtggtggtgagtgtgaaggcctaggacattaccgtacaccattattgactttatagacactgtacacttaggctacactaaatttatagaaagatatggttctttcttcaataataaattaacttttgcttcctgtaactttttttaccttataaactttttagtttttaaaaactttttgatacttttgtaataatatttagcttgaaacacaagcacattgtatagatgaacaacaatattttctctttttttaatccttactctataaacttttttctattaaaaattttttttgtactttttaaatttttttgttataaaccaagacacaaacatacacattagccaaggcttacacagggtcagaatcatcaacatcactgtcttccacctccacatcttgtcctactagaaggtctgcaagggaaataacaggcatggagctgccatcccctgtgataacaatgccttcttctggaatccctcctgaaggaccggcctgaggctgtttcacagttaacttagaaggagtacaccaaaatagtgatagaaagtatagtgtagttaatacatgaatcagtaatatggtcatttattaagtgttgtgtactgtacctaattgtgtgtgttaggctttcatatgactggcggcacagtagttttgtttacaccagcatcaccacaaacctgtgagtaatgccttgtactctgacatgacagctacaatgttactaggtgatagaaatttttcagttccattatcatctcaagggaccacccactgtagcatatgtggttcattgctgacagaagtgttgttacctggcttgtgattactttaaaggaaatcctagccctcatgtcatctcagtcttatacctttattatgtacttttgaaaaggatgaacatcttcttacataactcttgtatcattattacctaataaaaatttaatagcaatttgttggcatcatttaatatctagtctatattcgtatttccttggtagtatcaaatcagcttttttccccgttagcttgttagaattaggactccaacaaagcctccacattctcttggcttttctgtctcctgtctcttactttagagcaattccccatgcctcatgctcttcttactctcttttttgtcatattatcagcaacagttgttgaagagaccaggccatttgtcctacagaatttctaactttctggatttatctgtgtgcttccttgtggcatcatttcactagttcctctcttcctatcattcctgtaagctggatgttacatataataactcactgttaaacatttcccgtttttggcatggacacccataggtgatgttgtatactttgtgtcacatcacatcaaaagatgtgaaatagctgagcatggtgacacatgtctgtaatcccagcgacttggaggctcaggtgggaggatcactcgaatcctggagttcaaggctgcagcaagttatggtcatgccactgtactccagcgtgggcaacagagtgagactccatctcttaaaaaaaaaaagaaaattaaaaaaaagacatgaaatatcagttgcccacagagggtgatgtgaagatggaccactaggtagattgatgctgacaggatctctgcagtctgcgatgagggtttccctctcagctagaaagggatctctgtggtgttcccagcaacatggaaatgtccagtttttcctcagtcatttacccagtggctttaacacccattgatagtcttcatctgagtcagtcattctttttaattaccaattctcaaaataaggatttattgtaatagttttctgaactagtgacaaatgagtattatctggctttctctttgtaaagcgtcattataaactaatggaattccattgattcattgtgtttcagtctattacagtcattttggagggatgccaaatctgtcataacttggccaattgcactgaaaagtcagtcttttaggagcttgttgagtgagactcaaaatacctgtgtttattattcccagttgagtttgaaccacttgctgcatccctgcaggacagaaaaggggtggtgatttctccagttctgggccagtcgtgtctgcaacctggggagaggtctgagaatagggtctgttgctggactcagtaattcaaagaggcttggaaaagctccttaggcaaagcaaatggctgtctggccactttcctttcatcgttttccacaaggctctgggggagaaaatctctgcctatttcccttttgctgctgccacttgttccttctcactaggttttcattcctccctgttccagggctaacctggatcctctctcacgacatttccacaactcccattctgttcttcctaaagcaagaggcagcacataggtgttatttttggttattctttcctactgttcaattttagacatggctgtttgatttcacattttgatacagcttaagctgaatgagagaccattgcaatagaggtctccttgctgtagtgagatttggccccagcctctatggcgagaattctgtcatctagtggcacattggtgtggtgtcatctctcactgaagtcaggcctactggtttactttcctaatccctaggatgatgatggaattgtactgtctttctttagctttgatttctgttaaccacagttttcagtgaactgtgttgctgatctgcaccattaatgaaaattatttcctggttgccaggaagtttgactggagcaattttcttgccactagcttcagaagtcaagacagaaccaaattagcaatggtggattctttatagaacagggggaaaggtcttttcagttctatatagttacctaaagggcaaacaggtttccagtatcattcagttcctttactgctaccttctctatgtaaccaaataaaacagtagctctccctgtggttttcaaggcagcatttcaaaatgtcacccagctataacatgagaattatacttagtcattcctgatgccaaaaatacagtttcatttgcttttgataaagttaaaaatagtttctctgacagtactgtcacgtgctgtgtcctttacaggtgtccattttttcctcgcccacacgtgccctccggcaggccatcttgttcattctgtaacaagcctctgtgggcatttgccatttggtgcacatgttctctgtcacatttgctctcactcactgaatagaataaggtgagactgaagctgtgtttacctgtgtttcaacctggattctctgactgtacttgattgtgttttatattttcactaagtttgaggccatggtgtttggacgtaatatccaagttctttctttaccttaattccaggtgcgtcagaggttgaaatataagtctgactcatagagtgtgcttcataaatacagtgatccattgacttttttaaaattcagtttacaatgatgaattcttcagttgaaagtctcttcttgactgatatttctgtgctcatttcaatcataattagtgttggatgaagattagatgaagattttgatacattactaaattctattgttcttaatttaaaagacctaattataccattgtatcatgttgatagtggtatgttctggttctttgctgaaaatctgtaaactcatatgtaacgtattataaaccagaatagcagagtgtttattggacttattcagtcacctgtagtggataacacaattttcttccactttctttcttcagaggaatcaaagggttctagagatcccttacttctgggtccagatccatggaattctttacaaaaaatagtcataaaattcttgtaaaactgtagaagagtctgaggtggtgacagggatggcactgaagccaaatcctcaaaatgcatctaagctctgtctctgctggttgtggctctgctgtgctgtgaggtcctatatgctgcccatggtgctttcccactgtcttgggtctctagatgagagaggaaaatgttcttatgtgtagcatctatgcagataaggaagctgtggatggagatggtgcagttggttgttcacaggtcggcctcagcctcggagtgctctgtggaggcaggcggagccacatgatgagcctggcgtggagggctgtactggggcctgtgaccacccaaacaccctctgtgcatgttttttcactccgtgttgaagacgtgagctgagagcacagcagtcacgccctcctgactggctggtcatgtgggactgctccttggggcccctcagatgtgggttggagctgcgggaaacaccctgtagctttttgaatctcttccaccctctctggacctctctccttctggcttttcttcaggaaggaagtagcctgcatttggtgagagtcactgagggtgtggagaggcatgtagtctcgctctggatggctgaggcagctgagtgaggactaaggcactagtgcttgcttgagcttgtctgccccatttgcttgaatccccttgggcctttgctgccctctttcttcccctttgagtgccctccccctcttctaggagcctcatctttccaggtgtgctccagatgctgcctcttctttgtagttctctctgttcctcccattcccagcttctcccctctgccaggtgtaactgaccacagcctcatctttgagccaatgccttgtttgcagtgctcctctgcccctgatcatttggattggtcgtcattattgttacaatgtgttcatctttccacactgaggagttgtcatgcaggcacatggcaggtgattaatgaaagtttactgcatctacacagcttcttgacacagtgttgcatttctttttagaggtaaggtcagctttggggaatagaagggaactggaataggagtagaagaagggaactggaatagaagtagaaaccgctgggtttagtcttgtccctgtccgtgtctctgtctaacagcaataatagtggctataatttacagtgtgcctgcttttctccaggaaccatgccaggttcattgcatgtgtttctgtaattgttaatggagcctggaaagtatttccactttactggtgaggaaactgaagcttcagaaacctaagtaacttgctcaaagcatggaaccaatgagaaatagtattttcaaacccagggctctttcttgtattccagattgccttagactgtcacaagcctctttgagcctgagattcctcaagtaaaacgaacaataattctggtaataattcttgctccacctgtctcacagaatcatgtaaggaataaggagattcttgattcttgatgtgaaagtgctttgtaaattgtgaagcaccaagacaatataagataatattatctcaaaccactatagatcttgcttcaccagttattctaactttatcacaatcaccatctcttcctttgtattagcttcaaaccctttgcctgcagacctgctaagatatctcttatcttacaacacaaataattacccttctgtgacagttggagagactgtggtactatctcatttttttcctgccgaacttcccccagtcctactctctcctgatgcctcctctttctaatagctacagtctggtttataggcctgtcagtctacccagctagtgtttccaggttatcagccacctgccagcatgaaattcagtaatttgttttactgctcaacatccgtgatgtctgtagttttctgtttgggttttttttttttttttttagcttggatttgagatcctaatgtctgcagtttttgacggcgcttaccatgtccagtttcttaaaattctttcttcaacacataccctcagacttcctgttctctccttttttatcaccacactcatttctctttttacttctctaaattgatcgttctcaatctttgttcactgttaggctgccgtaggagtcaatgcagggatgtagtgttctcattgtgaccagtagctcctcactcttgaaagcattttgggaaatgtgtgtaagaatgaatgatacaattactgtgcttcctttagtacttgctttaacttgtaacagatatttgtgaaaaacttcagtacctcagcctaaacaaagatgtgccctcctgttgattttttttcaacttccatgctgttatcatgcagttataaaggatggtctcaggccttctacttagttgttgtcgtagccttgggaaggttacttactgtcttgtaaacctgttttctccattgtaacatagggtgatagtattaccttaaaggatcgtttttgctgttaaatgagatatgtataaagggcttagcccactgtcatagtgagtactcaccaaatgttagttactcatcatcatcatcatcatcatcatttggtagtgatagttttctgtttgtagattaaatttagggaaaaatgggcaacatatttgcaatacaggtcaagcatttctaatctgaaatgcttcaaaatccaaaactttttgagtgccaacatgacaccacaagtggatctcatgtgacagattgtcgtgaaaatacagttaaaattttgtttcatgcacaaaattatttaaactattctgtaaaattaccttcaagctatgtatataaggtgtatatgaaacaaataaatttcgtgtttagacataggtcacatccccaagatatctcattatgtatatgcaaattttccaaaatagaaaaaaaaatccaaaatccaaaacatatcccaagcattttggataagggatacacaaactatattgaacttcctcttgctataataatcatgaatctttgcattttaaactgacctacatgtcactgccagaataatctttctaaagcacaggattttgtcatgtctctcctcttcttccttactactaatagcagctattcccccattgtatgcattctggggagatccagtaaatgttggcaaaataaagggcatatctctattcttctcctctctggtgcctagcaaaattaagaaaaagagcatcaatatatctatatctatatgtaacaacaagacagatcaggaggtcaaggcaggaggaggggaatcagtaaatattatctaaaattgctaaaccaataaataaatgtttattttaaaaccaatagaggcccgtatctaccaaaagtatcaaaattaggaggcaggagaatcgcttgaacccagcaggtggaggttgcagtgagctgagatcatgccactgcacgcctgggtgatagagcatgactccgtctcaaaaaaaaaaaaaattaaaaacaatagagaaaccaccagagaagctaaaatatagactataaatatcactaatatatcaaattattagaaagaaaaaggaaatgcagcacacatagctaaagaaggaaaataaaggaagcattaaaagaaacgtaacagaattacattggcgagagtgagagcactaggtattttcatacactgcaggtaggaatgtaagttagaaacagctttttttagaggataatttggaaatacatatcaaaaaacttaagatcttgtactctttgcagcaatgccatttcttcagtttatcttatggataggcttgtgtgggtgtgacaaggacatttcactatggcatcactttaacagataaactaacagcagcttaccgtcagttaaaaggaacagaggcagaccaaggcagggaagtgagctctgggtgtggcctaacgggatgcattttctgtaaaaaagttaaaatcaataataaaactgatgaaaagtctgggttcctttaatatccccatatgtgggaaattccaaacgatgtcagtggtcggatacttcccccattgatgcttcaggctctcattgaccttgcctcctctgctcatgtacaacacaacaggagatgcatgaaatgagctttgtcatgtgtttgctgtggatgactacacccatgaaagaaaacaggctagagctttatatactaaactggaaagtattccaagttatatttttatgaaaaatatatgtgtaaaaatacatatcattgatatatttttatgttaaataaaattgcgagatagtgtgaatggtatgattctatttgtgccaaagtaggtttatatatacataaagtttacatgcataagcttctaagagtgtgcataggaaatgcctggaaggatacacaagatatttacctctgggggtgggcatagtgagccaggggacaagacagtatactttttgcccattgttaatatttttgaggtgtttttattttaaaacaggcagtttagaaattcatttgttcccaatcattttagggtaatattgtaatattatatgaacttatattctatacttaaattttttttccaagataaattgtttccttgaattttgcccaacacataatgattgtcatggtcattggataagacagtaaatatttttaggttatagtttagtaaaataagctgtgttactagctttactgtgtttcttttccataaaaataaatgttcattataatcttaagaagggtagaattttaatatgtaaagtttctttttattctcctttatttttgtgtttttattgtctggaaacaaaaaaatgaattgctttttataaccaattatagtttaaactttcttgccttggtagtaggttctatgggaggtttctgctctggtaagctgtgattctctatggctgcctgcctttctttccagttttgggggcagcagtttgctctgtggccttgattctctgctgaatctaagaagattcttgattttcagcttgttcagcttcctgcttgttaggatggagtggtgactttcaacctcctcatgtgcaggagtggaaacctcaagcctggaccacttccttttatagtttattttctcccctctttccatgcactcctttctctcagttcttcagtacctctgaactgttctgtgtcttccttcccacccctccctctggtagttcaggggtctgccctttaccttcttctctgcccgcatcgcccttccctaatggccctgtctccctctatggctctaatatctgtacagtgaagtctccttgttctccttagctttgggtcctgagtgtctggtatctcatgggcacttcacagtcggttcctccaaaatggagtttattttctgtgagccctccatcctcctcccatcattgcacctcaccctcctctcttctcccacaaacacacccagattcccctcttccttttttgtgttcattgtgccggctgattcagtgactctaccatccacttatttgtccaagccagaaacctgagtgttattctagattgttctgtctttctcatcaccctccaaatccaatcactcacacagtcctgagacgtttgcatctcaaaggaaaaacacattcatccctgaccccactgccctctgtcagagttcaccctctgaagcctggaagtctgtcctcctgtcggccctccctgcctcctgcattccaccctccatgctgtccactgtgcagcattccagaaaacatcagatgctcccctatggcctacagaagctgtctcccaaatggcatctgtaagcaattcattgagagtgtagtcataaaatattagaaattctatgtatatttatttttctttatctcaacttataaaaatgtctgcttttctttttgcaatgtgataaaacaataccacatgcatatactttatgagtgtactaatagaaggttgaatactcaaaagttattttagtgtgcattggtgaggaagcttagaggccatggcctatggtgcatggtcccagttcctcagcttagtggaccaggccctctgttttctggcccctgcctgccttttccagactccgctcccattctttctacatttatccctgcattggtaactgcttcatctttaaccacatcctttctagaagttaccaggctattttatgccatcatactttagttatactgttgcttctgcctagaattcctattatgattcccattttccattcctcatcccagccctgccttgcaaagtctgattccttttttttttttttttttttttgagatggagagtcttgctctgtcgcccaggctggagtgcagtggcacaatcgtggctcactcaacctccgcctcctgggttcaagcaattctctgcctcagcctcccgagtagctgggattacaggcacccgccaccacacccggctaatttttgtacttttagtagagacggggtttcaccatgttggccaaactggtcttgaactcctgacctcatgatccacccacctcagcctcccaaagtgctgggattataggcgtgagccacagcacccggccgattctttcttgattcctatccgagaagctttccctggtgctactctgcactccacaagtaaagtcatcatgctctcctttgccttcccattttgcagtgctcattcgttcatgcttcagcactgtctgttgagcgccagccgtgtgcccactgcaccaggcccaggacacagtgtagttggttcacttctctgcctctttcagtgccagctgcttagacacaaaggctcttcattcttctcttccagcaccccgcaggtttgctgacagcatgcttgagtgaacgaaccagggagcgagggcactggatcatgaacgtctctttcaacactaggattctgtttaaagaaaaatcagtcagaaattaaggtgtaaatttgtggatgtccatagccaaagtctcatttgttgtgcaatttatgttcacttactaaactcattcatttattagtaactatgtttttatatttttatatataaatttgttgtggggactcattttatggaacgaagtgttgtgcagttctagaatcacaaataaagccaattgaaaaaaaaatgtgtattttggtaatcctaaaaagtagacatataatgagaacctacaatattctagagccattatttttggctatggctatatattttggcttgacttaatgattcaaatgtaaacattcaaatcacgtattttggatttgctttggtttatattggaatatatagaacagaaaaagttatttttgggtgaagaataattcaccttactagttacgttgtctttaatttaagatatctaactataaaacagataagatctgattatttatattgcaggcatttttttcataaatgaatattttactggatgagaactttaaattcacttaatgtgcctcaggatttttattcatttaatatttatgtatataggtcacaagtttctagaatataattcataaggtaagagttaccattataactgaaactgatcatattttgcatgtaagtatgtataaggaatgtatacagtgagcagttgagactgcttaattgggttagtgaaagagtaaataacagggaagggacaaaggttagggaatgatatatctaccttaattactgacttataactaacactagtaataatcagactgtcattctgaagaaaactgtctgaaaacccctcaaatgatataaatacacttttatgttttgaatccttctttagctccagtgatcttaagtattaaatgaaaagttaattgaatttaccttcagaaattgaaataaacaaagatgctgttgaacctctcttccttctcttaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggtgagctcctcctgctcagcctgcagttgcaggcatttacctttcggttgggcagttgagtcaacagcagtttcaggtttacatcaactttgccctgactgagtgtgtcccctgccttatttctgcttcacaaaaaaaatccaaattgcacttctgatttaagacactgtataaaggatccaaacataaaacagcagagttttctaaaaaagttttttggaacttgatagaaggttgaatatatatgcaccttcatatatccacaaattctatttataggaaaattgtcctttactttgtatataccttcatagctgtgtgtccgttttggttaattcccaaatccattggataagtgaccttttttctctccaacccccatcccatgttgtaggggcttatatttgcatcagatattaatttacgtccgtgttctgatttatttaacttctttgataataacttcaaacctagcaatcatctttctcctgtgaaggcccactttatatgaggcatgaatattttaaatttttcctcataggatttgaggctttgttgacctgtgtgtgtcactaaggctttgtattgttttgttgtttgatttttgctagcatgcttaccacactgctttcttcactatattttaagaaatgtaaacagtctcattgtctctcggccacgtcttgtgagtggagagtaggtgtggtggtgggattgaaaggagagtcagggtgggaggacgttcatcactgcattgatttacttcactatctgtattacaaacttccaaaaaagatagagattgataaaatgctgagatataataaaaagaaaaatttataagaggagactgagaggacaaaatgcgggtgatgaagggtttccccagaactgcagaatgtgcactccaccggggtccagcactgttgtcagttgcattcacttctgtatcctcagtgtcttgaagagttcctggcaccaagtaggtgcttaacagatgtttgatgaacaataaatatatacttgcaggtaattttaaagcacaaaatcggggttctctttgatggaatcattaaattctgaaagaacaaagaaggcaagatggagagtagtgattgagtctctcctataagctatgtctcttggagaggggatagatagtaatattgctgatttttaactcaagctgggagctgcattgtggtgttttcaaattcaagggttataatttgcttgggcgtatatcacgacattccaggatttgaaggaaaaataatttgctcctaaaattgtccagccagcacttcttcccagctcttgtgggtggttagtaaaggtattgtagaggataggcagtcaggacaaaaggccctcatgaggaggatttcctgtcctggacacagaattccaaaaccaaaatcattcaagagatggagcagaagaggatgcggggaaaagagaatctatctcgagataatgtggggtgtagaatgtaattaaaatgtctatatgtgtggctatggatgtttaatatacagattcttgtgttagggattttagagaatcagatggcctcatttaccaccaaatttaaatttttttttctaggctgttgttcatgaatctgaaggattgttggggtacatttactgtgatttttttcagcgagcagacaaaccacatcaggtgatcctttctttataaactggtctctctagaaccgatcggcatttcatttgtattgatgtgaactttgtatcattttttaaattccatgacatttaaaagttactaatgatggttaccaaatatatacatttgaaattaagatagaattttaaaattaaaaagtttatggaaataattacatcagtctatatttgtcacttttatctgggtcatggtattaattatagtaacaatgacaactgacattttatgaatccttatttgtgccaaacagtgcactgagcccgttatacacatcagccttttaatgttcacctcacccttttgactagttactcacattatgaggaaactgaagccatagaggttaagctacttggccagaagtgctaggacttgaaggcatacatcctgagcagatccccaacttttaactcttttccatactcgacaatgaacctattctaaaactgcggaagatactccatgtggaaaccttaccaaccaccaagtagctccttatgtggaagacttgaggcagctcatctccttttctttagcattggccgactttgacagccagtcagctttagcagtttcatgtagcttgatgggaaatgtcaagagtttaggttataagttataacagaaataatgtaccttatgtttgaatagtgattcacaatttccaaagcacagattttaacagatgtgagcttatgaattctggacagccactgtgggatttgacaaggaagcattttagagatgaggcttgcagaagcaaattattttccgagatgatttgtctagtaggtgtgaaaggtaggaacagggtgcaggtcaccagactctgaggccagtgttcttcctctttgcttaaatgggtgggtggtggagactcaactttagtgattaggagccctggctcctaatagtcagcctgggttcagatccaaggtgtggcagttctagctaggtgtccttggacatgttatttaataatcctaagactagttttagttttatcatctgaaaagtgagatacctgctacatagggttgttgtggagaataagtgatacagtgtatgtgagtctcagtgtagtgcctgtttcagagtaagttattctggctccggatcccttgctttacactagtttagatcccatctcgttcaagtgataaaagtcaagagaggctgggcgcggtggctcatgcctgtaatcccagaactttaggaggctgaggctggcagatcacttcagtccaggagttcaagaccagccctggcaacatagtaagactccatctgtacaaaaaaaaatctaaaaatttagctgggtgtggtggagcacacctgtagtcccagccaatcagtaggccaaagcaggaggatggcttgagcccaggaggtccaggctgcagtgaactgcgatcacaacactgcactccagcctgggcaacagagcaagaccctatcttaaaaaaagaaaaaaaaatagccaagagacatggaaagtacctactagttcattatctgacacatagtagggactcagaataaatgttagtgtcccttcgtaagttctttgctgactttgtttccagcttctggcacagcatcatttcaatgcatgttttgggaccaaagtaatgagttaatccatagaaactgaatgtgttcttgatgttttaaaaaattaaaattttagcagaataaaaaatgtcaagaaaaggtgtatatatgtaaatagatagaataagaatataattaagttaaagtttgcactcacacatttttggtgaaattttatattcattaagactgttttactcttcacattaccaaatactttcttttccttttatgttttctgattcttaaaggattgccatttcactatccatggaggcagactaaaggaagatggagactatcaactcccagttgtagttcttatgctgaatcttccccgttcctcaaggagttctccaactttgctaactcctggcatgatggaaaatcttttccatgaaatgggacatgccatgcattcaatgctaggacgtactcgttaccaacacgtcactggtgagccatgaggagggcttttatttactacagtcctttacaaacatacattttctttgaattgggaaaggggctttttatttggaaaatgtgatcattttaccgtgtcctgtggtctttatctcagattgcctcatcctgccctccccatggttgtgcagcctgatcttccatgcttttttccatgcttgctaacagctttcaccagggaataatctcagttgtctttcaagtttgtccctttttacattttacagtgttttatattgaatttaagtttgtggctatgtgtgtgtgaataaaaacgtatctccttaatacctcccacagagttaataagtaagtgaatgaatggtctctctttatattcaaaatcagagaagaaaataaagcatgcttaaaaagtatgatgaagtccttttaatttttcatatactttcccctgtataaaatcatagttctgctttgtagtttttatgctgctatgtggctatattttgtgatattacagacttccttcttcattgtcttatccttaagtcttaagctccctatcacatatggtcagcattagaccactagtgaattgttggcatccagcatttgttaactaactttacacacagtattttggacaaggagaaggtattgaaaagactgtaggtgggctgaacacaatcgttaaatgtcatctaaatttcttacaggatttgttactttaagtaattttgagtttaaaatatttcttttcctcactgagaattgactttgttacaaaaagcaataaatggataaaataaagtacttgtaaaacaaaggaaggataaaagtattaggtaatggaatttagtgaattaaatacaaacgctatattaatattagaaatgttttaatctgtttcatgtatagccagcatagctgaagacaggtttgtttgcaaaaggtgtgagccatggctttataaggtgttttagcagctgtgcaaatattttgttttaattttgatataaaggaaaatatataggattataataaacttttctgcaaatatgtacaataaatttatagaagaaaaatattgatttaatgaattaaaacttacagttcatcagaagtacaaataaaagttttaaagggcacacaaaaagtagataaatatattgatttgattcatgccaacttttttttttttcttgttttagggaccaggtgccctactgattttgctgaggttccttctattctgatggagtactttgcaaatgattatcgagtagttaaccaatttgccagacattatcagactggacaggtaggaacagtaatattgtcgtcttgtcctttgggttgtgatagttggcgtttatgacatcctggataaattgaactcttcttgcttttcagaactcaccctctgttagtaacaaaccttttattgcttctttttttcctgattccctatcttttcttttgccagtctattaaatcatagtcctagcatatagtcatgtgttgaaaaatagctaccctttattacatgcctggtaatctaccatttagtcctcataacctccccataaggaaaacactttatccccattttccagatgaagaaacaagttctgtagtagaataggcattcgagcctgtctcacttctaaaaagcctttgcttctgaatatttattctcttggtctgaatttttatgttgtctcattaaactgaatccagtgccatattttgccagtatgcttagcatctctgtgatgtttagtctgaaaagtccttaattttaaggcttaaatttcaatgatgcattctaatattaaagatttttaaattaaaatgtgaggtaccttacactaagctagctgtaagttgtcaacattgtgctgtttactgtccatgtgtacattggaagatgcgttctttcccttccctccaagtctgattatactagaaccgtattacgtgaggtgatgtttttccccctcagactgtatgtactcccggtacaaatgtaaattgtattcatctgtgaatacttagcacctagaatcaaaaaaaagcactgaaagaaattaaatgaggggacgaatagaattagaaacagaaggaccttaaccacctttatttgtgactcttcttctcattatgtctccagatgtgtaatattatttggtcatttttttttttggacttgattttatctgtagaataatctgatcttctggctggcacagtggctcatgcctgtaatcccagcactttgggaggctgaggcaggtggatcacctgagcttgggagttcgagaccagcctgggctacattgtgaaaccccgtgtctactaaaaatacaaaagttagccaggcgcagtggcacatgcctgtagtcacagctactcaggaggctgaggcaggagaatcacttgaacctgggaggcagaggttgcagtgagccgacattgcgccactgcactccagtctgggcaacagagtgagactgttaaaaaaaaaaaaaaaaaagaataatggatgatattctggataagtaatctgagtgactcttcaacataatatatttcagttattacggtggcagatttgtgatccaattaactacccatccattaatctacaaagaattgttctgggaattatgtagacttggccaataacatagagaggcataccctaccacgtgatagcataatccatctatggctgtgtattttgggaactgggaatgattagtagttcagtgattgctccctgcctgaggtgcttagagccctgtgcacaggcagggccacgagggccctgggggaactggggaggctggggaggagaagtgcaggaggaaggaggtctgggaaaaagagaagcggcattcgccagtcagctctcagcggtattcatctgttccaccaaaatacatttattgaggacataggacagagaggcccttcagtcagaaaacacttgctgagttttaatatttaccagtctgcattctcagcatccaagaaacagccaagaataagtcaggcaacatcccattgcccgcggtctttaattcctaggggaactgagacagagcctgactagggtgttaccgcccgaaggcaaagcccaggagaggggaggagcaacctctagactgctggggaggcctggccaggagctgggagctaaaggctgaggagaagttacacagggaaaaacacgggcatatgggttgggtcttctgctgctggagcagcagccagtaaaggctttcaggcgggaatcaaatttttacttcaagaaaatcacgctggtgtcagggaggaagcggatcgcagggggtgcggatagagcctgagaggcttcctggagaggcaggctccggctccgggggctcggcccctctcccctcatcccgggcgcgtggcctctctccacccacccttgctgggtggcctcagctctggcgacccagcaacccgcagacaagtacacggctggtgaaggggtcagggtgggaggcaggggacagcaaaggggcatcctgcttccgagggttccgcagggtcaggccaagggaggcgccacttagtgtgggagacgtggggagcatcactgccgccaggaggggtttctgcgagtttgaggagtctgaggtttcggaggtggccgctgccaaagtgagagcgcgtggtgcagggctgcggaaagagggtctggcgaggggcgcgaacacagggcgtgggaggacacacacgcgggggtgactacacaagaggaccaggagccttgcacagtagtcatttttttaaaagtaaaatctggagtggaaatttaccacatatacaaatgtcaattttttttaaattgccatctacttatagaacaaccaggagcaaagaaaggctggagtcactgctccaagtgtgatgtaaggtgcaaaaggagagagcttctcaatgcctgtattcttactaaattattctgtaagaagatgtattgttgaactagatgcaagaaaacaagagtaaacccaaaatctaatccaagatagatgagataggaagaaagcactaagctgctttgaattaattcaagtttcagacacagaagatggatccagtgcccttaagggacttacagacgtagtctctaaagaatctaaaattttgtgattctcatggagaatggaaagcgtgcccaaaggcaagagacatgtaaatgctttgagcttcacaagggcttgcctcttcttgtcactaatgaaggcaccaaggaggtttattttattttatttattttttttaaatcttaagtgcagtcctagccttaaggataagaagttaattctctaaaatccaagtctttgtaaataaatggcatttaatctcacaaggaaaaaataacagggttgcatgtttatgcctaattttctatcctgctgcctttcaggaaaggatttttttaacattatgaaatatattccagagaggtctcaggtagaggataatcagtgacttattaacacctacaggtattttatcagaactatatcatagcatagtcaaagaattccttgtggtggaagaattagaagtatgcttatcagatttgcaggtgtcatgcagctgtcagagatagcagataccagaggtgctcattcaagattcagaacgtcttgacaagctacaacattaaagccaaagtagaatttattgtaaattaatcttgaaatcaataccacaggtatagaaggagtacaaacttgcctctgttcaggtgtttagacataataaacttaacatggatcaacagtctgatgggttttcccataaatctccttcaattttaggctaccttagtggagctgtggtgcctaaggacccagaggtcattgtttctcttctcagtgcttgtagatttttaccttccgcgtaacttcttcgccgttgctccaaattagcacagaattatatataggtggcctcattctcctggaagcatgattcttgtccttcctaaacctttctaagatgcaactttcttttttttaatgttttgatcattctctgaaagtgggatccccttgttatttacctatttatatttaatagctatattagtctgttctctgttccttagaatacctgaaaatggataatttctaaagaaaaggaatctattttttacagttatggaggctgagaagtccaaggtcaaggggccgtatctgatgagcgccttcctactggtggggactctgcagagtcccaaggtggctcagggcctcacatggcgagggactgagtgtgctcacatgctagctcaggtctctcttcctcttcttataaagccagcagtcccactcccatgataatctcttaatccattataatcaatggatgaattaatccatttatgagggcagagccctcatgacccagtgatctctcaatactgcctggagaaggggtatttaagccccattggggcttaaatttcaacatgggttttggaggggacagatactcaagctatagcagtggcatagtgtgctctctccccaaatctgtcataaaatcacagtggctctttacaaatattgggttcttagattcaaggaaagaagacagtctaaacccctatacccagcattgaaaatgctaagcaccttcaccgtgcagtctaatagcctgccccttgacctctgctgtggttagaatatggtttgctccaccaaaacttatgttaaaacttggtccccaacatggtggtattggtaggtggtgcatttgagatgtgattaggtcctttagatggagtaatagctctctctggaggctgggttctctctggaatggattagttctcatgggaacagatcagttcccacgagagcaggttgttatgaagcgaggttgcctcttgtattttgctctttacatatgcatcaggttccccttccatttctctgccatgctttgatgcagcacaaggctctcaccagaagctgccggatgtgttgcccagtcttgaagttcctagcctacagaattgtaagctacataagcttctgttctttataatttacccagtctcagatattctgttatagcaacacaaaatgcagtaaggcaattcccatccacatccccccctcccgccgccatggggaagctaggctgtccccgacgcccagatcatttgggtactcagagttttcctcttctttctctcactgtccccagatcctgattcctaatggaggcaggatctatttgtctgtgccctagatttgcaatttcttcacatcaggttttaggtaaatttctgaaaatgagcaaaagtctgatacttttacctttcctttgcatttctaaggttctgttcccatcccactttctcagactgaattttccccagatgtgtgaatatatgtgtcctaattgacttagcccagcccctgagtagtccagatgcttggttgccccaccctttcccctgcttcacagtagctgcctctgttcccttttgtcctcaattcctcagtttccaactaactcctccacccctacagaaactgccactatccttatctttacccacaatatccctttgtcctcagcatattgcctggagctgggctgccagtcccagtgtgtttgatcaattttgaagggcctgttttacagtgatgctgatgaactagaaaccatcctgaggggtggctgctgcttatttgtaaaattggaagccacttcacattaggaggggtttaagaaaagacatttttagactagaaaaatgaaactcaagtctttcatataccatttgaaggataccatgtaaaggaagaaagtcattctaggaaaaaacaatattactaggaatagtggaagggaattctaaggaggctcatttcagttcaggagattcttctcgtaaatgattagagcagaaagagatgcctctccaagtaatgaatttctcttttatttaatatttaatgttataacacagtatttgtagaaagaacagctatgaagccattctccaacctgagaagtaaaacattaccacatgctcttctctgaacccatctctgccccgcttgcctcccagaggaaagcatagtgctcaattcttatcattttttggccacattatttattcctaagaagtgtggtgtttagttttttgaactttacaaaaatggtattttactgcttataatcttctgttatttaaaaaatatatattttatgcctaagattaatctgtgttgcatgtagctgcagtgtatttatttcaattgcagataatattccatcatttatttactcattctcctgtcatggagcacacgtggagcacacaggttcttccaggtttttgctagttcatgtgatactgctgtgaacatttttatactttcttctgtatatccatgtataagattggaactgctggatttgtaaggggtgcatgtctttaagtttatgagataatgccaaattgtttttcaaaatgtttctgctaatttatactcctctcagcaatggtttctatcgtgcagcatcctcattgacttttaattttgtcaaaagttttaattttgcccattttgtgattataaaatgaaatgctattgtggtcttaattagcagcagtgttctctgattacttttaaggtcttaattagcagcagtgttctctgattacttttaaggttttttatttatttattttctgttttgttttgtcttgtttagaaataaggtcttgctaggttgcccaggctggcccctcaaactcctgggttcaagcagtcctcctgcctcagccacccaagtagctgggactacagtcatgtgccactacacctggcttatttttcgtttttgttttctgtcagatgtctttttgtctcatgctcattttcctacttggaaatttgtctttttcttactgattttcagaaattcttggtagttgaaataataatcctttttaggcatatgtcgtgtctcagtttatggcttgtgttttcactttccttttaatattgttggatttatcaatcttgtctttatagttaatagtttttatattttttttctttttttgagacagagtcttgctctttcgcccaggcttacaggcatgccaccatgcccagccaatttttatattttttatagagacaggatttcactgtgtttcccaggctggtctcaaactcctggcctcaagcaatcttcccacctcagcctcccaaagttttgggattacaggcgtgagccaccatacccagcctcttcagttttcttctaaacattttaatgctttcttttctctttcaatttttaatcaagttggaaattctttctgggtttggcataagacgggaatccattttactttcttccgtgtgagtaacaaactgtcccagcaccatttagtgagtaatttaccctttcttcagtgccattactcatgtacatgcaattgtcagtttgtgggattctctttcattccattgtttaagctgtctgtcctaatatcaaagccatgctgtctgtattactagagctttggaataagttatagtaataagcttactattattaataagtaataataagccttgatatctggaaggataggccttcctcgatttgttcttcaaaatttcttgtctactcttggacctttgtattctttcatatacattttagaatcaggttatctaatttttgaaaaattctggtaagagtttgattgggattacattaaatttctaggccaatttggagagaactgatatctctgaatattgaatctttgaatccatgaatatggcatatctctccatttcttgggtcttttcaaaagtctttgaatacagttttaaaattttcttccagggccttggtcagcttttgttgggcttcgtcctggatgcccttcctttttgatactataagcagtatatatattcagattgtttgttactggtgtttaaaaatgctgtttgtccatttttgtatagtgctcttgtttacagcagctttgctaaactttcttattaattcacagaatttgtctatagacttttacaagcttttttaaccagataattacttctgctaaaaataatgacagctttatttttcctttccaaccacgtatcttttctgtttaccttgttctactccacttatgagagcctccttaatgttgagtaaaagccgtggtatgggcattcctgccttgatcctggtgtttaaaggaaatgtttttaatacgtcaccgtaaagaaagatgtttgttataggtttgttggagatatcaggaaaaggaaattcctttctatctccagtttgctactatttttttaaatcattaatgggtattgcattttatcatagttttttcctgcatcttttgagctgtcagattgttcttcacctttaatctgttaatgtagtgaatgttaatgttaaacattagccacctttgcatttcaggattaagccaccttggtcctaaataatagttattttttaatgcagagctggctttagtttgctaattattttatttatttatttttttgagacagagtctccctccatcgcccaggctggagtgcagtggtgcagtctctgctcactgcaacttccacctcctgggttcaagtgattctcccgcctcagcctcctgagtagctgggattacagcgtgtgccaccacacatggctaatttttgtaattttagtagaggtggggttttaccatgttggccaggctggccttgagctcctgaccccagttgatccacccacctcatagtttgctagtttactaatatttttatattcttgatttttgcatttatgtttatgagagagggattgcttatgatttttctttgtcattatttgctggtgttcacttaaatatatactatttcataaaatgagttggtgagtgtttctttttcttttctttacaagcatttatttataacattgttatcatttgttctttaaaactgtcggaattcatctatgaaaccattcagggtctgttgtttcctctgtgggaagattttttaaatgactgaatccttactagtcataagcctctttgggctttcttttcttctcagataaactttgctactttgaaattttctagacatttatcaatttgagccaagttcttcagcttattcacataaagttacttatagcattcttttatccttcaaattctgctataattgtatcctttttaatttctaattctgttttctcatttttttctctctgttaatcttggcagaattttgtccactttatcactgtaatcttctctcagtgtctaagcaggattggttcctgggccactactccccgccaacgtggctaccaaaatccttggatgctcaagtcccttttatgaaagggtgtagtatttgcatttaacctgtgtacatcctgctgtatactttaaatcatctctagattacttataatacctaacacaatgtaaacgctatatagatgctgtattgtttagggaataatgacaagaaaaaagtctgtacatgttcgatacagatgcagtttttttccaaatatttttgactcatggttgattgaatccatgaatgtgcaaccctcagatatggagggctgactgtattttcaaagaaccaatgcaaactttgtttatcctattttgtttgtttcagtttgttacttcctacttttattattactctctccttcctccatccttgtttttttcttctgatttcataggcatttatctaattcggtttctgttttatttaacataagcatttaaattttaatgctttaaatattaaatgatgtgatgaaatgttttagctgaattctgtgattttaatacaaaatatttttaaagttggtaatttccattgtaatttcctccttaagcaaagacttgtttagagctatagtttaaaagttttaaacctttgcaggggagttatttatctttttgtttctgatatctaattaattggtctatctggtattgattctttgcagtttgttaatatttattttatggcttcatgtgtcatcagttttttagaaatgttccatctgtgcttgagtagattgtatatttataattgttgggtctgcggtttcatactagtctggtaagtcaaccttttaattgtattgtttagatctttgatataactaattttttgatatagcaaaaatttagaggtataagtcttctaccatgagaatgatagatatataatttccccttagttctatccatttttgctctctatattttgagaatattttattagatgcataaaagcatagtttccccgatgaacaattcctttcttccttatatgttatcctcttaatctttatatgtttcttgttttaaaatcttttttttttcctggtaattttgcaaccccagctacattactaatcaccaaatatagccaattgatttttgagagaacctgatattttttgtatagttgtgtctattagccactacactaaaatgtttactgctctagttgtctttctcactgaatatttttaaagcgatgttaagagaagttaatactcactctcataattttttcttatttagtcctttctggcagtctgtgaagttgatggttggtacctagttgtccacactgtatggactaactgtagttactgtgattccttaccctggctaccttagactcagccagggtaggtaattttccaaagatcacacaataataatgaggggggcaatagatctattagtttcaccttagaatttccttaaagttcagttagagttgatcaagtcagtattataacattgtgagtattttctttttccaggtattttctcgttaaaaattcctcaatatgtatcgcctaaacttctgacaatgtgtctcataaaatggaagccccatatctactttaagtgttatttttagaacagtaacattctagtgctttcattgtagaatttttctgtcctgcatcattgtaagatttagtttctcgccttagtttgtgaaagtcagcccaaggctaaaattgcttaagttctatcttcaaggagacatacatacttgtaataaatcttctcctgtcatcctctttcaagagatgtgaaaaagcatcgaaggtaaacatgacagtgcaactagcattagattaactttggcagatttaggttgttttggaacttttcttactttcagtgttaatgcttctcaattatgtctagacaaaagcattgaacagggaagtagagatggatctgagcccggccccaccaccatacacagctggctttagaccagtcattgaacttgtctgagacttttctgctcctttatataaaataaatggaataaatatgtcaaaattaaaatttagcaagcctccatacctgcctcaaaatttttggacaaatttaataatggacgcaaactgtaaagcacagtattattggaatatttttagaaaaaatggaagttggatccctatcacacattaaaatgtttagtgttgaaccctgcaaaactcaaagccatctgacctatgtttctttaaaccatcggtgggtctgtgataaagtgtaagcatttttaaaggttttttaaatcttagatcatcttatttagtttgttagaaaacactacttaaaagtaagtgaaaagtagtatttcctgtggatttaggcttgaggttttgtctccttgggcctagccaacatttttattttattgattatgtgccatctggattactggttatatcaaaacaagctagttgagacatgcaatccagttgtttttccattatagacacgtgaggaaatgcagtgctgtgacacacagcttggggtgggatgggatcagctgggaaatcagagctgctgcttggcagcctggtgcctggctttatgccgctgaagtattttcttgttttggatgactatgtttcaacaagttttctgtcattagacctatcacgtgcccagggacatcagcagtaggagttctctgcttcaggatgagttgaattaccaccataacaaggacttgtaccagagattgtcttacctgttaatatatatgcagcttctcaccacagtacattttctcaatggtcataagtaaaaaaggtattttatcacagtgacttagctctgtaataatttgataccaaacttttaatgtaatgttatttaaattagactagtgagattgtgaaatgttagagaatacttagcaagtttatgagattacatgcttacaacttaagctcatgacaaaatattcagagaattcaggtgataactatgtttaccaaacatttgtattttttggtgttatttttagaatcattccaaaatgctgtgctagcttcatagaatgggaaagctatttgttttaatgtttttgttcctatgcgtggtcaacaaacattgccacttttgtttaccccaaggatacagttgacaccttcctctctttggtaaggcagtatagcataggctgtggacaactgatgcagtgtttggctcatatgaagcactcagtaagttagttattaatagggtgacaatatgatctattgtccaagccaaaccccttttttggtgagagagggacagggtctcacactgtcacccaggctagagtgcagtggtgcaatcacagctccctgaaacctcaaattcttgggctgaagcagtcctcctgccccagcctcccaagtagctaggactacagggcctgttatcatgcccagctaattttaaatttttttgtagagatggtgtctcgttctgttgcccagcctgttctcgaacattcagcctcaagcagtcctccagctttggccctccaaaatgcagggattataggcgtgagccaccgtgcccagctccaaatgctgttaagaaagaaaggagtgctattattgatcacaccaagatggcagtcataacgtaggactgtcatgcccacctccatgtgtggtcacccaagctgtgacagcattgagaaagtcagatgtttcagatgcagggacctgaatttcttctattcagttaatacattttagaagttcattaactaattgtcaccttattgaaccttcatactaattttgtggcagaggtatttttatcctcattttacaaatgagaaaataggatactctgagattttgttaggctaagaggcaaaagagtagcaacagcaggatgcctaactcacacccaagccttcgtctttcacacagtgctcctccttacagaccatttttctgcttgtaaaattagaacaatttaagtttgctcatctttgtttttcaagtcattgtaatgactgtttctttttctaagtcaggtatctaaaactttagcacacaatcacctggggatctggataaaatgcagattctgatttaatggatgtgaagtgggttcaggattctgtatttccaggaagcgcccagcggaggttgcagtgagctgagatcatgccactgcactccagcctgggtaacagagcaagactctgtctcaaaaaaaaaaagaagcgcccagatgctgctggtctctacttgctttggacttcacatagttgggtaattactgttcttacaatccatatttaggaaaaaaaaaaaaagttgcaattctgagcaagacacagatttttaccttcttaatataagaaggaggtcagttttatagtctttcattttccctttctggctgtaaatgtgttctggcattaacaaacaatagaataaatgagcactgggagtcctctcttgcacagctgtgtgtttgggtacacaaagagggtggggcccccactccctagtgtcctttaaggggacctttcacacagcaatggctgattgtgtctcacagtctagttggggctctagaaatctaagtttaagtcattgaatgcatcatcgggataggatgaatcaattagctaaatgcttgaaataggagcatttggttacccaaccgtagtacagccttgcggggtggggcaatgtgaggcaaccactccagggcttttaagtcagttctttttagtttataggcaactttagcatattagacaggctgcattgtcttgttatagtcatatagtcaaatcttgagtttttaaaaataaacacagaaattactgttttaaatacagtggtaattgtggaaaaattcaggttggattattacagtaagcacattaggtcactgtagttaattactggcatattatattccaatagtagaaacaacatttctaccattttcctattttaaaaaaccacccacgatgtttgatctctgcttttgaaataccactgttacggtagtacaaatggcaccatttattgttagggtaattgcttttccaacactgtgaatgattactctcttctaaattcctttattgctttatctgcacctcttttgtggctcttggtgcattttcccatgctttatgaatcctgaaatacatttggcccttctgtgtccacacagtcaactaaccatgggtcaaaaatacttggaaaaaatagtaataataacaacacaattattaaaatgcaagtaaaaaagcagtacagtgtaacaactatttacatagctactttgtattaggtattacaagtagtctagacatgatttaaagtatataagaggatatgcatctaggttatctgcaaatactatactattttataccagggacttgaacatgtatggattttgttcttggaggaaggtcctggaaccaacccccctcagatactgcaggttgtacattccttttctggttccaggtagcaggatcaggtgagattcattgtgtattacccagctgcttagtaggatgccttgcacagggtgggatgctcggtgaagatgagcccagagagtcttgtgacaggtctcacctgcttttcttgctctgtcttctcttacagcccatttcgtaagcacaggaggcagccagcttcaaaccagggctcatttggacttggtgggattctatagtgacaaaaaaaaatctgcagatatttttatgaaagaaactaggaaggggcataaattatctgaagtataaagttcactcagtaaaaattgctttgaaataaattcacattaacataaattctcaatccatgtttaaaatagtctgcccttgttaagggatacagattttatagaaaactgtttctgaacaactctatagtaagatagtttgtaaaggttgcagattgcaaagctttactgagggtataactagatttactattgtatttcaataaaatgcctccataaaaataatagttgataggtgatatctgaaaaaataacagagtgggaatctccctcttcactgtggaaaaagaaaatgttgcaggagggaaatgtggagcttgcagttggtattatttggcgtttttcagtatggaggcagtgttggatgctggctatttttcttctgttttggagcagagaaatcagaatgagttttgtggatctgctaatgcattgaggagaccagaacatacagcaccttctgtgctctatccatttgttccctggccataaggaaaggcaaattagtgtgctttcatgagctccatcaactttcattccttagaaatgcacactctgatggggcattggaactggctcaggcaccagagcggcaggacaccctgcaggcaagttcccagaatgtctgggggctgtgctggcctgggagaggcagagccaggtgcgatggagaagagctgaagagaagctttctaataaagtgggtgtaaatataagactggaaagaagctgtaagatagccagaataacagctgtatttattcctttatttctttacgatgttttatttataagaattctttcttttattagtgaaagttacatttaattgctttaccaagtcattttccaactagtgttgtacatattaaatcacctgattataaaagatgtatggggtggagggagcaggtgttctgtgctcaaataattttggaaaatgggtgtagcattaaatgggtttctataaaggtaggactacgtataatttaatatgctaataactggaatccccaagaaaggtgtttacttgagtgaatttcctagacaatctgacctgcttttattgttggctcttctaccacaggcagggcctctgttcagtcaacacaagcacgagagttggacaacatcaagggaaggccaagtaacttcactcaactggattctatagatacaaaattaagagtgctcgaagagtttctcacacttaacccattttttaaatgacacatctgtaaacctcattggggagacatgtacaatatactgtgtgtagaacacttggaatgaaaagaggtttttttccttttttttttttattgagatggagtctccctcttgtcacccaggctggagtgcaaggatgcaatctcagctcactgcaacctctgcctcctaggttcaagcaattctcctccctcagcctcccaagtagctgggattacaggtacatgccaccacacctggctaatttttgtatttctagtagagatggggtttcaccatgttggccaggctggtcttgaactcctgacttcaggtgatccactggccttggcctcccaaagtgctgggatcacaggcatgagccaccgtgtccggctttttttctatttttttttttaataaaaagtggagaatttacgctgtatttcagaccaaatgtatataacacatagagatttatagttctctatctaaaacttcgggattagatgttttggaattcagaattttctggatttttagaaaattaatatggtttatgagaagaaaaaattgcaacaaatttggttatagatccgtttgacttttatatgtgattcatgaattaggcagcctctattctacaaagtagaatgaaagctacccctgggcaatagcagaagagtgggctttataaggtgggaacaaggaaacagaacaccagaaaaaaaagccgattgattagcatcaggttcctcttttgtaagcgttaaagcaaagggagcttccatatgacactgactcaggtagactgcgatctcctattttcaggaaacaccggactgtatgggatctacctgcttctctaaaactttggtttgattgtgtggcatttagcatgagtgactccatttggtttggttttgtctactggggcccagtgtaggagctcagtataaaacaatggcctcccataatttttgtttaaccttatactgtggatgttgaattaaaagaaatgaataaacctagctagttctggtagagtacccagtagtgaaacacattcatatttctgcatattcacgaagtgtaagggtaaatatttttaaaagataaatactttacaaacttcacatttgtccaggtcaggtcttgccatctaatgttttttttggtcaaatttatgaaaactttccagtcttcagaccttaacggattatggaatttcaggtaagggatctagaccactactcacagaaattagaatgaggcacatcattgaatttccctctccgctgttacatttagcctaaagctgccttacatattttaaattaggcttaaagatttctccatacataatgaactctaaccttactagaggtataaacagcctgtaacctacccttgtaccaatcacagagtttcagccaatcacaggctgttcaaaccttgttcaaataaggcaaatgtgaactgtaaccaacccagctatttctgtacctcacatctgttttctgtaggtcattttcctttttctgtccataaatattatcagactatatggcagttcctgagtctctctgaacctattctggttccagggactgcccaatttttaaggtgtcctttgctctgtttaactctgttaagtttatttatttatttattcatttatttatttttattaatttttgagacagagtctcgctctgtcacccaggctggagtgcagtggtgcgatcttgtcacactgcatcctctacctcccgcattcgcgttccagcgattctcatgcctcagcctcctgagtagctgggattacaggcacccgccaccaggcccagctaatttttttttttttttaagtagatacagggtttcaccatgttggccagactggcctcgaacccttgacctcaagtgatcagcttgcctcagccttccaaagtgctgggattacaggagtgaaccaacgtgcctagccaaactctgttaaatttaatttgtccaaagtttttcttttaacgctgcttagctcactgcaaaacccagaactaagtgtatggcccaactgtgacaatgacacggagttacaggaaacatgttttaatgtgcctaacctcaattctgacctcattttatttttctgctttcatttttccttatctaacttcctcatctatcaattgtatgctaattgtgtattaaatatataaattatattcactgaatgttttattgagttattaagtgttcattcagtaaacactgaatgtttactgatccttttgtgggggaacttgttgaagtatcagtaaaacaaattttggatggaagtgcctttgccatcaaggggcagcatacctgaatcacaggatcgaattttgaggggtacacaaacaaattgaatcaacaagcccgacgttacacacctgcagcatgcctcacagactccaccttcttgtgatgcaggtatcggaattttaatgcttttgagggcaaaggatgatgttttattgttcttgttacaggaaaaattattcatgaaagttattaaagaacagtaaggcagactttatcggggggctactgcagtgaggtttggtagtgggggagagattctgctcaactccatattcaacaaggaaaagtggagatttatagccaaggaatgagggagtggagggagttggaggataaaaaattactaaggtgaggaaagggggattctcactcgactgaccaaactgcttgagacagtgctcagctatgctgtctgtcatacgtgccaaagctttacaagtttcttcatgatagtctctgatggtgtgtaattcctgacttaaaagcatagttcaccctttgtaaagcttttctgcctttgtgtttggtttggtttggtttgatttttctcctttggaggctaagcccaaatgatattacttaatgaaagtctgaactgtttgggatttgcccatccacctaggatgcagaaagctcgaaagagcagtgctggcaaccaaccttcctacaggaaaaggcaggtagaatgctaacttttctcaagctcatagggaagctgaggtctcagggccctcgaggtgtctgaatccaaagagatacagatggctcacctgtggcagatcatgggtggaaaggttgactgccgtacaaaggggtaagaagagatcagtaacactttagcgaattgttagagtcccagtgtggactggaatatcaatctggaatatctgagggccctgatactggaggagtttgcattcacttgtaggccattttctgtcggcctcctctgggtgctcatgagagcagggtgggaaagcagacaggcttcctccgtgttgtaggaagtgattggctgctgctgcagaaatagcagaaaaccctgactccctgctccaagataaagctaatcaataaaagcaaactgaggaacttgaaaataactaacaactagaataacttcaaagtcactgtctgtcagggacttaaacaaccattaaaggacaagacggaaaacatggataacatgtatgaacagataaggagaagtggaaactacaaaaaaaaactacagtcaaatgcaaatgtaggtaataaagccacgatatcacatatgaagaattcctttgagaagctcatccatacactcgatgaaactagggaaggaatcagtgaatttaaagatagattaggtcagtagaaattatttaaactgaaatacagagtggggaaaggagtaggggatgggaaacaaaaacaaaaccaagcatccaagaactctgggacaataccagccagtgtaacatacatgcaattcaagttccagaaaggaaaagagagcaataacaaggccggagaaatatttgatggcataataactgagaatttgccaaaaataatgaaaagcacaccagagatccaagaagcttcaagaatcccaagcaggacaaacaatcagaaagaatatacctggatacattgttgtcaaacggctggaaaccaaagataaagagaaaaccttaaaggcaaccagggcagaaaagacacattacaaacagaagtaataattacagtagacttttcgttcaaaactatgcaattctgaactatctagacttatagcatgagatacatttgatcgtcagaagagagagattttctgattagtgccagtattttataaatatgagctagaacctgcagatgaaaaactgactcattgtttgataaccagttctacttaaggtggagaaaatattttcaaaaagtgagttaatgaccaagttttatggcagatattgaaatatcgaagatattaatagattactagcacattactttatttcattgtggggtttttttgtaaaccttaaattaattaccaggttagagaaagcatcctcttctaaagccgggtaatttgaggaggcgtacattttgggttcaagataatcggctattttataaatgaaaaaaattaaaaataggcctggcacagtggctcacgcctgtaatcccagcagtttgggaagcccaggcaggtggatctcctgaggtcaggagttcgagaccagcccagccaacatggcaaaaccccatctctactatacaaaaattaggcacggtggtgcatgcttgcaatcccagctacttgggaagctgaggtgggaggtatcacttgaacctgggaggcagaagttgcagtgagccaagattgcaccactgcactccagcctgggctacacagcgagactctgactcaaaaaaaaaaaaaaatcaggaaactatggaagtacattccttatttagaacttgattgttaggtgctacagagagaaaattgtttagctataattcctgtcttctaagaatgtatagatctgaaacagatcacatttgcagagtatgtaaataacacagtaaaatgtaaataaagttcgtcaaagtcagtgattattgtattatatagtgcagcagtagtagtaaagaataccagctaccatttattcagtatctgtgttaaacctgatgtattaacattttaaaactcattatcttgcttgattctcatcctatgaaaagataatattaacattttgcagatgaggaaaatgtggcttcacagttcagtaagttgcccaacatccatgccacttagctggtaagtagcacagttgggattcaaactcagttttatctgatgctccttactgtgctacagtgaagcgcaatcataggaatttgaaatgcaggcagattttggtgttaaggcaggccatgctctcagttctactgtaatgggttaagttcatggaacgaatggtatttcttgattaattggatattgtgaagcagccatttcgatggtcaggagttagaatgttagaaacagcctgaaaggcccaaaagagctctccagtcctgatgtttcttgcacagttgttctttaccataattagctaatataaacgttcttgatttatagcattcttaatatgctggtaggattctttttaatttttaataagtatgggaccaggcgtggtggctcacacctgtaatcccagcactttgggaggctgaggcaggcggatcacaaggtcaggagatcgagaccatcctggctaatacagtgaaaccccgtctctactaaaaatacaaaaaattagccaggcgtggtggcgggcgcctgtagtcccagctactctactcgggaggctgaggcaggagaatggcatggacctgggaggcggagcttgcagtgggccgagattgtgccactgcactccagcctgggcaacagagcgagactccgtctcaaaaaaaaaaatttgtttttaataactatggtagtgtccatatcctcagaagaattgagaaattatatgtcagtgtgagataggagatttacagatcagtgaaagggagtattttctgccttggaaattatggaaattgaaatagtatctggtaaaacgtgcagctgataatatggtgaaaattatttatgatgcctcagactttggtaaattttcaaattcaatataatgaacataattataatattattcaaggcttagatgttttaaatgcattttcatttatacatagttgctcattacctatcatcttagatatgttaattctgtttctttaatgtagcaaatgtgagagtcttgtgtttaggagacaataatattaaacatctgtgctgctctgtagacttaattgcttttggaattacagcaaaattgaattacagtcaaccttctgtatctgtgggttccgcatctgtggattcaaccaacagcagattgaaattatttgggggctggacacggtggctcatgcctgtagtcttagcccctcaagatcttggctgaggtgggaggatctttgagcccaggagttcgaggatgcagtgaattatgattgtgccactgcactccagcctgggcaatacagtgaaagcctatttatgagagagataggtatattttatatttttttatagatatacataaatacgtatttatatgtatatatatttggggaagaaaaatggatggttgtgtcggtactgaacatgtacagactttttttcttgtcattattttctaaaacatacactataacaactatttacacacgaggtgatttcaaatatacaggaggatgtgcataggttatatgcaaataccgtatcatttcacagcagggacttgcacatctacagatcttggtatccttaggaggtcccggaaccagttcccccatgtataccagggaacactgtagttcaatattggttatcatggccgcgattggcaaagcaatatttacagaagaaaatcttgaccaggaaacatttttaaatttcagttttaattttgaaacgttgtttatttttaaaaaataactttagatacaactttaaaagaaaatcagtttgtatggtatttaagtttttttttcaaatttgttatgttttaaaaagcaagtattttctaagagaataagcatataacttcatttcaattaatacacttattaattccagttgactaacaatcaaactagtttttttaaaaagaacatttacttttctatgtatagcacacacaatatgtgtattttttatttgtgatttgatgagttaatgattctgtcctctgcactattctactaggattgtacttattctctacttatgtgtttctttacaagtgaatgttttttgtattacaatgtatagtagacattgaatagataattgggtacttaactttttattttgaaatagttataaattcacagaaagttgcaaaaacaaaaatgcagagaggtcctatgtccccttcacccagttttctccagtggtagcattttttgtttttttctaaatacgtattttctttttttagaggcagtgtctggtttgctggtagggaagaaagcctaatggcagtgagcgagggacggggagagtgaggcacgaccaactgcccatcccgtcatggtctggaactcaagtttccagagtttctctggggtccctttggccaacagggggtctgttcagtcagttaggggctcagaatttttttttttatttctcagggtggagatgggacccagcgtggctcagcttcccggcttctccaatggggacctcctttcctgtcctctgctggcttccaccttctgccaacagccctgttctttcctgccctttgcatgtgctgtttcttctgcctgaaatgcttctttccccttcccatccatccttctcttgtctagttaacacctattcatttggcaaatctcactcctacatccatcaagcctttcagggtcacagctcacataccgtcccctacgggccttttcttccctgcacgcgttacagttagtaactgtggaattggtgcttacgtggagaatgctagctgagaagttttgggggcagacacctgctgttgcccactgtttgtgccccttgtgcctaatgcagtgcttgcttacatggtcttcatatgtgttagttaaatgagaaaatattgtcacagctcaatgggttcttcttgcccactgcccagaaaagctaatgcaccgagaacagcaaatgttgcaacaaacagtttaatcatagcagggccagctaagtggaaaacagaaggcgtttctcaaatccacctccctgagaacttggaggctagagtttttaaagatactttgtcaggcaggggcctggggaactgaaacagttgataagctgtggatgaaatcacaggagtgtctaaactgcacagctgagtctgtttctggttgggaggtgggtctcaggaccgggtagcatctcttggtttgttgaaatgctaaatctgaaaaatatctcaaagaccagttctttaggttccacaataatcatgttatttacaggagtagctggggaagttacaagtcttatagcctctggctatgtgactctggtagtgagcaacttatagaaaagcaagcttagcagtggcaggtgattgtttaagtgtatctattgtttagcaaagtccaggcccctaccataattcaaatccagcctcaggaatgtggcttcagtccccaaacaagcaggaaggtcaggttttctagcctcaaagtttaactataaaccaaatttttcttatagttatcttggcctctgcactagaataagctaaagacaatgtagcctgagaggttagaagcaggatggagtcagtcatgttagatttctcttcttattacttacaattctgcaaaggtggtttcagtgtcattcttccacatatactttttttgtaaaaattattaaaacttggtgaagcatgaaaaatcttttaaatgtagcatgaatcctgtcaacaatataaaatatgatataaagtaaggtttaaagaaacgtgaacattttgacacaatctgttggcagatatgacttaaataaatcttgactgttaaaaatcctgtttgaggaagtatttctttcatacaagatgagcgcccctggtgtcagaaagccccaggcctgtgacctgtaccagaattcacactatgtagctttctcccatctgtgtcttagctctttaaaaatattgtcttttctgcctagtttacttctcttgctgccaaatggaaagagaaaaggctgtaggtttgtcatctgagcagtcagcagattctatgtctttcacttaagaagccgtttcctagcagttcttctattagttcattccttcacaaatctttcctgagtgtctgccgagtagactcctacaaagcagtggctagtttccgcttccagcagacagcccacgttctcattcacaggtggttaatttatacgaccataccactgagtaacttgccattggtctttatataatgtgtttctctttagaggggcttttagcttaattaggttgtaaatcggtatctttctttaataaacatcagtattaatgattttaaagtagagtaagattgaggaaagttcttgttcaactacattattaatttatttctaagaggatctgtatgttatagggttaggcctaattcatctcaaaaagaaagccttaaatcacatagggacattaaactaagtgtccaagctctacagttctttcagattcgaaaagaaaataatctgcaatacattattatgactatttgttaggatgtcagtttagctttaacactggcggacactgtgaattaccatttatttcttgacattttcatcttttagtcctattgtcagtgattatatgcacttaaaagtcaagagagtatttgaacaggcactcactaatagcaaaggaacagaaaaagtattccctttgaggttttaaatagatttttaaagatcggcgccagtgtcttagttccacgtaatcctgtattttcatgtacaaacccttatttgacaattaccactttttgaaattaaacagaatgtctttattcatgttgtcttgccaactaaaatatttaaagttattatttttaaactataatgaaattctattactcatgttacatttgatgttatttttaaatttcctggcttatacatagtgcagtgacttattacgcagtttactcacatatatattcttttgttttatcaagccactgccaaaaaatatggtgtctcgtctttgtgaatctaaaaaggtttgtgctgcagctgatatgcaacttcaggtatgtatgtacctttgttctgaagttttccggagtcattatcccaaataaatatataactttacattcttgccaatgatacctatttattataataattatgcttctaaaacatctttcatctgagttcaaagaacttgaccaaaattgactcatttagtcctcacactgcccttatgaagtaggcgttgaataaaattatttcctggccaggcacagtggctcacacctgtaatcccagcactttgggaggccgaggtgggcgaatcacgaggtcaggagtttgagaccagcttaaccaacacggtgaaaccccatctctactaaaaatacaaaaattagccaggcatggtggtgcatgcttataatcccagctactcaggaggctgaggcaggagaatctcttgaacctgggaggtggaggttgaagtgagccgagatcttgccactgactccagcctgggcaacagagtgagactctgtctcaaaaaaaaaaaaagactatttcccgttttcagttgggaaaaaatgaaagcttagaaaatttacacaacttctaaatcacacattttgccagctaaattaaggctcaaacttaattttatatatacatatgtttattcattttgtatctttttaaaatttttgtgtttttaggtttgaagtttagatagtaattgctgttagttttagataatattcaaaaccaacttcccaggttttgagatgaagaccagaaaactttcatgaaccatctggatgccaggtctgcatgacatcagatgcgtagatgtttgtaatgactgagattgttatggaattctcactcctcttcagatcttgagagttatgtaaacaccttaaacacccatctttcatcttaggcagtattcactttatgatgattcagttacctgtttaacaaagtaatcactatttaattgctttatagttttgtaaaattcagtccctagaaggtaataaatgtgctctgtttttctgtaccttcaaacatgaaatacatgtttcagtgaaggaaatctattatatagacaaaaccgtgaatctatatttgctttaccttactcagtatctattcatatcaatataatttttaaaggatttctgagttatttttaaaaattaacattacttggcaaaagtcttgatttgctgatatctttagtagaaggcctggcttttaaaagtctgttttgtggctttcttcttgaaaaagtgttctgataattttcttttaaaatggaaaaccaacctttccctcctccgccctccaaaaacaatagccccctagagacagagagaggcaaagtcctggtagaggagctgcctgggttcagcttttatattacacttggacagtggagatgaacacgggtggaaaggaagtgaattgtttcaactttctatggggacataaacagtgtttttaaggccagatgcggtggctcacacttataatcccagcacgttgggaggccgaggcgggcggatcacgagatcaggagatcgagaccatcctggctaacacagtgaaaccccaactctactaaaaatacaaaaaaattagccaggcgtggtggcaggcgcctatagtcccagctactcgggaggctgaggcaggagaatggcgtgaacccgggaggcggagcttgcagtgagccgagatcgcgccactgcactccagcctgggcgacagggcgagactctgtctcaaaaaaaaaacaaaaaaaaaacactgtttttaaaactgtacattttttaaaattattgttttaaaaataggctcttcatttttctgtgacttaataagtttcttggccccaggaatgcatgactccctgggtaggcagataggctcatgtctttggaattgtttagtttatcagcaaataagcataaaaagaatgcacatttaatttattttgctctgttttcatatttaatttattttgctctgtttttataattcaaaaaagttaccccatgtttatatcattttgtaaaaggcataattgaagaaatgaaactcttgaattctgatttatttatacattggggcaaaataacacctcagttgaggttagaatgtaagagtttcagttcctgataatttactctgttagaatataggtaagacattgagtaattttggcctccctgattatctttatgcatcgttactcattataaaatgtagaattgaaagagctatatttagctatatgtttagattaccagttagaagaaagcaatatttatatttaggaaatgtctgtatttttctagggaaggtttaaacttaactttataatttagaaccataattctatatctagatgcagccagaagccagaggtcatttaaattttctcttttaaccaaactaatcctcacttctttcaagtcaacagctgcacattctctacaaatcccatttctgaatcacaaagatacatatcagaagcataattgcatgtcaaaatttgtcctttaaaataaagcattttctacttgcctgcatgaagtcaaatgttcaagtcagtgttgaaaaacaatatttgagtcagatgttgcagtgaaaaaatgctttatgtttattttagatttctttgcaaaatttagttttcagtactttgtaaacagcagatttcatgtccaaactttctttaatgctttcttctcccactgtgtttcagtggcctatatcctctactcagaggagagtgctccttttcccctggtcatctagttgagccctccctatacagcagctgcttcctttgtacttcctgacaccaggtgtgggagtctagttccaacctctccaacagctgcatcagaattcttcgatacatctatactcacgagatgctgcattgctatttctttctctacccccaccacacctatttaattttctttcaccttttatcacaaaactagaattctgaccgtttcatttctctcatttaagatatatcaggattccaggaggaaaccaaacaacatttgttagatccagcgggtctaaagttgtaactggttttgtatatttctgcctacagatagatagatagatagatagatagatagatagatagatagatagatatagatttttttgttgttgttgttgttttttgtttggtttttttttttgagacggagtctctcccaggctggagtgcagtggagcaatctcggctcactgcgagctccgcctcccaggttcacgccattctcctgcctcagcctcccgagtagctgggactagaggtgcctgccaccacgcctgtctaatttttttgtatttttagtagaaacgggatttcactatgttagccaggatggtcttgatctcctgacctcgtgatcctcccgcctcggcctcccaaagtgctgggattacaggcgtgagccaccgcgcctggccttccgtctacatatattttggcaaaattccagttttgtgtcacatatttgatttgctgccattgtacataaagagtatcttatgggtatggttcaaaattctttaatattcttatttatgaaaaggttgagagcattccttttaatctttagcatggtcttaaatgtggtatgaaatacatttcaaaccatgtaagtttatttttgtgactgttttcaactgtgattggtaactgttgttctggtgcacttatagcatctttggtcaaccacatcttgatgtgaggatggacgaccaaaactaagtagatgtttttatctatctaggtcttttatgccactctggatcaaatctaccatgggaagcatcccctgaggaattcaaccacagacattctcaaggaaacacaagagaaattctatggcctaccatatgttccaaatactgtgagtccagcatttggcttctgttttgtgtattgagtggttctgctattacttctgtagcttgtgattatcttcccctttggagaacttgaaatccctacatttatgttgaggcttcacatggctcaaatgctggaaattgcctggttcatttaatatttccaactacccatttatatgttcttattttcctccctctaacagtgtttttgtacctttttggaaatgtgggggttaaaaaggccattggagttggtctatattcttctttttagttatttttctacaatgtgaaaaatagtgatgtaagatgaatgtgattaccagtcctgaatcattttcattgcaaagagaattaacatgtattgagtatcttacattgtaccaggaattataatagatgctttacatatcttatcttgttgagtaccatgtcaggagagagagcaggagtaatgttaccatttattggattctaggcgccagactctatctaattcctttgggaaaagatctctaatttagctctcaaaataaccttataaattaaattatatccttgtatttggggctcatttggaggcacagacacattatatgtcctgtctgagatcatctaggtagttaagtgattgtatgggggttcaaaacaaacaggcttttttcatcactcaaaggctcgtgtaaggagcagttgagcaccgtgactcctagtgcaattaacagtgtgattcttggtgcagttagcaatgtgactgacttaatgttacccaggcctttctcagctgcaagtgatagaaacgtggttcacacggacttaaacagaaaagggaatttattgagtcttgtaactgaaaggtgcaggggtgtaggggtgtttcaagtaagttggatttaggtctcccacaatatcgttagaaatgtttctctctctttctgcctctcagctcggtgtttttctgggttcctttcattctctggcaatccccccagactgaatggtttgataactaccggtaggttcaggtcgatgtccttctagcctagttggtctaacagaaggagagctaacttgaaagtgttttgtaaactataaaaagcagaataaatgtcaagtggttttatttgctctaagattggatagcagaatatgttgtgctaagagattaagttaatcaataaactacaattgtccactaaatcttcaggtcctaatgctcaaatatgcatgggaagagatcgtatttaccagacaagtgaagcaacaggatattttatcttcataatacctcttgtcattagttttcgattggcttagaaccttaattatctgctacaggtatataatgtcagtcatactaactaattttttaatcttacatgtaatttactattctaatactttctactgccaagctcttgattatctgtgttagtgaaaatttatagtgataagaataatctaactatttattcatggaataaataataacaattgcctagattttactagcattttccagttcacagagcattgcctgattcacctgcttttgggcttgtatgtttttgttctcatcttatattcttctttgtgaatatgagttaaacttcatgaccagtaagtagtaaagtcctaggaagactaacattaggagaactgggatgcttgccaaagctacaaaacttcagtttgactgagttgcttgccttctgcccttttttatcgtaggtctaataataaagtaattatgtctctttttaaaagaaaacttccttaccatccagatttcttctctgtaatcatttaacatacaaatatgaagtattagtggcaaccaaattctgaatcaacaatccataaatcacttttaatttgaaaggaagggtgatgctaagtccgtgtgccttgtcctaattccttttgagaaaatagaaagatgtatctctttactgggattagctccacaattcacgttcagtagccatcacttgctctttgtgtaaattgttttaagaggtctttaaaagaagcatagctatgtttagagaaaaaaagacattattttaaggcttgcctttaaaaaaaagtgtctgagagtttgtttagatttgtacagatagcctactcttcctacttagaaacttctgcatttcttcatttgtttgtcaatgcattcatcaagcctataacattcccgacatcaagttggtggacttgaccaccaacttggattcaaataaagctgtaggaattaagacagtctaacactggtgtagggatgcacagatatcagtgaaacaggagcaagagcccaacggcagactcagcaaattaatagactctcaaatataggttgagtgacactgtagattattggatgaagaaggaacaattttttaaagtggtgttgtagtgattgatctctatatggaaaaaaaaatgcagccctgtatcacactgcacacaaaaaatagagttaaagaccgagatgtgaaaagtaaagctttaaattttagaagataatacaaaagaattttttctttttgatagtgtttttgttgttgttgttgttgttgttgttttgagatggagtcttgctttgactcctagtctggagtgcagtggcgcagtattggctcactgcaacctctgcctcctgggttcaagcaattctccttcctcagcctcctgagtagctgggattacaggtgtgcgccaccactcctggctaacttttgtttttttagtagagacggggtttcaccatgttggccaggctggtctcgaactcccaacctcagataatccacctgtcttggcctcccaaggctgaggattacaggcatgagccaccgcgcctggccatgatagtgttttttatacccactctgagtatcttatattttatacagatgcttctcaacttacgatgcggtcaagtcccaataacccattgtaagttgaaactatcataagtcaaaaatacatttaatacccctacactgctgaatgtcatagcttagcctagcctaccttaaatgtgctcagaatgcttatgttagcctacagttgggcaaactcatctaacacaaagtctatttcataataaagtgttgaatatctcatgtaatttattgaatactgcactgaaagtgaaaaacaaaatggttgtcaggcacccaaagtacagtttctattgaatgcatattgctttcacaccactgtggagttgaaaaatcttaaagttaaaaaatctttaagttggggatcttctagatacaatggaaagccattaaacataaagcaaaagactgacaaattcaatgatatttaaagttaaataccacatagcataaaactgacttccccccctgccttcagatggagtctcactctattgctcaggctggagtgcagtggtgcagtctcggctcactgcaacctttgcctcctgggttcaagcgattctctcacctcagcctcctgagtagctgggattacaggcacctgccaccatacctgcctaattttttagtggagacagggtttcaccatgttggccaggctggtcttgaactcctgacctcaaatgatctgcctgcttccacctcccaaagtgctaggattacaggtgtgagccaccatgcccggccattggaaaaggttatatttttaaattactttgaataaacaaaagacatggatatgcaaaaaatgacgtaaaataacttaaatattaatcagggaatgcacattaaaaccacattacaatactcctaaaatattttactatcactggtttggcaaaaaataaaacaattgacagtatcagatgttggcaaggatgtggagtcacaggaactcttatacactgcaggtaggagagcaaattggtataaccactttgcagaacagatctgtgaaatctgaatatggactgccctatgacccagcaattcaattcctaatataacctagaaaaaaaaatgttttactttctctaccaggtatacttttctgtaccaggcatgaaaaaataggagggtttataacagcacttgttgtaagtagttaaaaaaaaggtgagggggaggattccgggaagaacccaagtgattgtcatcagagaaatggataaacaatttgttcatacagctggaatactgttcagctatggaaattgagggccccagttgatgagcctaacaagcataaggtaaagtgaaataaatgaataccagatgaatcaaactagtacatttatataaagttcagagtgatgcaaaactaagcagtacattgtcagataaatacatatgtgattagactataaagaaaagtgagggaattataagcacagaattcataggagtggattcacaggagtcttagaaatattttcttaaactgattggtgggtacatggttgatgactttgtcattctttctactaatagtagacatatagtcttggtagatagaaaacacttccaaggattaaaaggtgatctgggctacaaggtatggggtatgccaagaatggaccttggcaaagctgctggtggctcaaactaggacactgactgtggggagtggaagattgaaacagacctgagaacagtgcagaaggcataatcagtgcagtgggggtgactggatatatgggttgggatgatgagcaagatccacgggaatgggacaactgcaaggctttcaacttccatatcggatagaagatgactttgtagcgccttcccatgcgggccaaagagtgacagtgttccccctgtaaacttgtctccagaaattgtttctctgaaatgaatccttttattcccccaaattaaacaatgagaaaaggaaaatataagcaacgaagagtctttataatgcttatggagttgatacaaatttaggtacataatctggtacaaacttttagacagtgattttgcatatgtctatattagcaattctttaagtgcattaataactcatcttgggaataaagtgtcgcactagttatctttgagcaatactggtttaaacaacattgagctggcttctctactgaggaaccgcttggagtctgtaatatgctaacaaacattatgagtctctatcctcaaatgtattaaccctggaagtcttcatggataatttctaggcactagctttatgtaggtcatactttggaaaattgcatttacatgactgtaactatttaataggggcagctccacagatattccatattaaataatgatgctttctttacaagtcaataaatagccttctagtgtcggcaatttattgatatttgtgtgcatgctgagtcactctgtataaaatataggctaatttgtacttacttgctattccatctaacagtagtttgatgctggaaatccaaaattttctactcatttgtgaatagagggcaatagtacaacatataccaacaggctcaccttctgctgttaccacttctcttccatttagagaacagtgttgtgttgttgtgttttttatattcatgactgtctcttctcagaatattttccctaagcgattgtgtatctctcctatttttaattcaggaaatagaaaatgtaatatttttatttttgtagcattctaggtttgtaattttacattttcaccctcctctctgacacagttgagatacagtcgtgtccggaaagctctgggatgaaacttctagcctttgatcctctgactctgttctaatgtgtatttttcaagtacaaaacatgaacagctgactctaggttttgaagatctgttaagcagttgtattttagtgttttgacctaatttggtaggcttgtgggtttgggtggtgaggctgtgtctccagcacagctgttctcagagtgacagtgttctctgaataaatcttgccaccagtgagactcctttttgccctttagtgacctcaaattgaaaacagaataagaaagttctgagcactctaagtatttacatgaaaatataataatacgtctaagaaaattgtctttcttcacaactcacaatttaaaattcaccatcttgatggcataaaagttgttcaaagctagaatgaaaaagttattttaggaaagcagttactgggactgaaggatatgttgatatttggtccttctcgttagaacaaacaccaacaaagaatatgaaaagaagacatgtttcttgtgaataggattcactccacgtttagggttttatttttgcatccagcaacaaactggcatattatagtgacaccgtgttagcattagttaaaaattatcctaggccgggcgcagtggctcatgcctgtaatcccagcactttgggaggccgaggcgggcggaccatgaggtcaggagatccaggccatcctggctaacacggtgaaaccccatctctactaaaaatacaaaaaattagccaggcgtggtggcgggcgcatgtagccccagctacttgggaggctgaggcagaagaatggcgtgacccagaaggcggagcttgcagtgagcccacatcgcaccactgcactccagcctgggcgacagagtgagactccgtcccaaaacaaaaacaaaaacaaaaaaattactctaatttgcctgggtgtggtggctcatgcctgtaatcctagcactttgggaggccgaggtgggcggattgcctgagcttaggagttcgaaaccagcctgggcaacatggtgaaaccctgtctctactaaaatacaaaaaaaaaaaatcagctgcgcgtggtggtacatgcctgtagtctcagctactggggaggctgaggcaggagaatcgtttgaacctgggaggtggcagttgcagtgagccgaaatcacaccactgcaccccagcttgggcgacagagcaagactctgtcaaaaaaaaaaaaaaaaaaaaaaaccaaaaaaattattctaatttaccctagagaggggatgagggatgtattatatgtattaatccattctcacattgctacaaataaatacctgagactgggtaatttatacggaaaagaggtttaattggctcgtggtttttgcaggctgtacaggaagcataacactggcatctgctcagcttctgggaaggcctcaggaagtttacactcatggcagaaggcaaagggggagagtggtgtcttacatgatggcagcaggagcaagagagagagagggtaggtgccacatacttttaaacaacccgatcttacaagaaatcactattgtgtcaacagcaccaacggggatagtgttaaaccatgagaatccaccccaatgatccaatcccctcctaccaggccctatctccaatgttgtggattacaatttgacatgagatttgggccaagacacatatctagactatatcgggggatttatataatctataaacattggttacctgtccatctttttgagtaggtgtgtgctgcagacttattggggacataatcagatatacctgatttgctgcagtatactcaaggtgtattagttgagaaaggttgctgctactggagactggtttctattcagactaatttctattaagtctaattatgtagaagtgatatatatttcatattaagtataattttctatgtgtaacaaactgtttttagaaaaaaactgccaaaaattgtgctgaatttagtcagacactccaaagagcaaacacacttttgttttttagcataaagaaaactatttcaaatcccaattaaaatagttgtacaataatttgctttttgtatttatattgtgataactacaaatttttaataattgatataatgtatatgtatgtgttatctttttattaagtgcctactacgtgctaccacatggtctaagcaatggatgtaacagtaaataaagtagaccagaatccttgctctcatggagcctgtattcgaaatagccttttagatgtgtatttgctaaccaattcatcattatatctggctgtcctgtcagacatctcgttattaagcaaaatagttctcaagcctatcaaattgctttgagttgtgagcagagagactgagcataaaagatgaaaagattgagacattctgatgcgtatacaactaataccgaggctatattgggatcctcgtttttaatttccagagggaggctccttccctgaaacattaatgagaaaaaggtaccttttgtgtttttgtagggctcttgcattcttcctcactcttgatgatgtggcaacctacacctatttgttgtgcatcagcaagctttcctggaggctaaagaaacaagatgaccaggcagaatagaggagtgctttagaggttcacggcagccagcagacagacctgggtgtttggtgcttgctagtttgggaggtggtgataaaagagaaggagtgggaatgacacccactgttttaataaaatgagccatctgtgggggtggggatgacgttcagaaacagagtacaggaggggtggtagctgcttcatgcagtgaggagtgcatgggtgatgaatttcatttgatgtgactgtagaatatccaagtggagatgaacagtgttgggccagtgggtccacagcccaggagacagagcaaggtgggagctctgtagatttgggagtcattagtctagtgaaggtactaactgtgggaaggggcagcagggaacagggagagtttgctgtgtaggatgaggggaaattgaggagattacccagaggtgtgtccgtcaaagggcacagactgggtcagccagtgtggttggcatgatgttctcattggaacagccttttctcaagtaccagcaaaacccaaaattttaaacattttcttttcagtttctactgctataatcacaacaatataatgctctgctcctttctattattttagggttacattggctgtatagtggcttgaaacatcacttatagaacatttgttttggatgtgtgttgtgagttcccaagtaacagaatagtgaatgaacttttagcatataacttatgtgtaatttgagggcttcccatgttaagattgcttgatttctagagaagattcttaagctgacactgctgttaccatgattatgtatgcaaaggaaagtaaccactgtaccagcttggagatggagtgcagctagtggtgaaccctgttgtttacatagtgtgctcatccggattaactttcaaacatgcctcttaaccatgtggaaagatgagaatagggagatgaaatcaatataatggaagagtgcagagagattttgagagtactgttacatttactacgtggagtttttttgttttttttttttagtagtcccaaaaagaagaaaaatttaaaacctaccatgagaaaatggcattgttatgcacaattttggtgttaatgctttaatatattattactactagagtttcttttctttcctgttctctcattcccttgatagtcaatttttgtttgtttggtttttttttgagacggagtctcgctctgttgccaaagctgtagtgcagtggaacgatgccagcttactgcaacctctgcctccccggttcaagcaattctcatgcctcagcctccccagtagctgggattacaggcatgcaccaccgccctgataatttttgtatttttggtagagatgtggtttcgccatattggccaggctggtcttgaactcctggcctcaagttatccgcccacctcggcctcccaaagtgctggaattacaggcgtgactcactgcatcctgccgatagtcaatttttaagagcttctttgttcgatatatagagcatacatgtatatacatatacacacacacatatatatataatatatgaagataggtgacatttaaacactcaagcatattaacaattgtgtgtgtatatgtatgacagggtcttgctccatcacttaggctggagtgcattggcatgattatggctcattgcagccttaacctcaaggctcaactgaccctcctgtctcggtttcccaggtagctaggactacaggcgctcatcaccacaccccactcccagctttttttttttttttggtagagatgaggtttcactatgtttcacaggctagtcttaaactcctggcctcaagtggtcctcctacctcagcttctcaaatgtttttgtgtttttaattttaactgtatatcttaaagctgttcatgggtgactttacaactttatttcagttgttaatataaaagtgtagcaccacgtattgacctcatgtagcatcaagtatataatgattttaccttaaaagcgttaattttagaatagttgataagacatgaagataagaaaataattatccattaagtgatttctgtcatctagattaaaatgtcaatcagattgttcccattagttatttttaaactaagacaggtaagtaaccgtgatcatatggggagtccttatacagaaatcttagggttgctttggaccttggctatttttatcccacacttgttcagatgttggttgaaagaatggcataagggtctgtttttaaatgtataaacaaatatattgtctattaaacaataggactggagccccaggcgggttaaatatttactgctctctctccagagtattcaatttaaactatttggtaaaaatgcttattcctcctattctttttttttttcttcgccctggggaagaagtttcctcctattcttatgccccagctctcctgcaaatggaaagtctcttccatgaggtgaagttagtgcctgggctgagctagcttggaatatttgatgttgctaagcaaacatcaggttaaagaaaacaatatttatttttgtttttatcttaaatacgaagaaagaccatatggtgcatatctagaaacacctaagtggttaattgcatgttaaatttctttcctctttgcctgcataaacaactgaaaaaatatttactttctgtgtcatgctaggtttatttatgactttgtaactaaaacacagaagtgttataaattgaaactttaatctcatgattgactcattttctaaaaatttatatggtttcagtttgtgggacagctgcaactctagatttcagtgatttaaaacatgaggaaattatgactacccggttgtttttttaatatggtcctttgagccaaatcaccaactttcatttttgtcttggttttcatgaataatgctgccctttttttcttctcggcctgcaatttgacaagctagatataaggaactaaaaatccaggctattagtagaagttatttctttaccaggtaaacttttgtatcttaaatgatgcacatgtgtcttttagatttaggctgtttctatttcaggaagcgttttctctggtaattttctgaggtaagtcccgtttttactcacaaggaatgagagccggacacagggaccattgtgatgcctctttacctttatgccttatcaccaacagggagttaaggcagcgttagcaatatgaggaaggctccagttgagtgttgttaatttttaattttaattttatgttgagtaagtaatacatatgcatgattaaaaaatcacagggtgtcaaaagctttacaatacagtctccctcctcctcaggtccctttctctggaggcagcctggggtactatatcacactgatttgaagatgaattacctcggttcaacataaatttaaagacataaaatctgcagttctcagtcacttcctcctcttaatattcttcttgccttttctcatggatagagcagctctagactggactcacagtcttcccctaatgagcgtcctaggaagtatctgctatacaactctcaaatccacacaacattagtgaggtcttttctaaatacagatttgagtgtgacgtcccttcccttaaaaccctcaatggcttccattgatcttaagctaaaggccagagtcctttgcccacttgcaagttcctgcgtggtctggtcacccaagcttcctccagcaggacacagcctgcttcctttggcactggagtcttggcacttgtttctgctgcctggagtgctctctttctgctccctttgccttctgcttgaaccatcatttctccagacctggccagcctctgttacagtctcccagggctggggtccttcccttaagatgggtcatctcagtttataatgtattgatgccatttgattcatttctatcttcccaactggagtgaacctcaaagaacagcatggctcatttctgatttgtttattgttttcccagggccctgaacagttagtagtatgtacccaataaatatttactgagaaatgtttttacatttttattgagatataatgtacataaagtacacaaatcttaatttatagctccatgaacttctggaaatatgtttgcctgtggaaccaccacccagatcaaaatatatacatctgcagttatccagaaggctcttgcgaccccctttaaagttaaccactagttttgcctgttttgaccttcatgtaggtggcatcatacagaaatcctcttttgtgtctaatgacttttatacaacatgtctgtgagatccactgtcttgttgcatgttttagtaatctgttccttttcattgctttgtggtattttcttttccagtatgccacaacttatttatctgttccactactgatggacatttgagttatttccagtttggggcttttatgaataaagttcctatgaatactcctgtatgtggtttttggtggacataaacattcattttagctgagtgaaatggggaacacttttgtttagttttattttgctatcgccagtttttcaaagtgaccatcatgagttacattccaaccagcaatatttggatatttgcttcatcctctccagttataattaaaaggatgtaatcaatcctttttacttcagccattctggagcatggagaatgatctcactgtggttttaatttgcacttgtctcatgacacccactcatactgggtgcttcttcatatgttcagaggccacttgaatgtcctctttgtgtaagttttctctaatctggatgaaataggagggtttcaaacagaggactgacagatggaatgtggaatgtaagagaaagaagtgagttgaaaattactgcaagggttttgatctgagcacccaaaggatggcattgccattaagatggagaagacggccagacatcgtggctcacacctgtaatcctagcactttgggaggccaagatgagaggatcgcttgagcccaggcattcaagaccagcctgggcaatgtagactaaaaaattatctgggcatggtggcacgcacctgtagtcccagctacttgggaagctgaggtgggaggatcacttgagtccagtcaaggcaatgagctgtgattgcaccagtgcattctagcctgggcaagaccctgcctcaaaaaataaagatggagaagactatgaagactatgggaaatgtaggtcttaagggagagcagaagatcaggaaatactaagtttaagacgtctactaaacaaaccagaaaagatgtcaaataggtagttggatgtacaagttcagaggactggtctgtgctggtgatacccatttggagtcatccccacacagattgtatcaaaaagccaaggaactgggtgagatcaaccccaagagtaagtataaatgggaacaatctgtctaaaagatgagccttggggcattccaacatttagaggcggggacagtgaggaggaaccaaaaaaaaaggtgaattgagagggagacaccaatgaggcaggaggaaaaagagggtaatgtcttggaaccaactgaagaaaatgtttcaaggcagagtgagtgagtgattgtatcaaatggtacctttagggtagaagagctgagaactgagcaacaactattggatttagcaaggtgaaggtcgttattgacttggataagaacattatcagttgagtggttggtgggacaaaggctaaatggagtgggtatcaagtaaagtgagagagaagaattggaggcagtgagtagaggcacttctggtgttttcctgcaagagaagaaaaattgaacttggaggagatgtacagataaagggaggttgtttttgtttttttgcttgactgactgatttcatttggatttttaacgaggtgaataatatgtgtaagtgaatgggaaagatctattaagactgaaaagccagtgatgcaggggagaatagacaaggggaagggatttttgtacgggtggaggggttagcccgtagagcccgagagcacagcctaaccgtctttagggtgtgtgaacaaagatgcaagcagtgggtagatggtgttgtggaagtcctcttccggggctttgctcagtcaatcggaagcagggcaccagctgagcatgcaaatggggcagtgctgctggcatttgaggagagaggagcaggtataaaggagagtgggagagatggcagagtggagatgtgagttatgattgcaggccacgttaagggcccaagtggggttagtgccactggtttgaaaagagagctgtggggatggttgtgtgcttttcctggccatactcggtgcctagctttcaccagggctgtggttttgccaagtgaatgtagagtatagtccaagagcaggccatggacctgagggttattcagagcaactgtgacaactgactgtgggatttaacaaggcagaggacagtgagcacatgagggagctctggcctggtgaacatttggaagtggattgtgaggtcccagtgggattggagatagggtactagagagttagctgaaaagacagggtgtgattgttgagcaaaggaatgcttggagtggatattatgaaggggttccagttacagtaatggcaaggcctagattgtaaccatggagtgagaggctgagttagggccaagaacatcatcactaaagaagagaaggtcaaggagtcgagaggccagagtattagttgcctattgttgctgtaacaaattaccacaaacttggtggcttaatatagcaaaaatgtgttttcttagaattctggagaagaccacagtgagtgttaatgggctgaatgaagatgtcagcagggctgacttcttccagaggcccctaagagcatccagtccctgcctctccccactccatgaggcagatggtgtgccctggctccgggccacaggctgcattctctgcttccctcatcacattgcctccccctccttctacttcttgcttttcttttataaggacccttgtggttctgactagggcgtactcagataattcaggataaccttctcacctcaggatctttagcttaatcacatctgcaaagtccatttttttcccaaataaggtgacattcacaggttctagggataggatgtggacatctttggaggagagggcattattctttctgccacacagaacatttgaaagattagctttgggggcattgctgtcatcagaattctaacaggagtaggattggtgagagtgaagtaaaacagaagtaagaaatcttcaaggagtgagtgagaaggacggacgcttctgctagtgactgcagtagtgaagggtaaagaggattatggtccactgtcagcaaaatcagagttggagtgttctgaaggagaaggaactggcagtgaaaaccagagccaacacctacttgccttcagacccagtcatatgcaggatttggcgagaaaccagccgtgtcatgaaaaagttgcaagggaagtatggttcttagcagagacctgggtttcttttagaataaaaaggtgaaaggaaccttcaaagaaggcagaggaaaatacaggtggttttgctgatgactggattttagaaagctcagcagaagaaaagggaggaaaaagaagagggcagaaagtggatacagagaacagccaggagagcagtgctgccatagtcatgggtatccacagggttaaaggtctcaagactgatcgcagtggaactgctagtgcgggtagaggggagggtgggaattcccagcagagcacgagggcgtaggatgaggaaagccccaaacccggcaggtgggagaaactgagggtcaacaagaagggcatggaaagtgagatctgtttttatgttagcttgccaaatagaagtacagtatttctttctctttatttgtacctgatactctgggtaatgcagaggccaggatgaccgttcagttttgtgctgaagctaagaagctttgcgtagctttccaaactttggagtaatgctatggggccagaatagactgaggattaaggcatttacctaaggtgttccgggcagaattagtacacacattgcctgacatttggactggagctctttctgttactctattttactgtcatgaagtaaattccagatagagtaaacatttaaatggaaaaacataagccattaaaaaaggcttctatagacagatagctctttttcatttagagaaggttggtaaatgtaatagaaatggaagaaatcacaaatgcaaagagtagtagatttgaacttctctcataaaacatgatgaataaaatgtactggcaaacaaactggtttttttaaattatatgacatatggtttacgttttgctgcataaagagctcatacaaataaaacaatgacaacagaagaacaattttttaaaaatcccaacattggccaggtgcaatggctcacacctgtaatcccagcactttgggaaggcaaggtgggcagattgcttgagcccaggagttcaagaccagcctgggcaacatgacgagaccatgtctctacaaaaaataaacttagctgggcatgttgctgcatgcctgtagtcccagctacttgggaggctgaggtaggaggattgctccactgagatagataattttatatttgttcataaaaggataaatttgtttaaaaggagggaccaagaacctgaagagtttacatatcccttaagccaataatgtaacatttaagaatttgttctaaaggaataaatagaaatccaataaagcttggtgaactgatcatcataacatgtacaaaaacattggaaagaatccagcattcaaggaatggctagataaactagtgcgcatcatgtggttgtcactaggcctgctcactagtaatccagctctcctatctctgccccatggtagaattgcactttcatgccccttgcagttatttgtggccttgtgacttaatatgaccaaagaaatgtgagcagaagtgatgtgtatcattcctaggctgtggccttcgagagctactatacagttgtccacatctcctgcccttggttcagcagtcaatgacattccagttggtggaggtcttgagaacatgggttcctaaatactgatagtgcgagacgggcccactgacctgtgatgacatgttgtatgctcaaggagcaaacacagagattttagggttcatgtgatcacattgtaacatagcatagcctaatatggcccatatgaaataatatgcagtcattcatgtttagaaagaattcataaataagtttagggaaaaactgataggaaagtatacatagtgtgattttgtctttttaaaatagactgaagaaaactttgaaacattagcaaatattgatcacacacgtggattaagggtgggagtttccttttttatatttttcacagtattccattttttctctaatgagcatgtattccttctaaaatcagaagaggaaacacacaaacatatgcacacccaccctcctccagctgactcccagtggtatggccattcagttctctgtgaaccattaaagaggccacgctcatggaaatgatagtaatcatagggacccttttttacctggagagtgcagctgaggtggaggatcaggactaaacttaacttgggctcagagtagaaatttcctgtcatcatggctttagttctagatataacatccatttccctagagcctaaattctttccctctcctttaaatgatcttggagatagagaatgcaaactcacttgcctcggaaaagctgcatcctaaaagagatattcttggaggtggtaactagacttttcgcaatgctgagcaatcattcactgcagagcactccctggaagtgccgtggtaggggacacgagagaaagagaaagtgtgttatttgcctggataaaacacacataaatcaataaatgaaaatgaataggatggtgtgaggaggtgggacctttgggagatctttaggatatgaagatagagccctcatgaagggattagtgccttagaagaagagacaggagaagcatgtgcactcctgctgtgctctctctctctctgtcttctctctctctctctctctctccctctccccgtctcttgctcttgctctctctccccccaccctaccatgtgaggatgcagcaagcaaactgccatctccacactggaagcaggccgtcatcagacactggatctgctggtgcctggattcttgcacttcccagcctccagaactatgagaaataacttctattgtttaagccacccagtctatggtattttgttatagcagcccaaactaagatgtgtagtttaaactttgtacatttttgttcatcagacattttcctaagacctttaccactgtgtgtcagacacaacatgtggatactttgcactgagcaatctgcttgccacttacctgcgtgtcaagctgtggcgttcccatcacccctggtttgtctcccatgtgtgacttctgctcctagttgaagttagtattcacattcactctgcttgctctgaaatcttgccccagaccctccttgtgttcaagattgtgtactcctttttcgttattatagaaggtctgcataactctgtgcacttgactactttagccttaaaataagtccgtaacagtgtactgctgggccaaaaggtaagcaaagttgatgttcccagacacgttgcaaagttgtgcaatagattaggtagttttcttttgacaaccctcactgctgattttaatttttgccaatctgatgctccacaaatgctaacttagttgtgcttgcaattcatgtattactagtaaagtcactctttatttttttttctttttaccaactatatggggagtgaaatgcctatttttattattttcccatgtttatgttgatctttcttttgctattgatttttatgaaaatgttaatcatttatccttcttgatatacgtatttcccctattttgttatttgtctttcatcttttatgattttttaacatcgaaaagattttatttttgttgttttgcttgtatgttgttgatagctttaattaaatctattagactttttccgtttcctgttatgcttaaagagaacttcttatctaagattatttaaatttttgcctatattttcttctagtatttatgattttatttttcacattaaatctttaattatgtaaatttgttttgatgtaaagtatgaaatttggaaccagctttagtttttcttgtcttttttaagatacggtcctcactctgttgcccaggctggcatgcaggggcttagtcatggctcaatgcagccttgacatcccgggctcaagcagtcctcccacctcagcctcctgagtagctgggtctacaggcatgtgccaccatgcctggttaatttttttttattactgttttttgtagagacagggtctcacgatgttgctcagtctggttttcaactcctgggcttaaagggtcctttcgccttagcctcccaaagtgctaggattacagacgtgagtcactggcagatttagtgtctctacatcgttataattcgtcttttccccactgatttgaaaaggtatttttttgtcagatactaggttttcatatgcaacaagatttgtttctcagccttctgtctcagatgttcttgcccaggctggataatcatttgtgaagtttttaattgattgttgatggatttttaatatgaaatttttactgttcgatttacctgcctattgctagcatactatcatatatgttcttcttagaagtccctcatacaccctttttttctttttttagaggacttctttctttttttcttttttttttttttattatactttaagttctagggtacatgtgcacaatgtgcaggttcattacatatgtatacatgtgccatgttggtgtgctgcacccattaactcgtcatttacattgggtatatctcctaatgctttccctcccccctcccccaaccccaagacaggccccggtgtatgatgtccaagtgttctcattgttcagttcccacctgtgagtgagaacatgcggtgtttggttttttgttcttgcgatagttttctgagaatgttggtttccagcttcatccatgttcctacaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcaagtgcctttatagaagcatgatttataatcctctgggtatatacccagtaatgggatggctgggtcaaatggtatttctagttctagatctttgaggaatcgccatactgtcttccacaatggttgaactagtttgcagtcccaccaacagtgtaaaagtgttcctatttctccacatcctctccagcatctgttgtttcctgactttttaatgatcgccgttctaactggagagagatggtatctcactgtggttttgatgtgcatttctctgatggccagtgatgatgaacattttttcatgtgtctgttggctgcataaatgtcttcttttgagaagtgtctgttcatatccttcacccactttttgatggggttgtttgttttattcttgtaaatttgtttgagttctttgtagatcctagatattagccctttgtcagatgagtagattgcaaaaatttcctcccattctataggttgcctgttcactctgatggtagtttcttttgctgtgcagaagctctttagcttaattagatcccatttgtcaattttggcttttgttgccattgcttttggtgttttagacatgaagtccttgcccatgcctatgtcctgaatggtattgcctaggttttcttcttgggtttttatggttttaggtctaacatgtaagtctttaatccaccttgaattaatttttgtataaggtgtaaggaagggatccagtttcagctttctacatatggctagccagttttcccagcaccatttattaaagagggaatcctttccccatttcttgtttttgtcaggtttgtcaaagatcagatggtcatagatgtgtggtgttatttctgagggctctgttctgttccattggtctatatctctgttttggtaccagtaccatgctgttttggttaccgtagccttgtagtatagtttgaagtcaggtagcatgatgcctccagctctgttcttttggcttaggattgtcttggcaatgcgggctcttttttggttccatatgaactttaaagtagttttttccaattctgtgaagaaagtcattggtagcttgatggggatggcattacctataaatagggcattaccctatttatagatggggaatctataaattatcttgggcagtatggccattttcacgatattgattcttcctatccatgagcatggaatgttcttccatttgtttatatcctcttttatttcctcgagcagtggtttgtagttctccttgaagaggtccttcacatcctttgtaagttggattcctaggtattttattctttttgaggcaattgtgaatgggagttcactcatgatttggctctctgtttgtctgtgattggtgtataagaatgcttgtgatttttgcacattgattttgtatcctgagactttgctgaagttgcttatcagcttaaggagattttggactaagacaatggggttttctaaatatacaatcatgtcatctgcaaacagggactatttgacttcctcttttcctaattgtataccctttatttctttctcttgcctgattgccctggccagaacttccaacattatgttgaataggagtggtgagagggggcatccctgttttgtgccagttttcaaagggaatgcttccagtttttgcccattcagtatgatattggctgtgggtttgtcatgaatagctcttattattttgagatatgtcccatcaatacctaatttattgagagtttttaacatgaaggctgttgaattttgtcaaaggccttttctgcatctgttgagataatcatgtggtttttgtctttggttctgtttatatgctgtattatgtttattgatttgcatatgttgaaccagccttgcatcccagggatgaagcccacttgatcatggtggataagctttttgatgtgctgctggattcagtttgccagtattgaggatttttgcactgatgttcatcagggatattggtctaaaattctctttttcggttgtgtctctgcccggctttggtatcaggatgatgctggcctcataaaatgagttagggaggattccctctttttctattgattggaatagtttcagaaggaatggtaccagctcctccttgtacctctggtagaattcagctgtgaatccgtctggtcctggattttttttggttggtaggctattaattattgcctcaatttcagagcctgttattggtctattcagggattcaacttcttcctggtttagtcttgggagagtgtatgtgtcaaggaatttatccatttcttctagattttctagtttatttgcgtagaggtgtttatagtattctctgatggtagtttgtatttctgtgggattggtggagatatcccctttatcattttttattgcgtctatttgattcttctctcttttcttctttattagtcttgctactggtctatcaattttgttgatcttttcaaaaaaccagctcctggattcattgattttttgaagacttttttgtgtctctgtctccttcagttcttctctgatcttggttatttcttgccttctgctagcttctgaatgtgtttgctcttgcttctctagttcttttaattgtgatgttagggtgtcatttttagatctttcctgctttctcttgtgggcatttagtggtataaatttccctctacacactgctttaaatgtgtcccagagattctggtatgttgtgtctttgttctcactggtttcaaagaacatctttatttctgccttcattttgtcatgtacccggtggtcgttcaggagcaggttgttcagtttccatgtagttgagcagttttgagtgagtttcttaatcctgagttctagtttgattgcactgtggtctgagagacagtttgttataatttctgttcttttacatttgctgaggagtgctttacttccaactatgtggtcaattttggaataagtgtgatgtggtgctgagaagaatgtatattctgttgatttggggtggagagttctgtaggtgtctattaggtctgcttggtgcagagctgtgttcaattcctggatatccttgttaactttctgtcttgttgatctgtctaatgttgacagtggggtgttaaagtctcccattattattgtgtgggagtctaagtctctttgtagatctctaaggacttgctttatgaatctgggtgctcctgtattgggtgcatatatatttaaaatagttagctcttcttgttgaattgatccctttaccattatgtagtggccttccttgtcttttttgatctttgttggtttaaagtctattttatcagagactaggattgcaacccctgcctttttttgttttccatttgcttggtagatcttcctccatccctttattttgagtctatgtgtgtctctgcacatgagatggatttcctgaatacagcacactgatgggtcttgactctttatccaatttgccagtctgtgtcttttaattggagcatttagcccatttacatttaaggttaatattattatgtgtgaatttgatcctgtcattatgatgttagctggttattttgctcgctagttgatgcagtttcttcctagcatcgatggtctttacaatttggcatgtttttgcagtggctggtaccagttgttcctttccatgtttagtgcttcctttgggagctcttgtagggcaagcctggtggtgacaaaatctcccagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatttgctgttagtctgatgggtttccttttgtgggtaacccgacctttctctctggctgcccttaacattttttccgtcatttcaactttggtgaatctgataattatgtgtcttggagttgctcttctcgaggagtatctttgtggtgttctctgtatttcctgaatttgaatgttggcctgccttgctaagttcgggaagttctcctggataatatcctgcagagtgttttccaacttggttccattctccccgtcactttcaggtacaccaatcagacgtagatttggtcttttcgcatagtcccttatttcttggaggctttgttcatttctttttacccttttttttctaaacttctcttctcgcttcatttcattcatttgatctttaatcactgataccctttcttccagttgatcgaatgggctactgaagcttgtgcattcgtcacgtagttcttgtgccgtagttttcaactccatcaggtcatttaaggacttctctacactggttattctagttagccattcgtctaatcttttttcaaggtttttagcttctttgcaatgggtttgaacatcttcctttagctcggagaagtttgatcatctgaagccttcttctctcaactcatcaaagtcattctccatccagctttattccgttgctggtgaggagctgtgttcctttggagggggagaggcgctctgatttttagaattttcagcttttctgctctgttttttcctcatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagacccagtttgcctgggtatcagcagcggaggctgcagaacagcaaatattgctgaacagcaaatgttcctgcttgatcattcctctggaagcttcgtctcagaggggtacccggccgtgtgaggtgtcagtctgcccctactggggggtgcctcccaattaggctactcgggggtcagggacccacttgaggaggcagtctgtccgttctcagatctcaaactccatgctgggagaaccactactctcttcaaagctgtcagacagggacatttaagtctgcagaggtttctgctgccttttgtttggcaatgtcctgcccccagaggtggagtctactgaggcaggcctccttgagctgaggtgggctccacccagttccagcttcctggccactttgtttacctactcaaagcttcagcaatggtgggcgcccctcccccagcctcgctgctgccttgcagatcaatctcagactgctgtgctagcaatgaacgaggctctgtgagtgtgggaacctctgagccaggcgcgggatataatctcctcgtgtgccgtttgctaagaccgttggaaaagtacagtattagggtgggagtgatccgattttccaggtgccatctgccaccccttacctttgctaggaaagagaatcccctgaccccttgtgcttcctgggtgaggcgatgcctcaccctgctttggctcacactcggtgggctgcacccactgtcctgcccctactgtccgacgagccccagtgagatgatcctagtacctcagttggaaatgtggaaatcacccgtcttctgcgtcactcacgctgggagctgtagactggagctgttcctattcgtccatcttggaactgccccccccatacacctttttaaatgtatttgttttatggttttttgttgttgtgaatgggatgtttatcctcccacctttttctagctgattatcactgatacataaggaagttacttgttttcatttgttgatttttgtggctggaaattctaatgaaaacatactatctttgatacctgccacaatttcggggttttctacatacacatcgctcacaacatttgtaaataacatttttgctgctgctttccaatagctgtacgtttctgtttgtcctcagctgattcaatggcttgaactttcaaactgttgctaaataataatagaaaaggcaaacatccttatttggcatgtttctggtttgacctatggtttgaaagagtgctagtgtgtgtacttgagagaagagaacattccaggataaagagtgggcatattcaaattaacaagaaaggattgagaaagttatgtgtggaaacaggttgtacaaagctgaagctctgtgtggaggagttacaacatgagtagaggtggctcctctgaggagagtgagattaatcagatatgatggataattcaggcatactgtagagtgtggtgttgtagaatcaggtgagctaggcgtgagatcttcatcagtaagatggtgatatctaaatcacaggactatgactgaaataatgtatgatcaaagcacttagcccagtgcctggcacccagtaaacactaagcagatgtcatgtattattattattattattattatgtcagtataataaaataatgtagagcttgaaaggggaattgaaaaaaacgggtaattgacatgataaaaatggtatgtgtaaataaaatcagttgcacataggatgtgtcaaagcaagaaaaacaaatagaccaaaattgatgggaatctgtgtgttcagcattctttcattagtgagttttgagggagtctctgctccccaaggctagccattggccaggccaccaggggtccccatgataatgcacagctagttgcttgagcatggttatggtgattcgtgcccccaacagccttccatgaccatatgtgattattaatgtgctagaatagtttatcttggtgtcttgcacacatcatgatttgtaatgtatatatttaataattataaaagaaagcagttatttgctttctttaacatacattatcttcaaattcctaacttagtgatgatgcaatcattcttttcacatgtgtatgtttttttgtgtcttggggaagctttgaaatacttgctgatttatggagagtgaaaagtgaaccagactttctcagaacatttagaaaaactcagacactcaaaagctaaaatcaaacagtatttgaaatgatttatacaattgcagccataactttttcccacttaagccaaagtacgtctaaacaatcctttcatactgctaagtcctttaaatggaagcaatagatgtctataaatcaaatgatagtttacatttatttcataaccactttttctaacccattttccctcttaaaacttagtatgtcctctaagaagttgaacactctgtcctgattgaatttaaatgaacatgaataaagaaatacattaaaatattttagagaataatatgctgccacagttagtttagagaagcacagtactgaaggcaagtagagtaacactaggtgcagtggagtttgcttatttgaaataaggtaattcagctctaagctcatcagtagtgagtaataaacatgattactgcagtggagtcaatctcaaactagtctattggactaatccttggaattcacaaaacactctaatcttattttttaataacttcttatctcaaaatagtttatgttcgtaagttgcaaagtacctttcacccagcttccccagtgataacattctgtgtaaccatgtgtaccgtcaaacccaggaaattaactgtggtacaatactgtaacacagtaatctgaattactttcacatcctctatttgttcattatgattacttcagaaattcactgtcttttattttctaggatggtgcatctcagaatggttagcaaaacatagtttataagtttaacctacaacctatgactccttttgttctgtttagatgataaccagattttaagtgcatcatgaagacaggaacaacagaagcaagatcagtagagacttgcacatcactgggacttgccctgcattctgatgctaccatgttagagaaacacaaatactttaaagtgctcagagttgagagccacagcagccattgctgtgtttatggtccacttgccccatgggtaaagtcagaataagccacgagatcacccatcttaagcattttcacctgcctttatatccttgacttctctttttactttagtagcactgattttttaatctgtccttgaactgtttactcactggcgtttaagcattttgagcaaacctgcagtaagaaatgcattttacattatgatctattgtacagatacatgtatgtacatttaggtgtatatgtacatatatgtgggagtgaaactgaaacaaaagtaccacaaatctaaagttaccctctgtgctgtgcactatatattttctgtcccattttcttcttttttttttttaatgcaggtcacaagctactgtacagattttacaaaccattagtagataatggtgcacagtttgaaaaatctccatgttaacttatcctgcccagtgattttgcttattctactttctttcccaagtcaaccataaaacctttttccgatagagatgttttagaactaaattatttagaacactaaaaccacaacttttatttaatcccaccaccacttctcctcatgtgtgttaattcatttgaatgacatctttcaggatggatgatatatacatgtacaagacagtgtgaaaaatgatacaatgcagtgctgtgagaacactattataaatagagaagtgttgaattttgcctcgtggagtcagaaatgaccattaatctgggcttagttgcttctgcttcagattttaccctagcttaagccacagtagggaggagggagtgaggaacaggtaaggtatgatagaaagtggttagagaatatattagtcctggttgcttgatgatagggaacttggaacagaagggaggggctgttgtttgggggttgaaaatcagactgggatcaagtcctgaagagttctttatgtctgctcagaggcttatatatgactggggagggaatagggaggccttagaggtttgaagtttgtaagcagagaagcgacatgagcagatataagctgcaggcaaaaagttaaggtttcagtatgggtgatagatggggggtacagagattgaaggcagggagaaaacaatctatccaagaaatagatgaaaacaaatagaaaaatacagtgaatatgaccatatacttaaaaacatctgttttttaatctgctggaatgatctacatcattttgataacattttattcttctctcagcaacacatttaccaaaaaaaattcttttaaatattttatccagagtttagttgtttcattcaggactgttggaaatagcagacccattatgctgatgaaacagaagttcctccatttgatttatctcttcttcctgtgtttttgctttattcttggagattgccttgattttatcctcctgctcttcccactgtttttggtttggtttttgtttttgttttggcaaggatatttttatttctggtagctgctgcctgttcttgtcttcattttccacagcattttggttttgtttaatgaatgtaactttttttggtaagtaaaacatatatgcacatagaccctacgtaccccaaaggccttacagtttaggcaagaggtgatgaggatctaaacctgggcattgaggatgagtatggaagggaaaaactacaaggaatatattgagataaaattatcaggacttcaggattgattggcagtaactgcggataaggaatcaagagtcaatgctgatccccagcctaaaaagagcacctagaaaaagcccacagctgacattatactcagggtgaaagactgaaagctttcctctgagatgggaataagacagcaatgtctgccattgccccttctattcaatattgtactggtggttttcaccataggaatttgtcaagaaaaaaattaaaagcattcatattacaaggaagaaataaaattatctctctgcagatgacatgcatgatcttgtatatagaaaatcctaaagaatacacacacacacacacacacacacacacacacacacacacacacacagagaactgataggctgggtgcagtgactcatgcttgtaatcccagcattttgggagaccaaggcaggtggatcatttgaggccaggagttcaagaccagcctggtcaacatggcaaaacccccctgtctctactaaaaatacaaaaaattagccgggcatggtggtgtgcacctgtaatcccagctaccagggaggctgaggcaggagaattgcttgaacctgggaggcaaaggccgcagtgagccgagctcatcccattgcacttcagcctgggcaacaagagcaaaactccatctcaaaaaaaaaaaaaaaaaaaaaaaaaagaactgataaaccagttcagcagggttgcatggtatgagatcaatatgcaaaaattgtttttctgtattctagcaataaacaacctaaaaattaaattaagaagaccgttctatttacaatagcatctggaagagtaaaatacttaggaataaatttagcaaaagaaattcaagacttgtaaagtacaaactgtaaaacattattgaaagaaagaagacctaaataaatggaaagatgtctcatgttcatggattgtaagacttactattgttaaagatggcaatacaccccaaattgacctacagatttaacacaatctctatcaaaacctcagctgcttttttttatagaaaatgacaaatctaataaaatttctcacggaaatgtgggagacccagaatagccaaaacaatcttgaaaaggaacaaagctagagggctcacacttcccaattgaagcagttactacagagctacagtaatcaagactgtgtggtgctggcataaggataaacatacaggtcaatggaatacaactgagattccagaaaaaaaaaagccatacatttatgttcagttgacaactaattgggaaaagaattgtcctttcgaagaatggtgctgggaaaactggatctccacatgcaaaagaatgaaattggactcctaccttgtactatatacaaaaattaactcaaaatagatcaaagacctaaatttaagagttaaaactggaatattcctagaagaaaacataggattacgtacacatttatgaccttggattaggcaatggcttcttagatacatcacctaaagcataaacaaccaaagaaacagaagattttttttattttaatggggacaaattttttaattttaatgagttcaaatttgtatccaaagaacactaccatgaaagtgaaataacccacagaatgggagaatatgtatctgatcagagtttaatctttagaaaagcaacccattttaaagtgagcaaagggtttgaagagatatttctccaaggaagatacaaaaatgacaaattagcacatgaaaagatgttcagcatcattagggatatgcaaatcaaaaccacagtgcgagactacttcattcccactgggatggatataataaaaagatgggcagtagcaagtgttggtgtggatgtggagaaattggaaccctcatacgttgctggtgagaatgtaaaagggtacagcagctctgggaaacagtctcatagctcctcaaaaagttaaacagagttaccagatggcccagcagttccactcccaggtggtagggaactctcacccaatagaactgaaaacatatgcccacccaaaaatgtatgcacaaatgtacataacagcattattcatgatagtcaaaaagtggaaaccactcaatagatgactggatgcacaaaagccttgtatccactcaatggaaaattggtcataaaaagaaatgaagtattgctacaacatggatagactttgaaaacattacgctcggtgcgacaaactagacacaaaaaacctctattgtgtgatttcatttatatgaaatgtccagaacaggtaaatccatagagacagaaaatagatcagtggttaccaggagctgaaggaaggaggaatggagagggacagcgaatgggcccggggtttctcttgggagtgagaaaatgtgctggagttagtgatgatggttgcacaattttgtgaatatactgaaaaccattaaagtgtacacttgaaaagagtgaattatatggtgtgtgatgtttatctcagttttttaaagttgcacaattttgtgaatatactgaaaaccatttaagtgtacacatgaaaagagtgaattatatggtatgtgatgtttatctcaattttttaaagaagagtcactgtcttagagcagggaagggctgtgatgggccacactcaatgcctccattccttcccaggaagagggagactgaattgccatagaagttagagaccagctttcctgggaagggtgttctggctagtgttctgagggattaggtttaacgttgtaacctatagatctagaaggaaatatgaggccatcagctcacctcagccttcaacaagttgtcattcaccacagatccttttaacattacacctcaaaccttcaaacttaggagatgtgagaagaaagctcttacagagcttctatatataaaatacctataatattatagcattttaaagtaatgctagttgattctctttttatactaataattgtaagaatacttcagcgcagcagcattatttatagtgaatactacttttaactaatggtattgaatatttttatctaatatgttttttaaatttccataatatgtactgtttggcattacccaagttttccatatatttcagccacaactgtagccgttttttttgttgttgttgttaaaaaaaaattgctaaaaactcttgcatcaggaattttggaaattcttcagatgagacaatcagggaggattgatcacatgttgatagaatgcaggcagccttagtcatttcggtggctcagtcacattctttatttctgtcagttattctgaacaaaatacaggtggtaacatgacctgcaaatgacatactgtcacaagccctgggctatcctttagaatgtgcagttaataagctctggaatgcctttacatgggaagtgggggggcagttgttacggattcctggaggtgaagttgtttttattgtctttattaatttagtttcatcttagcaggagcataatccttcgtaagacacacctcctaattgcacacgtctggctttttacctcttaggcaatgtaaaggaaagttaataggatgtactttttaataggatcttagggggatctttcaccattaaaatgagaaaataagtttggggagcagcaattattcaaaccaaggaagttgagtgaatcatttagagttattaggtaagggttaataggtaagagacactgaaatgaggatgtggctgtgcaaacaccacatttcacgggtttcagatgaaacatgactgttagggaagagtctgtgtaggagtcatgcattcttcagtatttcacatacaccttggcctaagcttatgagaagctaatagcagtattattttaattttgttttgtcacttcagaaatgcagatgtgtgtgtgtgtgtgtgtgtgtgtgtgtgtgtgtgtgtagtcagcaaattagttacatgttacctatttgttgataactttataattttactgatttttgaaactggttaattatagaaaaagaatttgaacttacagatgtaaattgtttccaaattatagtcatttatgtctaatattcttgctccttttatcattgtttgtgtaaatatttattgaagacaccccactagtcactgatacaaagagatgtctgatgtccaccctgcttagaaaggattctgttagcagctgacaaactggaccatcccgaggaccagcacagtgcacacttttcccttcccttctctcctttagcccatgccatagccctaggaggtgggtgtggccacggtcagggtggttgtgggatctggtgttggctgtgcagccggtaagtgcagagcctgcattcccatagcacttgttgcagtgtgactgtccagtgatcccggatttactgtctgcaccccccagtgactgtgcagccatgaggtcagggtcctctctagtgctggccagttgtgaattcagtgaggtttggaaagatggatgattttcaagtctctgtgcctagtgtttatgcgccatgcagaggtacagaggaaagggtggtgagcacgcacaagacacagggcaggccctcgctgccacggccaatgctgaggtgaagttaggacagcctctccagttttctctatgaagactgtaaagggacaatacaaactcattagaaaataataaactcgtgtgttctaccccctcttcaataaatcttcccactgaaataatcccaggtgctggctgattagattaatggggagggggcagtggcggtctctggtggtgggtgagtggctctgaaggtgaggattccagcccaattgcaggacatcagccacaccagagagcacctgggggaggccaagctggcaggcaggggagttaggccctgattgagcaagagggtatggagtgggagttcatctgcacagacttcgatgctgaggtcccagctgcctgggggcagggggacagcagtgaaaccggttgttccaattgtgcctggaattggcactgagacagcatcctgaccccctcccctttttttactcatcagagaaggtcttgttgaagaagcgtaatttaaaaagacattgaggaaagtgagaatgagccatatggatcgacctgggggaagagtatctgaggcagagaggagagagctaggatcaggagcttacctggaggctactggaccagcaagtcagtggcatgtctggagcacagtgaacaacgggagagtgacaggaagtgaagtctgagcaggacagggtctgaggaagccattccagggttctgcttgcctgtttaatgaaagaagtcagtaggccctttcctagcccattttctgttgcttataacagaatacctgaaaccgggtaatttacaaagaggagtttattttttacagtaatggaggcatgtaaatccaaggttgaggatctgcatctggtgagagccctcctgctggtggggacgccgcagagtcccaagatgggaaagggcctcacatggcaagggtgctgagtgtgctcatgggctagctcaggtctctcttcctcttcttataaagccaccagtcccactcccatgatagtctgtttatgaagtcagggccctcatgatccggtcacctcttaaaggccccacctctcaatactgctgctttggggattaagtttcaacatgagttttggaagggaccatagcagccgtatgtgacatcaaattgtcccatttgtccctctcctttttgtattgcaagtttatctaacagggtagaggtgctggctgcctgattccccacggcaggcggagacctgggttctaaagctatgagcccctacaggaatggagcctctgcccacaaagcccagttatagccctccccccacacacctgcttccttgcacacttgtgtgcaatctgtgggtgatacacctgcccttggactccttcccattgagaagttactgtcctttctgcatcactttttgttgtactctatgcctggagagaaaatctcatggtctacaaagggcactcatgtccttttccatttttcctttcatggattttccctgatcctatgcagacacacctcctttactgaaggacttatgattatcatgaaaacaaaaacagaacccttcttgtcgtgtgcctcaggggtttcattgactcccagagctgcctgatcagggttcagacacagtacctgttcctacagaggccccgttgctgtcctgggctgactctcctgaccatggacgtccttattttctgtgttaacttctctgacactttcccaatgttagcatgggttcctttagaatgacggggcaatttaccattttctcagcagatgttggaggagagagaaaaagcaatgttaaagagttttgactgggaagaaaaagagcaagtatttgttggttctggttctgtggtggttgtttttcatttgtcttaattagatccatgttacctttctatgtctcatctaataaatgtatttccatttgagtcagttacatccctgctctgctagtagatttgcttttgatagacacaatcctgtatttccaggggttttttaatattacatataaattacattaacagtcgaggttagcatactgaagagatgtgctcctagttaatattttgtgtgtccttaacattacatctgccatactactttgtgtgggtttttgttttgttttgtttttgagacagagtctcactctgtcacccaggctggagtacagtggtgtgatctcagctcactgccacctctgctcccaggctcaggtgatccttcttacctcagcctcctgagtagctgggactataggtgggctaccacgcctagctaatttttgggttgtttttgttttgttttgtttttttggtagagatgggttatcaccatgttacccatgctggtttcaaattcctgggctcaagcaatctgtttttattggcctcccaaagttctgggattacagacatgagccaccgtgcctggtcaacattttaaactatagtatttacttaacatagcttgtgtaagaactttcttttcagctgtaaaaatagctctgtggtgtgttttgatatgtattttagcagacatggtagaaacaaagttaaaagttacaggtgtcatacatacacaacatgaatgtggcatagacatcagttttggtgttagtgatgtaaaatcaagccgggtgtaaacttggcctccccttgcctatcaagctagcagatagaaccagtgagctggtagcttcatcaacatctggtgttcacctttgagtccaaggtggtgattacagtcttcaccatttcaaagctagcaggaaaggagaaagaggacaaggagggcgagtagcttccttttgcagaacccagctgcacacgtcacctttactcacagccattttcaagaatatagtcgcacagccacacgcctcggggcatctgggaaatgcagtcactgccacagcaatcgagagtcctgttcacacttagcaagaaaagggtattattctgtttctaaaaggaaaaaggggaaaatgaaggaaggaacacttactaatctctgccagtagccttgggcaaatcgctcttttcaagtctatttataaaatataagctagtaaaatatttacaaaaaaaaattaaaaaatatttacaaagggccaggcgtggtggctcacacctgtaatcccagcactttgggaagccgaggcaggtagatcacgaggtcaggagttcaagaccagcctggccaacatagtgaaaccccgtctctactaaaaatacaaaaaaattagctgggcatggtggcacgtgcctgtagtcccagctacttgggaggctgaggcaggagaatcgcttgaacctgggaggtggaggttacagtgagccgagatcgtgccactgcactccagcttgggcaacagagtgagacttcgtctcaaaaaaaaaaaaaatttacaaagatactgcccttcaaacattttcacaaagacacaaggtatatctttatataccttccatatttgcaggcgtttattctcaaaatagtatttttaacctaagtctcatttaaaaaaatagatattggtattagttttcaattgctgtataaaaatttctacaaatgtagtggcttaaaacagtgcctatctcacagttggtttggatcaggagtcaacacagtgtagctgcttgctgtgcctgggggtcacacaaggctgcaggcaagttgctggcagggctgcagtctcatctgggagcttggctgcatcacccaggttattggcataattcatgtcctacagttatagcactgaggacaggcttcttaccggttggctctaggctacccacaggtcctagagggccccccaggttccagggtcctcccccagacctctgacagtgggctttcccaacatggtcaccttcttcctctagctaacaaggagtgttctagagtgagcttgctagcgagatggagacatcatggataacacaatgtattcacaggagtgacatccggaaccactgccatattcagttggttaggagcaaggagcagcttctgtctatatttaaggcaggggattccacaaaggtgtgaccatcaggaggatgggtcatgggggcctcctgagagtgtgtccaccacaataactgttccacttaacaacactttatattccaaatggagaattcctgtctgttgggcactgttatttcatgggttttggtaaactgtcagtagggactttttatcagttagaagcactagtctccagtgatgcatggaacatgcccacacattgagagagtgagtgagagagagagagagagcatggatgtgtgaggcaaatagaaggatatgtcctctgctctacattgtggttaaatcgttaaacacttctggagtatcttttttagcagaccagtgatattgtacacagagaatgtgagaactcaaaatggtctttctatgaagacgagctcaggaacttgcttcttcctgccttgttatcctgattacaacaggtgcaagtgtgaacaacaagattatatgagctcatacagtattactagcccattgtttgtttagagtctctaaggcttgaaggagataacatactctaggaagccctactcagattctctgcatgatccagacctggagatgtggtaccaaaattagcctgagaaaccttacatcatctatcaaataatgtagtcaaagaactatttttaaaaatcatttacagcctaagatccaaatttgtttttaacaccatagtatcttcttatctgcaaaacagatatggtagatgctcaaaagaatccggcgaagaaaaatacttctgaaataatgaataggattattccatatcagaggcctttttggatggttgttgtgtggtggtcttgaaatgtactctctcagacagtgtcacatcatcattggtatatagtcaatgtatttaatatatttcactaccattcttaccctaataccactcacttccctagtcgaaaataaattacttaaatgaaactgcccttgtagtacaacccaatacaccggtcttgtaaaccagaaatattattcctggactctgcatctcagccagatgtccagttgtcagtaacattgaatgtcattgtgaaagaatcccatggtgtccatctgtccatccattcattcagcagattgctgtcgagttcccgttgtgcttccagtactgcagtaagtccagacatgggcacaatatgtaggccatgcccttgggaagtttataacacacatcagagcaataggttgcatttctatactcgtggtttataggggtcctccgcttattctcaagggatatgtttcaaggccccaggtggatgcctgaagctacagatagtactgaactctatatatactatacatacatacctatgataaagtgacatttataaattaggcacagtaagagattaacagcaataagataggacaacttatgtactgtaataaaagttttatgaatgtggtgtctccctctctcaaaatatgtaattatggtacacctgcctatttttggagcgaagttgaccataggtaactgaaactgtggataggaaagctgctgttaccttttcacttgagttgggaggactactgtatagtgaccctcagcatctgtggggaattggttctaggacccaccccccgagcatggataccaaaatctgagcatgttcaagtcctgtgattggccatgtggaacctgcagacaggaaaattcagccctccatagatgcaggtttcacatccctgaaatactgtatttcccacctgcgtttggttgtggttgcagaacctgccaatatgtattcgactgtattcattgaaagaaatccacatataagtggatccacttgtgttgttcaagagtcaactgtataatgttccagtgataaaaatcatttgaaaataaattttagctaaagcatttctacatttatagctggacatgaagaaatggtatactatttaagagtatagttggctgagcacagtggctaacacctgtaatcccagcacttgacaaggtaagcagatcacttgaggccaggagttcaaaactagcctgggaaacagagagagaccctcatctctacaaaaattttttttaaaaattagccaattatggtggtgcacacttgtggtcccagctactcaggaggctgaggtctgaggctacttgagcccaggagctccaggttacagtgagacatgctcatgcctctgcactccagcctgagtcacagagtgagaccatgtctctaaaaaaatttaaaaagagtataattgggagaaatggttagttccgttattccatatctagcacacagttactgagtgcttgctctgcactagcccctgttctgtgtttgaaactgaaaatagatagtaagtaaatggctcattgctacctttccatttccggccctggaaaatcgtggcattagagtagggctataggcaagtaaaaatgatcaaagagccttccattctctgaagttctaaagcaagtgaccatatccatgggtttcctgacaggctgctttgctggctccaagttttgtctttcgtatgggatcactgagattatgtaactcaaggaaggtttaaataggcatgccttgggacagcaataggatttgaaaatctatgtctctcaccgtaataaaaggaaaactacaaagatgtttgcatggtttgcttttgaaatcagatccacacgttaaatatcctgaaggaagtgtgaaagcttttatccatctgacaaatatcccttaggaagaagaaaacttcaatttaaaaggaagaggatatcataattccagcgcttaagatgaaatgctatattttatttttccagatgaatgagtgaaatggtaataaggacttaatattaggttgaattagcaggaattcagcaattgtgttcaaacaacagtggaattgtaggtcttagccacagacttgcaaacctatgatgaaaggtgtcaggtggagataatttatttagcatgtcttgaggtgtagtcctgaacccaaacctgtaattaaagagcaagacacaacggggcatgtgtgtgccagaagacctggattcaggcagggggatcaggataaggcagacccctggctgtctaggaaatgatgcatgcacaaatcctgatgtctctttctaccattctgaaaggtcttatttttataactctgtttatgggggatgtgggaactcagttatgagctgatgaaaccagggaacttaagacatttcttagctcagatcaaatgccactattgaagtgggcctgctttcaagataaaacaaagctgtattcagcttgaatctaaacagaattaaactctgctctatactgcaaaggctgccaaactagttctggcaaatcaccatgaagaaaatgtttcaaagacaaagccccttaactgtatgctacaaattccggggcttccaccctgagagacgcttatcatcagtagtacaagtgctcgtatcttgttggagtatcagattaaaacagcaggctgtattccattacagaagataccctcacatccaaactgcttcatacgagaaaggctaccagtggtccatgagttctcatcatttagtagattaggattccagcataaaaagaaaaactgacaaataccccttttaaataagacagagtacattggactgtgtatatgttgtaaacgaattctaaaagccttttgactaaaaatgtagttattcaaagtttgttatactagaatttaattcatagatggtcctagtctctttgctttcgttttaaatagcacttgcatcttaataggatgaaaagtacgtgtctacctttctctgcccttcactatgctggagggaccttgctggcaaaagactgtgcaggccacattttgagtgtccagctcctcccacctagggcacagctctaccaagggcatggcatctgttgcacctccagcagcctcagccccactgttggttgtgtattcatggtactgtttgggggtggcatttgggcctgaagttggggtatcctgtgaggtagggatacaggtctagttgctgtgcaagagacccaaaacaatagccgtgcaagtgcccctgcccagcacaggaggcggctgccccattacaggcccacacttctgactggctgcatccccaaggaggaaggggcatggatcattccttcaggacaccactcacaaggcgcccacctgacttccaatcatatcttcttacagaaagaggagaacggatgtggaggtgcagtgtgtctctgaggtgctgcccccatgtcctaaattgattgcagtgctcctgcacaccttccttatgacagagcccttgccgagcccaagcaaattagttgtcttggagaatcggacataaccagagagtcactagcattgccatgcgtcttttaagccactgtgtagtgaatacagggagtatgctgccacgttcctgtgatgaagtaaccatatttttaaaaatgtttcttccttgatatgttaactagaattcacttatctagtttatagagttgtagcaaggattatactttgtttattctttattttctggggagttaacagctttgttaaagagtgttgttatcatggttaaaaaaaaagttaagctttttaaaaaagttgtttattttttttttaattattattattttttgagacagattcttgctctgtcgcctaggctggagtgcagtggtgcgatcttagctcactacaacctccgcctcccgggttcaagcagttctcctgcttcagcttcccaagtagctgagattacagacttgtgccgccacgcctggctaatttttgtatgtttagtagagacagggtttcaccatgttggccaggctggtctcgaattcctggcctcaagtgacccagctgcctcagcctcctgatgtgctgggattacaggcatgagccactgtgcccggcccaagcttctgttttttaaaagaaatgtttatgtcagataaagacagaagaaagtggatgattgctgtgtcagatttgtttcagaaaagtaaaaatgttaaagtcctaagtgtagcctttgaggacagttttcatagtcccagccttggctggggtgacgttacagcagatataccatcgcaagctcgtgtgccgtgcttgcatagccctgcacctgctgatgaattggaatggagatgttttccactttagcaacagaaaaagagcagtattcgtaggaaaagaagtttccagtggaactgtgtccttccatgaaaatccatgtggcttttcctatcataactacatcattgtcctgagatagaatggatgctctctctctgtgccagactccaaattctctcctccaatgttgatgaccaggcgttccaagtgggtcagaacagatgtgcacctccacccggctccaccattggcactcctgccaccgtctctaggctgtctttacgtttctgtcacagaagtgaatcccaaagtgatgaacttgtacaaaacaattaggtgtccgcttcttccttcttatgattagaaaataagtggaaggagcttagagaaggagggacaacagtttgttcacccttcttccactgagaggcaagttgctggtggttatctttggttcttagcgtttgtctcttcttaaaaaaaaaaaaaaagaatgcattcccagattacccctctttgtatagtaatgatttttaaattctgtcccatttttcttctgctctgtgactttttgttttgtcataaaatgtaattatggtaaaaacatggaaggtttttgtgttacaaaaactagttcatgaaaagcagttcatgcaacagagaatcattgcagagtacaactctctgaactaactaaattattaaaaataaataaactcctgactttactgtttttgtagatagtcatgtgaaataaaatgtattataatcagtgtaattaaactcacttaatgaagaagaatagccatatatttggagcaaaacatatacatctatatatgattatatttatgtgatacaaaattttctttgtgtatgtcttagtgtgctaaggctgccttcacaaaatgccagagactatgtggcttaaacaacagaaatttacttcccactgttttggaggctggaagtccagaccaaggtgtcagcagatctggcttctcccgaggcctctttggcttgcagacagcctttcctctgtgcccacaccctggcatccacctttcctcctcttccaagataccagtgagtttgggcaagggcccagtctaagagcttcacttttacttaatcacgtctttggaggctgtgtctcctaataagtcacattctgaggtatggctttgggtttcaacatgtgaattttcaggagacacagttcagccctaacagtgtataaaatgtgaaaatattgatatcataggtgacgtagccttctagggtaaaatgcaaatgaaagcatttacgggtctctctgtgtctccactgtgttctcacatgtgatattctccaagtggaaactgacttgtgtcccgtgctgtgtctctctgttcttggcaggcctggcagctgcgattcagccacctcgtggggtatggtgctagatattactcttacctcatgtccagagcggtcgcctccatggtttggaaggagtgttttctacaggatcctttcaacaggtaagggggtaagttctaaaatgtccccatcttggaccacagtaattccccactctattacatctggaagtcgggctcgagaactgcagcccacataacacagccaaacctggcagaaagtggcaggctccccacacagcctcgccccacttggccattcccacccaagcttgctcctgcttcccgcagctgaccggtggccctggacatccccctaccctgcagccactgtgtagaggtggctgtgtggtgtctgagggaacccttgtatgagggctcctgtgctacctgaagcagcccctgctgctcctgtgggttttcttggcttttctgacctcaccacgtgatacgggatgcccacccctttccacagaatggaggcaaaacaaggcactggagaggctgggagcattgtcgggaggaagtaggggtgcctaggatcagtagtcctgctttcccaatctctttctaaaggccaggtagtggttaaacttccattgggtggagaggtacaggagatcccttgcttcctggagggtgtgagggattctatgctgtggctgggggatgcaggggatcctgtgctgtctaggggggtgtgggggatcccgtcccgtgctgtcttgggggtgtggggaatcctgtgctgtctggggaggtatggggatcttgtgctggctgaggggttgcgggggatcctgtgctgtctggtgggggtggggtatcccgtgctgtctggagaggtgcgtgggggtcctgtgctgggtgaagggtgcgagggttcccgtgctgtctggggaggtgcagaggatcccatgctggctggagagatgtaggagatcttccctttgctccctgatttggcctcctgatcctcctaacaggaatccctataacaataggaaccaagacgttgtcaagtttgggtcctatgattccttagaaggctctttctttgaaagaaaaccagtaattataatctggtgtcagagttgtttatagcatttatcttctcaccacacaaataactacatctccaaattcttttcagggaactttggctgatgagtgctatttttactgctttatcttggtttttagagtgtcctagagttttcacatagtattcacagcagtcttggcagaaaccagcacgttttataagagaaaactgaggctcagagaaaacagtttgttcagacttcaccattaaaaactggactaagactataatctaggtcttctcattcctggttttttctccctcccacctccacctcaccctctcagtctgtcatacaatttgacttagacttggatttttctcagcagttaataatcacatttgtttcaaattatttgagtctgaatgtgatgtcatagaatttttaaatattttgcagcttggtactcacatgtattttgtcttctgccctttgcagactgtagacatttggtctgctcttcagattttatttttaaaagatctttagccaaacttgacatcagtaaatcagtttcagggattataactttttactgtagatttctgtaaaataggcaaaatatcatcttgtttgaagtatactttactagaaaagtacatactataaaatatatacgtttctaaatatttatatcttgtttatgtgtacattcttgcctagacatgtagttgccatacttttatgggcatattaaagtaagctagtaaaaatgctcactagactagaaaatttctaacctctgtcaaagtctcctttttgatctcactcctgagaaataaccaggctggagcctacatcagaaagccaggcattgcagagctgaggcaagccaggagctagaggcctgtggggagggatttgatttagggtcagggcactacatcccatggctgagaagggcctcagagcaccccaggtcgggagtcaggcagggcccctcagccacccctgcccctgaggggaggcgccacctcagtccaggcttcctgcttcgcttagcactcacttcaggatgtgaccagggctagtgtttgatgtcagcatgtttttgatactgtaatgctatcaaaaagtctgattaaagaccatgttcacaaaatgacccacatgtaaagaggctccagagcttctcaaatggaaacaatatcaaaatttatttaacctgtctcatcatagtatgtagtcatgtatgttaaaggaattgcatttttcataaaatacaaaagagtagtactaaataacttgtttccaggtcccattagtttggaggatttatgtctacaaaaattattccaaacctgccttcacatattgtcattaacagtgttccttgtggaactccgtcaggtaggcatatccaggtgacacagagtaccagaagacgggaacaaggcagcctccactgtgcctttatcacccgcacactccagtggagtttgctgatccgttaactgttatcctgaaccaaggttttctggtgtaattaaccttttcctgccagcttctcttccttcactcttgttttagagtgttctttttctcttctttattaggtgccatcacaaattatttcttaatggtataatttcaagcctcatttaaaataatcacaaaactatttttatagagaataaaatgtaatattttacttattctgtaacaggagtccccaacccccaggccacagactggtactgggaactgggccacacagcaggaggtgtggtgggtgggtgagcaagtgaagcttcatctgtatttgcagccgctccccatccatctcctgttgaattagtggcagcattagattctcataggagcaggaaccctactgtgaactgcgcatgtgatccttatgatcctctcacaaggatctaggatgggcactccttatgagactctgaggcctgatgatctgtcactgtctcccatcacccctggatggtaccatctagttgtagaaaaacaagctcagggctcccactgattctacattatggtgagttgtataatcatttcactatatattacaatgtataatgtaataataaagtgcaccgtaaatgtaatgttcttgaatcatcctgaaaccatccctcccccatcaaccctcgtctgtggaaaaattgtctttcacaaaaccagtccctggtgccagaaagattggggacagctattgtataatacataagttaattatttttataaagtgaggtctcttgttaacagaacagatagccaaaagtatagttatcctcttacagggaatatgtcacacctgatttaatttattttagaacaatttaaaagccagaatttgatttttagaagcaagaaaataggggccaaattgtcacatggtggcagcttttatgaatatggcatcagtgtggctttctttgagaattcaagacaagtgtgaatggaggctgtgcaagcaggagtctgtaacagaacctctcttccccagggctgccggggagcgctatcgcagggagatgctggcccacggtggaggcagggagcccatgctcatggttgaaggtaaaacaaaaccaaaatggcaccatctataatgaaagctgatttatgttttctccatatgtttttttcatttaaagaaaatgttttaggccaggtgtggtggttcatgcctgtaatcccagcactttgggaggccccaaggagggtggatcacctgaggtcaggagttcgagaccagcctggccaacatggtgaaaccctgtctctactaaaaatacaaaaaatagctgggcgtggtggcagacgcctgtaatcccagctactcgggaggctgagacaggagaatcacttaaacccaggaggcagaggttgcagtgagctgaaatcgtgccattgcactccagcctgggcaacatgagcaaaactccttctcaaaacaataaataaataagcaaataaaaaagaaatgtcttagctgtgcattgtgttctaagcatctgtctcactgtgtcctaagtaaattaatttttagttgccatgatttattcaagtaccaggataaagattcaggttttagctttcaaagtgttacttatactctaatagaaaaattttttatttgtcataaactcttagaaaattttcctttagattttaacaggtcacagtgttttttttttagtctaaagaactcatttattttttattcctttatttctttttctgaaagtttaaaactacatattttcaagaaattccaaggcattgggttagatttgtttttttacctgttgaaaaattagaacttaatatctttaaggtattacaattctttttttctatgtaattttctcagtaattttttatttgagtatttttactgaaaatttaattgtaaatggaagtgatcatcatgatttttcatgtatgaatataagaacattgaaacatgcttacaaatatttataggaagatatgaatgttactagataattgcaatatattgatggttatatttgcagctgagcttgactatctgaaaagttttctggctatctgaaaaagtgcatataggaaataactttcaatattggagaagtgttttcattgtagtaattgagtgtgtctgggtagtcatgagtgtgatttaaatgtctccttgcctaagactgttgaatctaatgcctgtactcctttttagcagaattccagattcttgccttcagccattcatttattcagcaaatatttgtgcagtgccttcagccattcatttattcagcaaatatttgtgaagtgctaattatgtgccagacatgattccatgtgccagaggtgaagtagtgaaagacgcttagacaaacatcctgctcttttggagactgcattcattccatcagctttgtgaagagtgaggaagtgtgcatgctgacacagccatcatttacagctagtccttactggtccttattgaactttccacctctggggatggttttagggattaccatgtatctgttgattgactcttcttagtaaccctatgaggtaggagttatgatccccgttttatagacaataagcaggttaggccctctgcttatgtaacaaggcagtatgtggaagagccagggattgaaccaggacctcaggcagcaagcagaccaagctcttcagctgcctgtactgtcagacaggacatctagttcagggtctgttccagacccaggcaaaagtgaaacaataggcacatcataataagctactgattgggtacattgtatacttttggctggtggttggtagcgccagcccaccccgagctaaggcggaaataagcggtgagtttctgtgaggtgtgtgttcctggcagccgtgcttggctcatcctttcccaggccatgctgctacacctcaacatttgctgataggagataccatcaaaagaaaaaaatgtaaatctttttcagtgtttatcttttggctggtgtgcttttctagtcggcttcccagaatgttgcaactaactctcaaaaattctgttctttatccaaaacaattttgtgttaagaaacttaatattttctgcactaaaattcacatatgagagaaaaagaagtccatcattcaaaccagagatgattaagtattcagattttagttaacacaaacaatagaacaattctacttttacattttaatatttttcttaatgctgttctgtcagatctcattaattcacatgatttgtttcatgtcagagatgaatgggggacatgcaaagagggttatgccagttgtcacttcatagggctggatttgtaagctaagacccatagtagtggcttctcattttcttggaggcagtcagtctgtaccccaaaacagcaggtcttaggtgttggctcacagccttaacactggggtattaccaggagtgatgggtgaaattactgagatttgtaatgtaaaagcatacaggatctcgttggcagtattcttctatgaaaatgtaactttttataggtaccttatatatttttgtttaactgcttcctggataaatgtaaagaattatattacatagcaaaatggaaagaaatagaacacctgccttcaaactatgtacctccctaaccaaatcacaacttttttttacctccttagttataagactgtgtttcttagggtcagaatacctttgtattcatatttgtgctctttgaatgatacaaattcagagaagtcaaatagggaatgcttttgatctttgaataataagttctacataggcaaacttttagattatttgtctttttcagaatgagtcatcccttgggaacagggctctgctcagagctctgagtccctcggccatttctagtcctcaccagctagaggccaacaccctattcaaggaagtccctgagcacacaggattcctctactttcttttttccctgatgtttgctttacattcatcagttaaaggccactgctaggcaaccatgtatctatgctctctaactcttggctgcaaggtatttattcagaagttttccattacttaactttacatagagtgatcctcacaggaaaaaagacaagttgcagcagcaggggctttcttaaaaagcctaacacaccaaataccatttgaaggcaacataatagtggttaaaacagtattttcttccccagagaaagaaagcaatcacatggtgaaatagaattggatttgcagtcagtgactctgctacttactgtctataaattacttaggaaagtcacttaatttccttgcgggaggtaaaatgtgatttgacttcaaaacacttctttttttgtcttattattattattatttttttttttttttttgagatggagtctctactgcccaggctggagtgcagtggcacgatctcccctcactgcaacctccacctcctgggtttatgcacttctcctgcctcagcctcctgagtagctgggaccacaggcatgtgccaccatgcccagctaatttttgtatttttagtagagacgggattttgccatgttggccaggctggtctcgaactcctgacctcaggtgatccaccctccttggtctcccaaagtgctggggttacaggcctgagccaccttgcctggcccaaagcacttctttttaatctgcttctcctttttttaatctctgaagggggtggggtgtgtgtacagacgtgtggcagtagctttgcagattgacagtatggccttgtctatttttaaacacattcatagcttacataaatatatatattataggcatgacattcagtcacttaatcctccactaaacacatgtggcaatacctgactgaaaccaactttcttaattgctgagacatctggggtgaggtttaactctcattgtcaatgttaaggttttctgctgttcatctcatacccccacaatggtttttggcttatgttaaatcacatttctgagtaataagataacttaaggtttttgcttaaaataaaccatgatgatatggcatttccattcattttaccattttataaaatatatactagaatatttgttaagtatgctatggtgagcatgatctaaggttcagtttccattacagccacttcagaaaatgtgcagttttctaaaaagacagatatgctgaggcttgtgaatagcaaggaagtaatactttgcccccactaggaagcagaattgtttcttactacagcaaatagactggtagaattatatagatattaggaatggaaactatattacttcagcagtttgtgaatggcaattgtattactcatgcaagttttcatattgccctctgtaaactatttggtctttttgtgttttatgttatgtaaaatttttaggtaaatccctcttactgagtttttaggttcagattttacttatcctctgataagtttaatcccctataacacaggtcatattgtccctatttttataaataatgaaactttgtcagtgttcataccctctgtgctgccttgcccacatttttctctgttgatccttacattctgacatgaaagtgacctggcctttagaaggcaagagatgtaagcaatgtgggtcttgggccctgatggttctcttaacgatctccaagttttttttttttttaatgtcgcaacctatctattctcattgacattggagagacctgcctgacatccactgatcaacaataaaatcttcctcttcctgtgagctcctttagacttttgtggcaaagctgtcaatttagtttataaccatttttagccatgggggtcctgatggaaagattctccccacagccatgtaagcaggacatggcccagttagttttgggttctgcctctggttacagaattccttatgctctctttcttcaactcttccgcaaagaatctgaggggaggggaagggaaaggataaagtccaagattttagcattccaggaggttatttgtaaatattaaacaactttatttccatgctcctttctaatcagaatctctctggccaaaagcagtatgcaagtagagatactaaataataactttatggagtttttcaaatggaccaaacatcagatcagatggaaagaaatagtagtagctaaatgagtcaattctcaacaaactgaaactcgattttgtttgttttttcgcatcagactgactcaccaaaccaaagtctagaagcccgcagggccttaccttaagctgattaaaatataataccttacgtttctgtagagctttatttatagtctgccaaacacactcgcttttgccatattatcctatatcatctcttctagcttattaaattttttttgtttaagaaacaaaccagagaattatggtttatactccaaagaatcacctccatgctccaagaagattaatgcaaacaatgaagatatctatctactagtttctttaaaaacagttctcagttccagcagcacggagcacatcagcacccagaaattgggtttacaccattctccagtaagaggaaccaaggctccttggagaaatggctgattccagggctggaacaaggaagacagaagatgagcatgaagcatcttatagtgccagaaaggaaggaagtgcccagaaacacacacagtgatgggcgcatgtgtcatcgcagcaggggcccactgaaagagctcccagtgccccaacctgggccaactccagcagccaaataaatcacagtcttgggatgtgatacaaagtattaaatacatatccatgagtccatattgatataaatgattaaatgaatagaatagaataatctcccatagagaagagttccaagtaatttatgtacatactccccaccttagggaagtggaacataactccccactcattatgtgggcagtgcagagtgagttccgtccagagcactctagagacagcgggggaaatgacaaatacgacctcagtcagatgatcaaggtcagcatcagtgatgcgtcatgtggacagtatgcatccttgatataatatgatgggaagttttcctcccagaaacccataaccccagtctcataatgagaaaaacgccagacacaccaaattcaggacattctgcaaactgcctaagcagtactcctcaaaactgtcaaggtcattgaaaacgaagtctgagaagctgacacagtctagaggagcctaaggagacacggcagctacatgtagtatggtcccctggttggtcctggaacagaaaaaagacagctagttttgatcgtaccagggcaatctgactaaagtgtagctggagctaacaatattctgtcaatactggtttgtgagttgtgacagatgtgccacatgatgaaagatattaatgataggggaaactggctgagtgtggagtgtggaggaactctcttgactccatcacagtttttcagtaaatataaaactatcctgaaatttaaaatttaattaaaaacaaagaacctccttgggaaggtttttagcagtgacaccactgctcatggtttggtccacaccttgactccaccatgtttcccttcttcccagcagccttttcattgccacttgggggagggaggggcacggaggtgagattgaaagaggagtattaggcacaaaatgaggctggaaggtaagtgggcgtcaggtcgggcagggcattgtggatactgtgaaagagagttggtgtttattctgaggactatgagaaaccaattacagtatttttaaggcaggtagtgccaagatcagttttatgttggcatggaggagggtgagtgtgatatcaaggatgactcccaagctccgtgcttcagttgttatagagatggttgcatggttatgactgtcacgggggacagaaatcaagaagcccttatgcaattcggccactgcgagaattcagctcaggaagctcccaagcctgtcggattcagtttctgagtgactgcgaaggactctgtacagaatgggctggagaaagctctttgcccatacagttctgatgatgggaaactcactttttcacaaggaaactcacttcagtttcagacagctctgactgacaggatgacacgtttattcaaattgacccaaaatatttagtccacttgaaagtttgatgtcttgtgacacagcagcttaaataataagcgttgatgcctttttttttaaataacctgattactaacctagtaggcaaaacatgcttagtgcaaggctttgctattggtgttatttgcacaatacaaacatcacgacaatcgaggagcaataagtcctgtctgtcagcaggagtactgctgacatttaaaataagaaagctaaataaacagtcattgttcagcaatagcttgattaatttccctgttgtcaaaaggtatacacagatactgaaacagaaaaggcgttttacattgtcttatagcactgaaaattagtagtagttaatacttctagttttaaagcatgcagttagcatttatgtaatctgatcaatctctaaatattggcattgtgtggcaaggctggtgtgcccagcactgtaggagaacagtaaatgcacactacctctggatggttattcctaaatttattttttaggtgtctttgctttttatttttttaataagggatttcaagggaaagataagccttaacgcctgacaggttctgcctgactgagccagcagcatctgtgcctccaggtatgtggaggcgcagcataaataaatgccagaacgtgctcaaagcaccagccttggcttgggataagtgcccaccccagggtgtgttttacatttgtgagggacttaggaggaaggaaatgtgttttacatttgtgagggacttaggagggacttaggaggaaaccccttcacacagatacattaaatattaaaagataagatgatttaaaactactagcatgccaagtaaaactttgctgttggaagtaaatcattctgatgaattttgatgggttgtttaaacatttatgaatagagtctcttcgtttcccctgtagtcagacattctctacccccttactctgctttgtttttgcttcatagcacatattaacatttacttcctaatttcaacatgtattatttcatttattggtttatggtctctgcccctcaataaagtctaagctctgtgataggagggcaactgactgtcatgttcacagctgtatctgcagcccctgttacagggctcagcccatcggcattcaataaatatttgtgcaatgagtgaatacacgaataccaaaatagacttaaaagagcaattgtttcctgtgctgtagaaaagttgtgatttagctgggtgtggtggcatgcacctgtagtcacagctacttgggaggctgaggcaggaaaattgcttatacctgggagtcggaggttgcagtgagccaagatcacaccactgcactcactccagcctgggtaacagaaggagactccagctcaaaacaaaacaaaacaggccaggcacagtggctcatgcctgtaataccagcactttgggaagccgaggcgggctgatcacaaggtcaggagttcgagaccagcctggccaacatagtgaaactccttctctactaaaaatacaaaaattagctgggcatggtggcatacgccggtagtcccagctagtcaggagtctgaggcaggagaatcacttgaacccgggaggcagaggttgtggtgagccgaaatcacaccactgcactccagtgcgggcaacagagcgagaccccgtctcaacaacaacaacaacaaaaagttgtgatgattacaatgggaacaggtttttatttgcctggttcaggaattttttttatcacatgaatatttttggatattttacaggctaaatattttcgtgaagttctttaatcatgtaaaagaaaaaaaatatatagccattgtgctgtctccacacttgttcggtctctcagctgttctcttactcctatcctgcccttcctccttcctgtcacggtgttttagacactttttgttctagtacagtgcttggttctgcccactggacgagtactgactgttaagcagctagatagcaggcataataagtaggggacaccactagaagaaagggggtccgctatccattcccaaataggtccttactggccagagtcaagcacctcttcataagccctgggcatcaagagatcccgcctaaatgatttcagatagtactctgtttaagcagcatgcaggaaggagattctccatgcaggaaaggcaaagggacaatgacagagtgaaaatgtgccaggtgggtcatgggcagcatctttaatccaccaaacactgctctggtgggtcgtgtcatctccacttcccatgtatggaagcaaaggtcttgtttcagagccattctctggcatagtcaggagtcggtcacactcttttgcctccagagcccctgctgccccacagcactcctcgacacctcttagccatagactcttgattactgtcttcttcaacttctgttttgtcaccgttacttttggtgggtagtgcttgttttgacagttttctctaatagtaagctatcatctactttctgtataaatttgatgggtccctcttccattttgagatacgtccagaggttgactttgaggtctgagaggtttttcttcctcaagtaaatatcttgtagtagattcattccaaaaaatatactaatgattccatttttagatgatgtcagtgtatactaccttctaaaaggaatgtaggtaacgttctctcagtgctttgagtgctgaatggaaacatcataagatgtttttgaagatggtcatttgttatagatggtgttcctttttttaatttttttttttttttttttgagagggagtctctctctctcacccagggtggagtgcagtgaggtgatctcagctcactacaacctctgcctccttggttcaagtgattctcatgcctcagcctcctgagtagctgggattacaggcgtgtgccaccatgcctggctaatttttgtatttttggcagagacggggttttgccatgttggccaggctggtctccaactcctgacctcaagtgattcacctgccccagcctcccaaagtgctgagattacaggcgtgaaccactnnnnnnnnnnnnnnnnnnnngatatgcattagattctatgtgtatcgtgtttcgacacattagagtgagtaaagtgcgatatgtaaaatagagtaattagataggactatatggcatattgatggtccagagatagaggatcaaatcgaacgaatgtcatctaccataggtaacttcgtactactgtgtgttttatggagattataatgagactcaggcagccctatattaatatgtgaataaacaggacgtatagtccaagcacgccccatactatttatgagtaattatatagttaaggcaagtgtttccacttaggagagccaatcataatatggatcatcactaacataagagtaaaacaacattcattgagtacatcacaatattgtgtgagaactcaagccaatactcgctacacctggccaaaaccataaaattttatgatataaaggagatgggcacagcactaagcacaatgcatgatggtatagactattggtgtatgagtgatccgtccaggcactaaggttaggccctaagattcccagctattatagagattactatggggtgtgtctcctaaggtaagatgtgcgaacctaggttgggcaccatggtgagacttcaccgctactaaaatcccgagttttgcagtctgtggtccatgcacgtatagcccgagctactctgggaggctgaggcaggagaatcgcttgaacctgggaggcagatgttgcagtgagccaagattgtgccgttacactccagcctgggtgacaagagtgaaacgctgtctcaaaaaaaaaaaaaaaagtgtgctgagtgggctaaacacaggttacagaagcagatgttgtatccccaaacgtctggttctaggttttgttttgttttgttttgagacatagtcttgctctgtcatccaggctggagctcagtggcacaatctcggctcactgcaaactctgccacccaggttcaagcgattctcctgcctcagcctcctgactgtagctgggattacgggcgcccaccaccacacttcgctaatttttttatttttcgcagagatgggctttcaccatgttggccaggctggtctcgaactcctgacctcaagtgatccgcccgcctcggcctcccagagtgccagtgttacagacatgagccactgcacctggtctggatctagattcttaactttcctgcgtgacaccctcaggcatcaagcttcaagggctgaggaaatcacaagttggcaatacactgatgaatttacatttggaaggagtaccagtaaaaagttaaattatagtaataattatagagatttagagcagattttagttgaagaattgaaattgacatttgctagccaactcttttatgaaatgttgctagaggatgtaggaacaagatttctcttggtttaactggactgtttcctgaaagagcatttacaagacatcttctggtgtttgtttatgtctttttcaactaaatgtaaaagaaactttttctttatgactatgatgtaacattattaataatgaaattagattaagaaattatacctatacctgattttcttttacatttaatagtttatctttacattaaagtttctcttattgaatagtccctggttaattgtagagtttgcacatctcaaatatctgaatagcattatcaagttatttttgtgacccatcacataagttagagtatgtcaggtaacacacagtttctttactctctttccattcggtactaaatgtatgttttgtttaagctttagggtcaggaggaaggccaacctgtacttaaatttccctttctagcagtttaaataaaactgagctttaacaaaattcttaaaagcttaagtcacacactcaaaatagtggaatttcaacactagatttatttttgtcttccttttgatgcacgtgcattccacattaggatagacattttatttaaatgcttccatagcctgtgtattgattttctaaagataagtaatccttcatgtcaaatactttcaataaaactaatttctgctacttgtatattgccagcattgaatggctaggagggagtcataaaagtttaatcaaaccaagcatacatttgttattttattgttcattgttacaatagtgacagcaataacactaagtacagctaaaagcatttgttgagtgtatttgatgtgccaagtactatgcatgttgctgtatgatctcatttaattctctaaacagtccaagggatgcataagtaacttatttgcctgagatcacctagtagcagacattagaactaggattcagagtcaggtactctgactcacctgtgtgggctggtaatttcttcaacttctttctcattataccaggaagtttttgctttgaaatatgtgcatgcatattccactgtattttttttcccttgctctttcataatttttggcaactgagttgccttgttgggaatacagtgatgctcaaagaagatattattgggttatcagagtaagatatcatggggacaaatctgaaaagtggcatgtgccaactagtatgctaactagtagctaatatatatactagtatgtaattgccttacctacagtaaaatgattttgtaggaaaataagatttgttgaatgtaaaggcatgaacgcacagcgtacaaagcaagatttggaactttacaggatgttcattggcagaaagctgcttttcttgcacagcgtagcaggaataaatgaggaaagcatgttacggaatcagagttacaatttagttagctctaggattatgacacaatttcaataatagaggcagcccagaataatagccaagtaaatagaatccctaatctttggcttgttcatatatttacccaacgtagcctctgaaatcgctgaaagctttttggaagaaagaaatggaaaggagcacctgcgttctcaaggctaagacctcccttttgtaaatgcactaatattttaagagggtgtgtgcgtgtttaatgtgtgggtgtgtttgtttaaggaagacactgagcttcaaaaggcaagatgttttgtaacccagaaatgtaattgtaaatggaattattaaatctgacaatgaaattaaaataaactaatgtgtaaacagggcacatatgtggggctgtacttgctggctcaacttctgtctaacacaggttcagaggcttcacttcagttaataattctagagagacagagagagcctcatatgtgaatgccgacagataccaatccagcacagggagcagcagagtctttttagttcaaaggaagagaagaatttcacttcctggccgatagtctgattttctcaagaactgattgtagatagagggaatccacctttagcaaagggtgtgggtaaccacagtcttgtagcagagaaaaacttcaaagtcaagatggtgagccatacagttgccctaggcttgggagagacagatctggaatgaggattctgatctcataaaattcacttaagatttttcaaactgccaggctagcctttgtagctacaattcttaatcagtaggctgagtttggcacatataattatttcagcagaaaaaagagccattaaactattatgatgaattattagaattggtaatggtgctgagaatactcaaacctccttttcactcccaaatctgtttagataatctgctttttggtacatccaagttattgttatgtctagtaatggaggacggcatagcacagacagctgtatatttgagtgaatcgcaggttctaaaaagagatttctgatctctttttaaaattgtggtaaaatatacatgccataccatttgccattttaaccatttttaaatgtatagttccaagccattcacaatgtcctacacttacaatgctgtggagccatcaccagtatccattttcagaacttccccatcaccccagtgaagaccctttatcacagaagtcaacaggtagaaaaatggatttattttaattccatcttttatttcttttagtagataaacagttacctaataagcagatggcaaaaagtagaaaaaagctgtgatttatgagctggataagtagcttgtgattgtgagttttatgatagttttatgatatttaatcacagatcaatgttttggaattgaacttgtgcaaaaatagtaagcaacctcctccttcaactcttgaactaggaagcaggttttcataaatcttcgggtctgattattatagtgagttactgagcatttctgtgtgttaaatgctgtatcttatttaatccttattaacaatctagcaaagtagatgacattgtgccagttttatgaacttcaaacattatactaaactccaacattttacttttacttagatttcctccagcaggggttaagtgattagtctgaggtccttacccagttgtttaacccagggtaatctcttactaaacccttgctctaaccatcaggatatattgccttctttcgagccacctaaagttttatttagaaaatgaaaaaggtatttttttctctctattctttcttggcaccccttcaaaggaaaacttttgtatagtcagaagagaaatagcctgaaatttcaaataataagataccatgcggaaccagataatgttccattcagccccaaattcacaccagcacagtgcccctgaggctgttggtggaactgcattcgaatagctgctctgctgaccagcaaggccccacggggctattgtcctgtagggggtcctcaggacattttcttttttggagcctgaggctctttttttggtccaccagactgttcctaactgatacttataggccttaaatagaaatctggctaatggaacttaattaattaatttctactaagtccagtgctgtggctgaaatgtaagaatatgactagcttttaacttttattttttttttttaaattttttttctaggttcggtgtacatgtgcaggtttgttatataggtaaacttgtgtcatgggggctttttgtacaaattatattatcacccaggtactaagcctagtacccaatagttatttttttttgctctccctcctcccatgctccacactcacataggcgtcagcgtgtgttgttcccctctgtgtccatgtgttctcattatttagctcccacttataaataagaacatgcagtaattggttttctgttcttgtgttagtttgctaaggataatggcctccaactccatccaggtttctgcaaaagatgtgatctcatttttttatagctacatagtattccttggtgtgtatgtaccacattttctttaaccagtctgtcattgatgggcatttaggttgattccatgtctttgctgttgggaatagtgcatcagtgaacattcacgtgcatatgtcttcatggtaggatgatttatattccttttgtgtatattaaccagtaatgggattgctgggtcagatggtagttctatttttagctctttgaggaattgccacactgctttccacaatggctgaactaatttatacccccgccaacagtgtataagcattcctttttctctacaacctcaccagcatctgttatttttttgactttttactaataaccattgtgactggtgtacaatggtatctcattgtgattttgattttttagctttgattttaaagaactgatgaggtatttgtcctgggtgtcttggcccatggcactggccacgcctgattggtgttacgagtccatccacctggccacatacacagagcacccagacctcccctctcctgggcagccttggacacccagtccatgaacttcccttgcatctttgaaacccacaagcagcgatacttccttccccgactccacaagggaagatccagtttcagggagacccaagctatggagggcagtccctctgtgcatcttcctatccccctcacacctcctgccacacctgacagggcttggtggcagtgagacactgttttctctttgtccaggaacaacccctgcttttccagtgaaggtggggagtagaaatcaggcattaaagcttgcttgtgtatcacccagactttatgaatcggaggaaagacagaatcatttaagtgaaaaaacagctgcttcaggtacaaatcctgggtctacagagttggtctttgatcaaacaaaaagatcagtgttccctagacatcattaaattctttttaataacgggtgaactgatttttttttttaatcaactgggaatcttcttgaaagaaatagaaccaactctggcttatcaaagcagaaaaccaattttttttttttttgaggccacagactcaaaggaagaagttacaacagggctccagaagagcagctcggtggggcttggcagaggagagggtgtgttcttcatggggctggtactgggatggctcagctccagccagccatagacctttctgcattcggctcaagactcaatcctggaagaacacatctggccaccctcactggctgagccaggggcagggagagcttcctcatttgttggcccaccgcagggtgtctgcctgcacactgttgacgttttgggaccagataagttctttttatggggcctgtcctgtgtgtagtatggtggttcactcctccagtgtgacaaccaaaaatgtcatcagaccttgccagatgccctgacaaaatcaccctctaaaccactgctctaaagcaaaattattctcctaaccagaagggaaatggatgctaggtggaaaaaagcaatatcctaccccattgacaccttggtgctgtatgaacagttatgtatttccatggctttctccccaactcatgaagttcctcagaacagaaatcatgtctcactcatatctgtgtgcctgctgtctccagtacacagtgtttagcacacaagtgcttagtaaacatttccttttgataaatgcatgagcagacgttcagtctgaagtggagtcaggagtagtcatgtttctgcttgctgccgtgcacagggagcttggcctgcaggcagaggcatttatctcagaacactaatgatgggagaggtccatgcctatggggagtcagacctaagcaactccatccacctttctgctaaaatcgcccactttggcagaaatcatgacctatcaacagatgaccagtcctctaccaacttcgtgttttccttgagaaatggctccctctgggctcctgcctgactgaggttgggttctatttctcaggctcagaacagtcagaatgaaagaagcttcttaggtgtgtgtttctgagcttttctcataataattgatcaacacaaattattgtcctgtagaatgttcctagtaatcaaaacataccctgctttttaactttttaaataaaaggactgccttcatctccaaagggcacctcccgtctgggagacttcttgagcaagtgcagagccccagcttccacacagctcacactgacaccacgtccctttctccgtccccactacagatctgtaggccatatccatgccaaatccactagatcattgtaggtgcttttccagctagctggtactcaataactttgaacagtgtcccaaataaattatagttttacatgaaacaattgttttctatttcacctgagaaatcttttttagttaagtagaaaattacaatcgtctacatctttcttgctcagtatttttcaagttatagttgccagttgagagaaacgacatctcattttcaggcttaacaggtttccgcaggtccatctgagccatggggcttaaaggcgagcatgcagcagagtcactgggaaggcttattaaaacacaggtcactgggcctatccccaggttctgattcagcagggctcggatgggggattaagaattcacatttctaacaggctcccagttgacacaccagtgatgtcagtccacttttaggtccactggatcatagttttcagaagaaagtctcagccagtcacagaggcgcacgcctgtaatcccatggggcactttcagaggctgaggtagctgggtcacttgagctcaggagttcgagaccagcctgaacaacatggcgaaaccccattcctacaaaaaaaaaaaaaactagctgggcgtggtggtgcattcctatagtcccagctgaggaaggcggaggtggaaggatcacttgagcccagaaattcaagacttcagtgagccgagattgcaccactgcactccagcctgagtgacagagtgacaccctgtctcaagaaaaaaaaaaaaaaaactcagtaatttttatatataatatatacagggatctctaatcttttggcttccctgggccacattggaagaagaattgtcttgggccacacataaactacattaacaatagctgatgagctaaaaaaaatcaccaagaaaaaacttcatagtattttaagaaagtttatgaatttgtgttggggcacattcagagtcatcctgggccacatgcagcccacaggccatgagttggacaagcttgatatataacatcttcctaataaataacatgttttttcttttttggggttgtttgtttgttttgccttcctgaaattcacattaggcatttaggcacagatagaatggatgaatgaatggaaaaaactcttacaaatattcaattaatagtttcttcattcattcattctttgagtttcattaaatttggatcatactcagccattgatcaaacagccatagtttcattttattgggcacctttgcttggtgtcaagcaatatataaaatagactcaaagaaaagatgtacctattcttcttcttccaagctttaaaataattctactttttaattgcctggtaatcccctgtatttatgaaattaaatgatacaccaacgatttcaccctagggccttaggaaagggagccagaatgagatttcgtctttgcaaggttggcttacaggtatagtcaaactgccaaccaattgctctcaatcatgttttcaaataattatattaattgtacatccaaaagggcattcaagggttaaacaggtgaggccatgagtatgctgatttttaaatgaaggtctggttggattatatgttcattatgtattacaaaataacaggatatgaacttgcagctttgtacacatatatatttgaactcatcctggagctgacaggattttttcttggcgaaagtgtagaaatatgcatagttaggagccccttaaatatgtgaaggctactgtttgaaggggttaccacaggcacttggagaccacccagaaagcatccctaagcacagaactcttgggcactttttcctcccagtatcacgccaagacaggaactccagcagcaaccaagcattgtgagcactgttgtgccctgatgggaagaggctcttggtcgttacatgagtgcctgtcctggtcatgagtgtcccggtcacagctgggccaagccaccgttggcagtaccagactacggccctgtgagacgaagccactgatctctgccctctacttccagctagatgggcacagtcgtgactgcttgtaaagtgtgctccacagaacggaagccgtgtaagttgggtacaagtgctcatgggtggcatcaggaaataatgagacctttctctcaagattttctacatatttaggttctgtcacatcaaggatgctgatatttaaatataaacctttttagaatgtatttgacagaatttcggggcatgaggcaatatatcatagcgctttaagagcatgggctcaggaaccagactgccagggttaaagcaaacctatgagttgtgtgactctcttggcttctgttttcttacttgtgaagataggtgtctcaaggtgtgttttaaggagaccatggatcagtgctcttaggacagtgtctggtgcacagtgaatgctctgtaaacagccaccgtggttctgggagtggagtggctggtgttctctctgatgagccccgtctaggccagctgtctgcaggtcaagtcctcctgcatggtatttttctcctcactttctctccagctgtatgtctgcagtcactcggaagaagaggactggaaagccgcagtttggaaaccctgccgttttaagactcagtcttggaatcttgttgatattataatttaaattagtcaggccagaataattaccctagtacttcaaggttatgaaacacgctaatttgagcagagccgtcagaacaaaaatgttctggcttgtaccatcttttcttagcccatttgtctctcaggtaaaatgaggagaaaaatacattaaattctcactctttaactactctttatatattctctgtccctctcagtaggacaaataggtgaagatctactacctgcttccttttgtgagctcatatttgcaatgtgtgtcctgatgcaattttgtctttcttatattgctattgacacttttctctttttaattgtaaagttattgcctgtttgagtccttttggcaagatccattcattctccctctaatttaggtgatttccagagtgaaatgtgtttgttaactccatccaccttggttggagttaacagctccaagctggttcccaggggtgcttggaaaatacaattttaatcgtcacccttctaaaattaagacttgaaggcaaaggggacatctttgtcagctttaaaaaagaaaccaaagctttcttggaatttttttactatggccatatacaaaatccaaatccagtttttcttacttgtggaactacctgaaacattgtttttttttgtttttttttaaattttctgtgtagggtttagttcatgttaacactcgcagaacatttaaatctaattagagcagggctagcataacagtgtgcccaggattcttccccagtaactattcttcattatccttccaggctcaggtcctgatttcctcctttttgaaccttcatcttcagcaatcacatacatacaaaatcaccaaaccagttagctctaactatatttctttagaaaagcccacaagtgtatatatttttctcttgtggccacagttgccattctgtgagatacaggaattgttttaaggtgggaaattggagaaggacgtgtgttagttgggcctgtctgctgggaaggagagagcaaggtcatatttatattggcagtttgttgagttgaagtgaaccacttcaaagaacaggatagccatacttacctgaatagcttggctctgaataaatggctttctcttctgagaattccagtcatttagttataaacgaccagtcatgtaattatagaaatgtttcaaatatagttttttttatttttaaggagcagagagagtttaataggcaagaagaagcaagagggaagggagaaggaagaagctcccctgtacagagacagaggaaggggggctccaaagccaagagagggaaccccacctgccacagataccagctaggtatatatacagaggctggaggaggcagtgtctgatttgcacaggctcaggggattggtttgactaggcatgtcattcacgtagcccgcaggaaaagctggctctcccaccctagccttttaatatgcaaatgcagggcaccatgatcttctacacaggtggggatacttcggggtgtccatgtatccaggaatgtggggaaagggcaagaagtccacaggaatcgccatgtttgggtggacccactttctaatggctggcatttggatatcgggtaactggcctggctttaagagctggagctttacaagaaacttttccagacgtgctttaaaaaacaaaaacttcctaaggaccccttttcctctctatctgcctaaaataatttatcaataactcctacaacattcccccctgtggagatgccgcactaactgctgttagaggtttgggcgacgatgtcttctggctacttcctgctggaaaggggcgtcgaatggggaacagcagctagggctcctcctggggttgatctaagggtcctcggaagactgacgtgtccatgtgtggttcagtttatagcaccatttggagtttgattgctgtgagttgggtgatcctctcctcttgaggtcccaagataaactcagagcttccagacagataatttccaaattctagaggaaccaggcagagaaataaacatgcttcaaattttgttcataggagtacaccttactcaattattaaaggccataaatagtttaaaataagtttccttgactcagtctgatgaatgaatttcctttctcggccaacgcaccaaaatgatgtggctccgatgagtggtggagcaccagggtttttggtcctcatgccagcttagatacaaggacacggacacacgtggagtggttttaaggagcagagagttcaataagcaagaaggaaaagagaaggaagaagctaccctgtacagaggaggagggcgccaaagctgagagaggcaacccctcaaatattaaaaaggaagaaatggcgtgataggctagcacattttatggaaagccatgtcttaattaaatgttttccctacaaatgttctctgtatcaagaaacctggcacatagggaatgcatgaaacctgatttataatcagattcagtctacttaagtaataacctatatctagatgatagattgtcaactgtgctactttagccatcatcacatacccagcgtttctatccttagtgacacagctgggccagaggcaaggcctgcattcatgcatgcagattattttactgtaaaaaagaacactgtgttttgaactttaattgcacaaatagacacagcaatgacattctcttctagtaactagtaacagcccattattcctcacatagtacctaagatagagctgttagaatttagatagacattagatagacagtgaaaatattttagtctacagttgaaactgtaacaatattggtattgttctcaactacccctggtctagttaagggctttcaagtatgtgtttggaccaagtattttcatgtccaccatctagatagtccttggtctatttcccaccccatgtgctttctggtgggatgatcacatctgcacctctagtccccaagctgtccctgagctctgtgtcctcactgtctccacatggagtgtccccttccacctcaaacttgacaagggttgtgtctccacaccaccctgctcctcctggattccagcccagtctgtccttccttttctgttggttgccctggttcagagccctgggacctctcatgttcctctcccagagtctcttccagccttactctacccgccagaccacttcttggtcagcatacattgtgcatttccccaggtttgtgcctttcctatattgtctcctccacctaaaaggcccaatctgttaagtttctgctcaatcccatctcctccacaaacctgctgaatctcttcattggaattcatctttctcttctgttctccacactgactgcactttgtatgctattagcatctacagtttactttttctcaagattttatgttaaaatttttcaaatattcagaaaaattgaatgaacagtacaacactcatatacttgccatttagtaaacattttcctatatttacatctcttcatctccgtatctggccttatgtttttatgcatttcaaggtagcagacatcagtacattttacacctagattcgtttacatgcatagcattagagttcaatagttgcttactgtatttaggtaaacttttcatacagtgaaacgcaaaatctcaaatgtacctttcaatgaattttgatgcatgtacacacctttataactcaaatcactatccagatgtagaacatgaccatcacaccagaggccctcctgccccttctcagttgattctaatatccactcccgaaagcaaccacagttctgatttttttcaccatagattggtttgactaactttttgaacttcatataaatggaatcaaacagtatgtactgcttcacataaggcttctctcactcagcataatgtttttgagatccgtttgtgttgttgcatgtatgaatagtttgttcctttttgttgctgagtaatattccatcatatgaatatattgtagtgtgtgtattcatgtcctattgatagaaacttgggttgtttcaagcttggggttgtacaagttgtttctttgttgacatatgctttcatttctcttggataaatacctgggagtgaaattgctgggtcctagtgtaggtctatgtttagtttcgtaagacactggttaagaccttttttcaaagtgattgtatcattttatcctttcaccacaaatgtatgacaattcaggttgcacacagccttgtcaacatttggtgtagcacagtggctcacgcctgtaatcccagcactttgagaggccaaggcaggaggatcgcttgagcccagaagttcaagaccagcctgggcaacatgacaagaccccatctctacaagaagtttaaaaactagctgggcatggtggcacacacctgtggttccagctactctcaagctgagacgggaggatcacttcagcctgggaagtcgaggctgcagtgagccatgttcacaccactgcacatgctgtgttgtccaggcctggacaacagagcaagaccttgtctttaaaaaaaaaaaaaaaaaaaaaaaaaattagctattctggtggatgtgtaatagtatctcattgtgggtttggttttcatttccctagtgactaatgatgttgaatgtcttctcagtgcctattagttgtgttacttattcagatatcttctgtgaaaaacctgaccttgtgaaggtaaaatcttttgtcaatttgtaatttaaaaaaacatatttttacaatgggtcaaaggagttctttatattttctggataccagtcttacgtgagatatgttttgtgagtattttttccaactatcatttgtctactcattggcttaatggtttcttttcaagagacattttaaattttgatgaaatctaacattttttccttttatgcattgctttctgtgtcctaagaaactatacctacttcagggtcacaaagatacttcatgcggtttttttaagataataattttagtgtttacacttaggtctgtgaccatctcaaattagtttttatgtatggtatgcagtaggagtcaaggctagttttctgccgtatggatatgcagttctgcccagccgactactctcactcttcatgttgtgactgagcctgcccacctgtatgcccatgacctggcctgatcctttacacacaacagatgcttccttcatgttcactgaattgcaatacaggttcagagaacaatagaggattcctgcaatcttttaatgccttgattttgaaaatggttttacagaattcatctcccaaagtaaatatcagtatatagagcctgttcaacccttcagttagcatttcctgccaagaatgtaggttaaagcaataaggttaattgcatcaatctttgtttttggcttctttagagtgaagaaaggacatgaattcagctttttattgaattcttaatatatgctaggcatggtgcttcattgcttctactacatcttcttgtttgatccttatagcaaccttgtaggaaatttggatgccagagattttaagtgacttctgcgttacacagttactaagttgcaaagctaggagttctctgggacagggaaatctggaggagagccaataacttgattctgatataagatttctataaaagaattaacatctaattgattgtaaagtgtatagaacttgataacaaaacttgatatgtaattaaacttgttaaattgtgaatcatcccagtcaaagataactaaaaaaaaatcagtcttctaatatcagtctctaagggtatagtcatatatgcaaaaataatagcccttaggaaatatatttaggcctaaatctctaagctaaggatggatttgatagtaaaaatacattaaaattataaatagctccaaggcccacacactgcccatgactttataaaatgttcttgcattcaggttatacagccagagtcttaattcagaaagccagagtgttcctctagtgtgtggatttgattttgtgtctttgtgcttcctgttgcctcctggtgaacgcagttctgacctttcctttgtttgcaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaattattctggcttttcacctgtttggcaaatatttgagcacatggaaatctctgacctagtaacaacaacacttctacatggcattgttaaatggagggtatgggcatttccttagtataaccactctcctgttgagcttttccctctttccatggatctttaattggtttaattaaataattaactaaaagcaaaattgtttaagacagagtttgaagcagtcttcagacaggttacacttatagttcttttaagaatgatgaccatttcttaagaccactatctaaagtaggcttagaaaatgcactttaaatagtcaattacaggcaaccaacaaaccaagtgtggtttccaaaatacatgtaattatctgtactgttttttcctgaatgtttaggcaaatagactcagaacacagaggactggcttggcaatgaaggtagaatgagtaagtgcaggtacaattaataagtgacataccagtgtcaagcaactggtgaatcaggaaacagaccatgtctgtttttatctggaactcatttgctttacagtattgcataccatactgtattttggttaatatcaggaaataaattatttaatgggtttttcccaccattaaagtcaaaaccaaattatgaatttccagtttaaaaaggcatctgctaacagcctcttcttgcttctcaccaaagaccaatgatgaaaggaaagattcaaaatacccaaaactaggacacacattcaacctatttgcagaatctggaggaatttcttcatgctcagagatgggactggatggagaaacatcatcagtggccggcctgtgccaggtgctcctggatgcaagggggatcgacccttcatgctttcccacctcctcctcacccttagaaatccaaatcggtactgaccagaaagcagagcagccagcaccccaagtagggctttgcgtttgactgagtgctgcagtgggtccctgtccctgctgctccccattggagcttctctctctatacagcagcacttggaaactgcagctcacacagccttgggcagggagtcgggcaagcctggcagtggtgtctcctctgtacccaaagcagagctgaggaacggagacaaaggtttgaggaagggctctggtgcagtgcccagggaggaatcttgctgtttctatgtctcaccctatttacaatatccaagctaacttaaaaagagatcttatcctgacaaactggcaatacacagatgccagctcattctgggaaacagacttggagacatttacaggtaaatcagttacaggtaaatctgaaaagtgctttcatcagcacccaggtgcaccgacagtgacaaaacccctgcatctttatcaggtcttttttgtagaggtgagtaaccaaaaaaagaagtctatgtggagcctttttaaaagcattcttcagaaaagggaaaggaagacttgacctggaagatgctggaaaatcataacttagaaaattattatttcttttgagacagagtctcgctctgtcactcaggctggagtgcagtggcatgatctcagctcactgtaacctccgcctcccaggttcaaaggattctcatacctcagcctcactagtagctgggattacagatgtgcaccaccacactgagcacatttttgtatttttaatagagatagtgtttcaccatgttggccaggctgatctcaaactcctgacctcaaatgatccacccaccttggcttcccaaagtgctgggattacaggtgtgagccactgtgcctggccaaaaattatttttttaaaggagcaaattgctccttgtacattgcagcaaaatctctctgttttgtttgtttgtttgtttatttgtttgtttttgaggcagagtcttgctctgttgaccaggctggagtgcagcaacatgatctcggttcactgcaacctctgcctcccgggttcaagcgattctcctccctcagcctcccagg

SEQ ID NO: 12546 - DNA, 5325 bp, Human
tctcaggagcttggccaagaggaaagcagcggaggaagtaaagaagtcctcttcagctcagatcgcaaaatatgacctcctcaaacccagggacactctctatggtgtctgggaatttggcatcctaaggcacagaacccgggcgttccttaccagcctcgcaggagcagttggggtccattgcaagccgaggtgagactggagttcccaagcgagaagagaagaggcagtggaacacgtggagggcgtggtggagcgcaacagttggcagctccttttctagtcaggggagggagccgggtgcagagaccctgccccacccttgcacccgacccactgagtccgagccgcccgcggtcctgggctgggctgtgcgcagcagacgggtcgggcgcaaagtaccctgagcgcaggtcggtgcacaccgcggggacggccctttcgcagcggctcccgcgggaggggctgtgcacccgggtgagctgcttgtttcaccctgccgggcctgcccagttccctgagattacctgctactcccgccctttggcgttccgcgtgccccgagatcctgacctgcgccccacaccccggggcctgcccaccccctgtcaacagctaaggctttcctggagtcccagtgcaaccccagtctcttgttcaattgtctggattggtgggagcagagagcacagcgagggagtagtgtgcaagggacatgccgaggatgcgaccttcagatctctggcattgcctgttcctgtccccgtccccacctcagttcttcggccacgtttctcctgtgcacagcaacacggaagacacaggaccctgcctccctcccatcaaagtatacttattcatatccctctatgtctctgttttgcttccaggactgactgtaatgcttggttttgttgaaagatttcaagcagtgaagagataaacatacctaggccatagagaagcttcatcactgacctctctacctagggaagctgacaggattcacaccaagcagtgccacttcccagctccctgaccctgggctagtggcttgaactcctcgtcattgtccagattaggaatacgggttcgtgaaaaggactcatgtccctttagggttgctgtgagggttcaaagacagaaagtgattaaacagggccaaacacagacccgtgtaacatagagtaataggaatatggaaggaaaaataaccagcgctcttgctttctaatttaatgcaggatcttcatatcaccttcaatgatccctcttctagggacttgccacactttccaaactgccatcctgtagtggggtacccggctaggctgtggggagaccctggagagatttatgcaaaggaggacctggacaaatgggcccattcagctcctcaagagtggagaatagaagagagaggcagatcactgtttcttccgtgttactgagcacaggagaagcgtgaccaaaggactgaggtgggaacggggacagggcggatactgccagagatgcgaagttcgcacccttggcctgccctttgcacactactcccttgctatgctccccgctttggcagatccagaaagtggagcacaagactggggttgccctcgactccaggaaaggcttagctattgactagagacctgggcgttggtgaaggtgaggggaaagccagaatactggggtaggcggaacgccaaggggcgggtgtagcaggcaacctcagggaagctgggaaggcctggcagggtgagagaagccgcacacggggggcacagcgcctccctcgcgagccggtgcgaaaggggccgtcctgcggtgtgcgcccagctgcgctcaagggaccttgcacttggcccatctcctgcgcacagcccaggccgggaccgcgggcggtgcggactcagcgggctgggtgcaagggcggggcggggcgtctgcgcccggccccgtctcctgactataaaagcagccgctggctgttgggctccactccgccttccacgtgcacccactgcctcttcccttctcgcttgggaactctagtctcgcctcgggttgcaatggaccccaactgctcctgtgccgctggtaagggacgcccgggttctgtgccttgggatgccaaattcccagacaccatagagagtgtccctgggtttgaggaggtcgtattttgctatcagaggtaaaggggactcctttattggtccagtgctttcctgttggccaagctcctgagggcattttcctcctccctgttcctctatgtcagagttgagggtcctgaggctcaaggctgtcctgctccacgtcacctggttggtcacagggctgctggctgagccccaattctctaacctgactctgagctaccggattggataggagacattggataggaggggacattgcctcttccaggttcaggacagaaagtcgaagtcttcctgggccatgtctgcagcctgggactttcctttggagtagaaataggagggtgcttggttttcccagcatgaatggagaggacatggggcttctcttcctctgctctgagtgggaaaggagctctgagggctggctctgcacagagaagggggaagtggacactcattgacccactgctgtaccttctgcatctcactcaccgttcactggctttttctcttctagcaggtgtctcctgcacctgcgccagctcctgcaagtgcaaagagtgcaaatgcacctcctgcaagaagagtgagtgcggggccatctccaggaatctggggctgtggctaaggttgggagggaacccaaggctgtccctgagtgcgtgcttctggggaaccggccttcctttgtccctgtaggttgtcactgcctgtctagtcttctgcactttccagggcttatgtgaggtggggcagctttctcaaaggaagacccattccaatgtccaccagttgtctcctgacaaaaaccatgccatcatgaactaagggtcctctggggctggagggatggagacaggcctctgttggggcagggagttctctgatcgagtctgctctgacctctcaatctcctttcctccccaggctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttgattcccgttctggttcctgttgtgtttttggaatgagggactggggtgggagattgaactgggagtttagactgggctctggatggaaatgtgagtgctgaacagtctgagcgccttcaggcaagccccgttacatcactgacctccatcttctgtaaaaggcacctgcactgtgctggatgatatggggatggggacatacgcgatcagctccactcattaaacgtggtacagagacttctccattcctcatgtttattctcaggtttccctgcccaagttcagatcctccgcggattttaggcttgaaagtgaccacaggaggtggattccaatgcctaaattacttgaatcctccacggggcttctcaaactccacggtgaagggacagttttcattttctatccatcccagacctaaacctttgtaaataaagtaatattaactatgaagataatgaaacacaaaatacagaacccatgttttacattttacacaaaaaaatcaataaatacatacagaaataacagaaaaatggaaggtttacaaactctgcacatatgttcatggatgagttgcattggagactggaaacagcagactgaccccactgtggaccacaccttcagcagcacaggccaggacattctcatgaggaaccatcaggcttggcctagccagcgtcacagacagacagcacactcaggacactcgctgaaccctgagagctccctgttgggagttggctcagaatctttggaagttcctcccaaggtcaggcttcatttgttcctctttcaaactccagcccttgactacttcaaaccagcatattcccgccaagatgtagtgtgatcgtgggttgcagatgaacttagtttggaattttgcttgtgatttcatcatctccataattaatattactttgtttacagaagttctcagaacacagctatggcagattgtgcagctggctgagtgtggtgatgttccttaggaaagaaagagtccctggatgtcttgttaatgacaagttagtccctccacttgtggagggaatgctatttgatgttcagtcaaagaggaagatgaatctccttgtgtagaagtcaggaccacacttacctgttgcttccttgtgaaatgatttcagaaggcagcctgcccctagggcatagttttaggtgtcagggagtcttatttcacagcccactccaccacttactggctgtgtggtttgggcaagtcacccacactctctgagcatctagtgcctcatttgtagaaaggagattatatctcaatgcagggattaaatgagagtgtgggccgggcatagtggctcatgcctgtaatacctgcactttgggaggcagaagtagggagactgtttgagcccaggagtttgagaccagcccgggcaacatggagaaaccccgtctctacaaaaaatacaaaaattatatggctctggtggcctgtgtctgtctgagctactctggaggctgagatgggaagattgcttaagtccaggatatagaggctgcagtcagccaagattgtgccactgcactccaggctatgcaacagaatgagactctgtctcaaaaaaaaaaaaggaaaagaaaaaaagaaaataagagagtggcctggctgctgcctaggctttaataaacaatggtgattatgatcattctctctgcactgactttcttggaaaaagataccattaaatcctaactcactcctggagaaaggctcattggtttggaagcattgctctgggtgggatgctgtgaagtggttgcatacctggctgatccagtgacaggaggagtgtggatgtcctcctgcagaaagtcctctgtgataagacgctcccccaacatttgaacactcataaaatcctttcccattcttcatgtcatttgaccttcatgtaacctgttgaatgaaggtcacaagcttcaggacagggacagaaaatattcagg

SEQ ID NO: 12547 - DNA, 49389 bp, Human
agtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggagtttgggaccaggctgggcaacacagggagaccccctctctacaaaaacatttttaaaaaattagctgggcgtggtgatgcatgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtggcggttgtgtatgtttttatgtcttaagagatggcagttcgctgcagctggattttgtggctcaagccttggggccaaagagacatattcctggcagtctggtgggtaccagtcactattcacatacttccagcaagaaatggttatggcactgacctgaaccccttgacccctggtctggtctttggagttgtcccactctgaatattcgagagaagcagcttatggttaaaacaggcagtggcagctgggaggatctaacagctagatcctccaggcatttggaaaggacaggggcataacgaaggcagaatcgcttcctgggtacgaatgcccactacttctgggcactgtgaaatgggtttaagacgcgggccagcaggacaatgtgaacggtgaaaggaagggagtggccggtaggtggcgctaactggcccgggcatgagtcccgccgtagccgcgtcctcttgcaggggaagaaagttgggaccgccagcctgggcaagcgcgtgagaagggagctgggggtcctaggcaagcgcgtgagaaggggaagaggcggcggcgtcctctccagctgggcttagaatactcttagttctgcctttggggtcttgtcttcctttctgggcctcctgcctgtgttaactttgatgggtgctgaagggaaggccggggtcccggcaggagaaacccgggaacgtcgcggccgtccaggctcccctggcgggttggagccagggttctgactgccaactgtggtccttcccgctgcggctgtggctgccagggcgagggcggtcagcgcaaacctggctgaggacatttcggattcttccttggggattcgttcccttctccttgactccggtgccgcgagggcgacaccctccgggccccgcgtggccaccccgggcgcttccccacgcggatgaacccacctcctgggcgccttcccctcggtgccccgctcgccaattggaggctgcagctcagccccctgacaacctgagccaaccagaggcgccagggaggggcggatcctctgtccccaccttcctccggaaagaggaagcggaagtgacgttaggggaaggtgggggcaatcatggtgccgctggggaggggagaagctgctgctgccgccgttgccgggagccgcggaggtaaaaggcgaaactagactcggcctgggcttgggacttaccgggaggcgcgggacttaggctccctcctgaagcatttcccaatagagacctcagtttggtcaccatagggaccccaccccttctccgtttccatggggatgggtatccagccccccttccctgtttccatggagacccggaccctgcccctctcctccttgcttggagacccccagcttgtcttcggatttttctgtgtagccctgtgctgggggctatcccagacaggttccttttcccagcctcctctcaagggggctctgttcgcactcctcgttggctaccctcaaacctcctggtcttgtttgtttcggacagttggtctccgcgttgccgccgagggtgccggggcagcccactggggccctcggtgctcttctctctctgctcagatgcagcgaaatgtacatctgtggggttgcgtaagccagagctaggggtcgggccggtacctcccggatccaatcctttggcctgtctctggtaactgtctagccatcccactaagtaaaggctcactttctaacccagagcagaagagaaagataaagcgcaaagccagactgaaaactaaaagggatgtgctgattattttaaaattctctattctgcctgccaaacccacatttgtagagcctgtgtttgcagatgaaggaagaatcactattccagaacatgaaagcttcaaatgtggtatttttctcaagagaatgtatcttcccaagatagtatatcttcacgagagagtaggtagccatgtctttcagtcatttagctgacatttcctgaactcttatcatagtatcagtgtactatgctaggagctgtagaaacaaaaataataagactcaattgattcagggacgagagcccaccacagaaccataacttcttgttgacaccatattgttttaggacataaatagatacagtgatcttcgttgtttgtgcctgattgaggaatagcccttccacccagaaggttgaaacatctgttctaggtaggggggaaggaattcatacttgttcctctactatttaccaaacattgtgctttacatatgttgcctcttttatttcttataaaaactttgagagaacaggaattactggtcccaccttgcacgtaagaaaaatgaggcacagaaaagttacccatgtagtaaaaggcaaagacaggatttgtaggtagatgactctgcctccaaagccttgctccttctaccataaactgcatgaaaccatttactgcctcgtggtctgatttggaggatatttgaatggatggagtttcccttaagatttgtagcaactcagcctttcagcagctgctgttctgtttgctcttttgtcccctttaaatattttgaccaagtttcaaattgtttgacaggcgtattcagaaggtcttatgaacttattcagtttttgaaaagcattgcttttctttctttttctttttttttttttttttattagagatgggggtctcactatgttgaccaggctgatctcaaactcctggcctcaagcgatcctcccatcttagcctcccaaagtgttgggattacaggtgtgagccaccacgcccagtcggcattgcttttctttaaaaatgacttgatggttttaaagttaaaataaaaaaattattcccaaggatggtttttcatttgctttggcttgctctttaagtgagagggaaaatgagccttgtggttgctgaggaggtccgtcggtcttgtggtatgactctaactctggctttgttctgttgcagacaagtcattacgttttcatttctcacaactgggctgagcacaactgaaccatgggggaacacagtccagacaacaacatcatctactttgaggcagaggaagatgagctgacccccgatgataaaatgctcaggtttgtggataaaaacggactggtgccttcctcatctggaactgtttatgataggaccactgttcttattgagcaggaccctggcactttggaggatgaagatgacgacggacagtgcggagaacacttgccttttctagtagggggtgaagagggctttcacctgatagatcatgaagcaatgtcccagggttatgtgcagcacattatctcaccagatcagattcatttgacaataaaccctggttccacacccatgccaagaaatattgaaggtgcaaccctcactctgcagtcggaatgtccggaaacaaaacgtaaagaagtaagtaaagcagtcagtgagggcctagtttggttttggggcaagtccttacaaaattcttggtgcaaattttagctggggagtaaaggagtgcatggggttaggacttaagtagttttgctatcaacaacatatgcctcaggttttgttgtgattgcttctggaacttttggtttgtatagccacattgaaatttgggaatatcaaattgtaatttctcgaatttccttccccaaatcataaataaaacagaaatttcacttaagtagacccatgtttctggtgctaaaataactatttagcttatctacagggaaataactggagtttgcttatttgatgaagaaataactatatttggcttatctcctggttgtgtttaaatgatttgttttagagatgagtatctgctggaatatgttttattatcttagtgaatgtttaatgaacttttatttcacagtggcacacgcctgtaatcccagcactttgggaggctgaggcgggtggatcatttgaggtcaggagttcgagagcagcctggccaacatggtgaaaccctgtctctgctaaaaatacaaaaattagccaggcttggtggcacatggctgtaatcccagctactcaggaggctgaggcaggagaatcacttggacccgggaggcagaggttgcagtgagccgagatcatgccactgtactccagcctgggcgatagagtgagactccatctaaaaaaaaaaaaaaaaaaagaaagaaattcaggctgggcacagtggctcatgcctgtaatcctaacactttctgtaatcccagcactttgggaggccgaggcaggtggatcacctgaggttaagagcaccctggccaacatggtgaaactccatctgtactaaaaatagaaaaattagccaggcatagtggcgggtgcctgtaatcccagctatttgggaagctgaggcaggggaattacttgaatctgggaggtggaggtggcagggagccaagatcgtgccactgcactccaggctggatgagagagagagactcagtctcaaaaaaaaaaaaaaaaaaaaaaaaaggaaattcaggcaagagacagtaaatgagagcaggttatctaaaataagttttcattttcatgtttagctaatgtgagtaagctaatgcatgtcaggatgtttatgaaaactgtaaagcattttacaaattatataactggttattattagcagaataaaagagaggctataaagacaaagaaacacattttccaagacaaattaatcacgttaaagtggaataacaacatcgttcactaaacaaaagagcagtggtgcgatcttggctcactgcaacctctgcctcctgggttctagcaattctcctgcctcagcctcctgagtagctgggattacaggcacgcaccaccatgcccagctaattttttgaatttttagtagaaatgaggtttcaccatgttagccaggctggtctcgaactcttgacctcaggtgatccacctgccttggccttccaaagtgctgggattacaggcatgaaccaccatgcccggcccatccaggaactattacaggtcaattagaaaaaaataagtcactagtagttacagtaccaaggactaagatgttaccaaacagaaatagggtgaatgatttagcaaggaatatcttttttgctgtggttgaggtcttaaaattgcatatggcttattgatggcatatcacttttcctttgctagccttagagagaccatcttgtcccacctcctaccctatgcagaaatctccctatggcatccctgacatcagttaatcttgtttctgcttgaagacatccagaacaacaagagcagagtgtttcataccccaacccaatacatttgttagccagctctgattgttagaaagcttttacttgtatagaaccaaaacctgcctttctgcaggtgctgcccactggttctagatctgccttcctgagtaaactttctcccacagaacagtccatcagctatttgaagatcatggatttttcttcctcttgtacaggctaaccacctccatttacttaaatgtccctctgtgacattttccccagtctctcatcagcctagtcacctttgattatatgaattccagttttccaaggtcctttttttcttctttttttgagatggagttttgctgttgttgcccaggctggagtgcagtggcgtgatcccggctcactgcaacctccgcctcccaggttcaagcgattctcctgcctcagcctcccaagtagctgggattacaggcatgcgctaccacacccagctaattttgtatttttagtagagacagggtttctccatgttggtcaggctgatctcgaactcctgacctcaggggatatgcctgccttggcctcccaaagtgctgggattacaggcatgagccaccgcgcccggccccagagtccttttaaaatctgcagttgagcgcagtctcataagtgtgagtcaactagcactgaatacagtatggctcttatctcttaatctggacactgtactacaattactatatagtctacattttatcagcaacatcttactgttagcttatagttggaaatttctagagtagtgcttcttaactgcgggcagctttgccctcaggagatgtttggcaatgtctagaaacattttgtattgtcatactgtggaggcgatactggaatctagtgggtagaggttaaagacattgttaaatgttttacagtgcacaggacagccccctacaacaaagaactggcccaaaatagtgatagtgctgggattgagaaaccctgctctagattattctcatgtatgcagctgtcagatctaacaaaaatgaaaatggagacctgcatgtaagccttattaagaatatctcccggctggacatggtggctcacgcctgtaatcccaacactttgggaggccaaggctggtggatcacctgaggtcaggagttcgagactagcctggccaacacaatgaaaccctgtgtctattaaaaatacaaaaaattagccgggcgtggtggcagacgcctgtaatcccagctactctggagactgaggcaggggaattgcttgaacccgggaggtggaggttgcaatgagccaagatggtgccactgcactccagcctgggcaacaagagcaaaactccatctcaaaaaataaaaaataaaaatatctccctatgaaattttatcttgttggtttcagtccaatatttgagcttgtaggggggttcatttcaactcaacaaacatttataaagcaaaatgctgttatgctctgtggatgttgcaaatgattgtggtagtcgatttatagcatagaagcagaaattgtttacaccaataatcatagcagcaaacacagtgtggtaaatgtgaaggagaggtacaaatattgcactgtgagcacagggaagctcacccttaattctgggatcagggaagtctttgtgaaaaaggtggcgtttgagctggtcttaaagaatacatacaatttaggaaaaaagcaggagaaggtttttccaagagagaggaacagcatgaaacaaggaatgcaggtgggaaacaggccattttcagggaatagccagttgtcctgttacaacagagtcagcacacttttttctgcttagggctaaatagtaaatattctgggctttgcaggctataaggtctctgttggagctactccattcttccattgtagcacaaaagcagccatagacaatacataaagaatgaacatggccaagttctgataagactttacaaaaacaggcagtggggtggatttggttcactggctgtagtgtgctgacccttagactagaacatagtagtagaaggagataaggatggaaagatagcaaagatccaaacatggaaggcagtggtaaccttctatgggttttgaactgtgctctcctagaaatggtgggaaaccattggaggtgtctaagccaaggctagagtggttagatagagaatgtggttagagtagcattttagaaggattggtctggcagcagaggtagcttggaggcagaggaaaactggagacttcttgcctagttaggagacagttgtagtttatgtttggggtttcatttaaatctgaagaaaggatagtggccttgttcatgggaagaatcaaggacttttgtagaagtacgagagaacttcgtacgtgttattggagtttgatgaatgagccatgagttgggcatgattcaaaggttttgaataggccaggcacagtggctcatgcctgtaatcccagcactttcggaggcagaggcaggtggatcagttgaggtctggagctctagaccagcctggccaacatggtgaaaccctgtctctactaaaaatacaaaaattagccggttgtggtggtgcatgcctgtagtcccagccacttgggaggctgaggcaggagaatcacttgaacccagagggcggagggtgcagtgagccatgattgtgccactgcattccagcctgggcaacaaaatgagaatctggttggaaaaaaaaaaaaaggttttgaatcatgttgattgaaaggattcatccattttcccaaatttgttgagtttctgctgtgtcttagcacagctttttgatggagctcaaatctaggtgaagagttaagcagttaagagtccgttgtggtagatattttaacagaggtgtattcgaagtgctgtgtgcatgctgaggagaaagtggctaactctgctctccgcaccctccaaatggtgatcccattcataggaatcaagaaagatgggaaaaggaaaaagttttgatggggtaattaatgagtttggtaggagtgtattgaatgtatagtccttggagaaaagtaacatgaacaaatggaaagctcattggaaacgtgtatctgaggtcaaagaaatggtttggagttagaatagtagtagaaaggggccttcaaactgtgggtagtttacttaagggagaagtaagagttggcctgagaatttaagggttggaaagagaaagaggaacccaagaagatcacagtagtcaaagagatgggtcgactgcagtgttgtggaagctgaaggaagagagtgtcaacaaatgagaatattcctgtgtgaccctgcagagggattgaggagccccgaagaagcctttagttgtgctggttgtgcagttgttcacatatcatgagaagacttgcagcagagcactggggctgaagccaggttttgagtgatgaagaagtgagtgagtgatgaggaaacaggaggcaggaaatgtcaagttggcttttttttttttttttaaataagtttggtagttagaggaagaagagtgatgaggcagtagtagctagctcaaggagattgaatcatttttgtttagcataggtaatttggacatagtttaggacctaaactttaggccatcctccatcagtgattactgtgtgaaagtgtttcatgagcgaatgttcgggaaacattaagttaaaccaagacagaaatttgttgattaggacttctcagagcctttgatgtgccaacagctaagaaggaagaaaacacagaatttttcaaatgctttaaacttgagaaaccatttttcagatctaatttccagggatcagtgttttgtggaacacattttgggaaatgctgatctaggcagaagaggaggagatggtacagagggaatgattatgcaatcagtgaaaagctgtcacttttccactttgtactattcaaattggtttattctatttgcaagtctggtttgccattcttgtcttcagatcattgataatcatattgaatagcacagggtcaaggatattatgagcactttgttcagtttgctggggatttagctcactccactttcctctcacccacatttttccatgctatccatgagacctttgtggaagatgctatattcttgaaatcagtaggtttggggttgggtggagattgaaggagaagtagcagtagctttagtcttcgaaaatcttgcttaatgaccagacattcaggaggcttgccttcctgaagcactgtcttagcttagcttttgttttggcagtgattttattttggcattaaaatccacttatttggcctgaagaggctgatgtttatgactactcgataacagacttcatgatcctttagctcttccttactccttttcctttcgttttttttcagcttggtttttggttttttcttttccctccatgcacaggtgttactcttgagaaatcaaatcatttgataactagttggtcttcttggcttcccaagcagcttattttctgagtcacattttagcctgaatttcctgtttactcctggttttttcattgtttcatatagtgtggagttggcttacctattacttcattttcttttcttcatgcttgtcttgcgcaaaaaataaaccaaccagaaccttgccacagatagtcttttcctaccacaaggccgctggtcattctgactcgaatttcacgtatcttattctcatacttgttatttcattactgtctccctactgatttggtagctttgagatctctctctctctctctctctctttctctctcccttttttttctctttctctctctcattcccttcctccctcccttccttccttcttttccctttctgtctttcttctttcctttctctcttgaaacagggtctcactgtgtcacacaggttggagtgattacagtggtgggatcgtagctcactgtaacctcaaactcctgggctcaagcaatcctcctgcctcgacctcccaaagtgctgggattataggcatgagccatggcacttggccagcttgcaaaatttctaatcaaaatattttcattctgcctaaaaacaaaagctttttttttttttttttttttggttgagacagggttccattctgtagccaggctggagtacagtggcacgatcatggctcactgcagccttaacctcccaggctcaagccgtcctgccacctcagcctccacagtagctgggaccacaggcatgtgctactgtgccggctactttttggtggttgttttggtagagaggggtctcactatgggctggttccaaaatcctgggctcacgcaatccttccaccttggcctcccaaagtattgtgattaccggcatgagccaccatgtctggccctttaaggcctttctactccaagtctcgaagcagctgcgtcttgttgtttgtttgtttgtttacgtattttattttatttttttaagacactgggtcttgctatgtttgcccaggccatcatcatagctcactgtaacctggaacttctggcctcaaccaattctccctccttagcctcctgagctgctgggattaaaggcatgagctaccacacctggcaactgtgttttctttagttggtttgtgcagtccattcttgaatctgtgcccttccatagaacctgccaggacggtctagttacctgttcatctacctctgtctgcactacattggtgacgtgatgtatcctccatggctaactgaccttgccagttttctatagagtagttggccaaggagcatgaaaaaaccctaggaatcgtatgcaaaatttattctacatgatgcaccaaagtattccagcacattgattaggaaaggtatcattttctaccaacaagcacagttacagcaatttttttttttttttaattgaggtgaaggcttgctctgttgcccaggctggagtacagtggcacgatcttggctcactgcaacctccgcctccagggttcaagagattctcctgtctcagcctcccgagtagccaggattacaggcatgtgccactaggcctggctaaattttgtatttttagtagagatggggtttcaccatattggtcaggctggtcttgaactcctgacctcaggtgatccacccgccttggcctcccacagtgctgggattacaggtgtgagctgctgcgcctggcctacagcaatgtttttaggctgcttggtatattgcttctagacacaccatgaactaattgcatggccagtggcattccaagaggagagttatttcttttagtgtgacagattttaagtataacaggaaaaatctgactccagtgttttggagcctttttgcaatgtatgtcctttactttgggagacctagttccaatctcatgcctcattataaattcctcaggcagtggaatgatccactcagacaaaccaagatgttgttgactctcctagaggggaactaccgactttttagtctttgcatactgtgattacatttctttgcaggttcccttctgaactctgatggcttgtaagtgtgaggctctgtaggaatccagagcaagaagcattttccatttacccccatatgaagccattttatcagtgtgtctgcatgtgtattatatacctctccttagtaatcagcatttccatcactcaggtccactggcctggaaaagggactagactggttttgtgtacaattgggtttcaaacttggtgctataggaattataggtctcgatttacatttcacataggttgtacatattaagtactgccaacattttgctgttatatgacattggcaaaagaacctgaattttatttttttctcctcatatttaaatcaggcttacttgtttcttctgtgatgtgcaaagggatagtttcaacctaggttccagctttgttctgttatgtactagctatgtggccttgggcaagctgctctgtttccttttttataaaattgaaatagaaatatcccattgcattttgtgaagattaaatgagatttattcatatgtaatatgtataaaacatttagcatagtgtctggtgcatcatgattgttcgctggatgttcatttgctttcttttcctcatagacccccatggttcttgaaggaggtaaagaggtaatgtccagtttaacaagaggttaaaatgttctttgttaggcactctttgggaggtgttttctccttgagacaagcttacatataaattgtgattaggttccaggatagcccatagaaatcttggtaacccctaattagctgaactgttgtattaatactgccatggaacataaaccgccatttataactgtgttttattcatttaattttttgagacagggtctcactttgtcacccaggctgagtgcagtggagtgattacggctcactgcagccttgacctcaccagctcaagcgatcctcccacctcagccaccacacctggctaatttcttatttttttggagagtcgcggtcttgctatgttgcccatgctggtctcgaacttctgggctcaagtgagcctcccacctcagcctcccaaagtgctaggtgagcacttacaggcatgagccacctcactggcccatacaacagtgttttaaaatgagaacctgtctgtagtcccctgcaggcgttctgtggataccagctcttgccactcctctctcttatacttggcttcctttgacttagtatcaggccactgaaaattatttccatggtgggcatttggggcaccaggcagagctaagggctctcaaagaatgaggacttctattatgctggcaatggtggtggagagaggaagatggctggctgttgaatacctgatatgtaccgatcactatgttatgggctttaatatagttttgtatttaattttcttagcaatcctataacatagatactattagcccccattttacagatgacagactgacacttagaaacacacaactagcaactggtagaaccgagatttgaactgaggactttctggatgccaaagcctatgctttctaccatcacacaccacttttgcaaagatacaagaatcaggtattgagacctgttggctgtgaaaagggctaagaaatgaagggacagcagtacttgttctgtaagggtaaaggtttgaggtgtggggaacagctggatgaagtcagctctcatggtgggggatgggaggcctgtcgaaatgagatcttcagggttcttatatttctgagctttttggttgtccattatggagaagaaatgataccagtgccggtgtggggaatggagtcggacacagagagggaagggaagtcactagtgatggggaggaaaaggcagtttctatagccataacagccaggccagtcatttatttatgagaatgttcatgtgctaggtgcccagaagcaggaactctcttgtggaatagggggctgtaaatgtgtgtaaaatctgcttctcactttcactttcttttcctccaggaaaaacccagccttttttcttttttctttctttccacaggtgttgacttttttctttttctaatttttttaaatttttgccttctggggtcacagtgttttattttctcacttttgcttatcccattcacctttcttctctgattctgttatcttaacaaggcagtcatctttgttaaatatttctgtattctagaactgctcagaacactttgtaaatcagcatcaattctctgaaagctcctactttgtgcccattactagcatgagatgttatcctcagtgcacctaacctgtgctccctccatgttccctaacagggtaatcgacagctgtttgaggccactcaggaagattaaagttatgcttagagcctgaagctcttttggaggaaagcttttttttttttttttttttaaatggggtctcactccatcacccagctgctcatgtctttaaattcaggttggggatcaccaccttcaagaagcctttctaaggtcactgaagtctgttacatgtttctttggtatattcccatagtatgctgaatatctgttatcagtaaaacttctcaaaccatgttgttcttgtctgattttccttttgactttgagctctttgagagtagggacaatttttatatgtattcctagcacccaggacagtataatttctggaacataatttttaggatgtatgaatgataaaccttagttgtattgaaatgttccaaatgttgcaatacctcctgtatgtaaccatgaaaacctacacgtttttgcaatttcctgctctgatccagtttgaggaggtttagttttccctttttgtgaaattttgtgctattttaaaatgattctgaaagacacagaatagtgacttcttcttctccctccaaatgaggcaagagattactcatttattcagcattttatggggggagcacgcatttgctttgacagtcaactgtctcccccacttttaaatacaaatattttcaggccgggtgtggtggctcatacctgtaattccaatactctgggaggctgaggtgagaaatttatttgaggccaggagttcccgaccagcctggcctaacatagtgagaccccatctctacaaaaaatacaaaaattagccaggcgtggtggtacatacctatagtcccagttactcaagaggctgaaatagactgcttgagcccaggaggttgaggctgtagtgagctgagatcatgccactgcattcagcctaggtgacagagagaaactccatctattcaatcagtcaatctgtcaatcaatcaataaaaatcaaacaaatactttccccaatctgtgtccttttctaacttgctatccgccccctcccctctctttctctcctcagccaaatttctggaaagtgtagttgatattcattgtctcactttctcacttctgttcctaccattccagtgaagctggttgtgctgaggcaattatgactttgtgagtcagctaaatccaagaggtgttttatcaatcatctgtgttacatttgacctacttgaccattctccttgaaactattcctttgtcacatgtcacttgtagtccttgtcactaccttttcagtcccactggttttgttcatttgttcattcattcaaaaaatataaatcaagcgccacttctccacaatgctagtcccggaagttgtgtcagtgaacaggataaacgtagtccttgctctcatggagcttacagtccagccgggaagtagctattcacccatttaattggacaaatatttatttagtgcctgttgtttttcagataactgttgtgcctagccatgaaacataatgatgtaaatggtttaatcaggtaattattgcatcttaattttatcatgtgctttacaggaagctctgaaaacctataattaggatgcctattctagtctgggatagaagtaagggtcagtcaggaagagttcctagaggaagggtcatttagtggaggcttgaattgtgcaaatgaaaaaacatgaatgggagtagagtttggcagggcagggagacaggagggggtagttaattatttattgcagttacttataaagttaacaaaagctgtagcatcttaagagtgaaattctgctcttatcattcagcattgttgtaagctttatgattgatacatgcagactcctttatcccagcatccacaatcccatttctccttagtggtgagtgatcattttcaattctctatctggcagcacaaaggaggtttttagtcttgatgggaagtcagaatatatgcatgagacaataattaacagtataaactaagtgtcaaatgagtggtatagtaagtattactggcatttagagaagggcactgtcatgtagacatggaatgatggtgaaggagcgtgtagttcctgaggctcgcgttaaaggaagagaaggactcagaaaagcggagaaggaaggaactaggcatttccagtggagaagaaggagagaacgaagtcagggaagtaggaattcagtcttgcaaatgggtaagagtgtactgttgcttataggcctagacagagtcttctgtttggctgcttaccgagtaatgtgatagaagacagaagcagccctggaaagatctttgaatgttaggctaaggaattgggactttatcatttgagcagagagatggaatgtgtggaaaactgttttagacttaatctggcaacaaatgactgcaaaactaggtcctgagacgtgagaagaatgcctggattagtgattcaataaggaattcagtttaacaaatatttatggagcttcttctgtgtggcagtggaaagagaacacaatgaacaggtgagagcacttgactaaggaacctaaagacttgtgcaagatcagatgggggttggatggatgggggaggggtgggaggggagacaggaggagtaggggccctccctttactaccctaccaccacaggtttcagaggttagcatactgtggcctacaggccaaatccatccagttacttgtttttgcacagcccttgagcctaagaatggtttttacatttttagatgatttttttaaatcataagagtatatcatggtatatgaaattcaaattttagtgtccataagtaacgtttttgaaacagagccttgctggttcatttacgtattgtctgttgctactttaacatgcagaggtgactagtgacacagaccataaggcccacaaagcctaaactattttttgtttagccctttacagaaaactttgtccatccttgagtcacactcatccttatctcaaatctcttctctgaaactaaatgtccctctcctacctgaggctttcccctcctcccgggcttttaaatcttgctcttctttattttcctccttaaatcctcaacttctccttcttccaggacttttctgcctccaaatatgttcaagaactgacttactttaaaaaaaaaaaccaggccaggcgtggtggcttaaccctgtagtcctattgctttgggatgccgaggcaggaggactgcttggggccaggagttccagaccaacctgggcaacatagcaaaacatttaaaaattagctgggtgtggtggcatatgcctgtagtcccagctactatggaagatgaggagggagggtcacttgagcccaggagtttgaagttacagtgagctgtgaatacaccactgcactctagcctgggcaacaaagaccctgtctcttaaaaacaaaaacaaaaagactttatcaactcaggagttcacttgtgctgccgtacttcatctctagcctctacctccacttcacctttcatttagtcacctgcatccggaccctgaccccagtagtccgctgaaactagtcttgctaagtcattagtgaattcctagctgctggatccagtcacttccccagtctttatcttccttgttttctctgacatttaacatgttgatcatgtttccttgagaccctttttcctttagctctggtgacatcattgttcttggtttctctgtctcaaacaaaaaaaaaaattatgttgaacaaaagtgccagaattcagtcttctgctgccaagtctagtgcttcttctaccgcatcagtatagatatgaggatctttgggagatgagagacaaaattgggaatccctacacctacacttagaggttaagggaaagaagtatctcagagaaggagttaaagagtgccccaaggcattactatgttgtgaaggacaagttttcagacattgagggtatcatcaatgagacatgtttgcgaatagtcaaggaaaatagggaaggacgaaagagtctgactaccgggaagttaagagaataatttcttacagtaaagccatcttgccaactggttaagaaatacatgggcattgatggaaatggtgtcaactgccattttttaaatttttaaaaattctttttcttttttttctttcttttctaaatcatccagcccaaaatgttattgttattattattttttctgtcatctaggctggagtctagtggtgtgatcatagctcactgcagcctcagccttccagactcaagtggatcttcccacctcagcctcctaagtgctgggactataggcatgtgccaccacgcctggctaacttttgtattttggtattttctttattaatatttttatttctattattgtttatctagttttttttcccccttttttttcttttttgaggccaggtctggttctgtctaccaagctggagtgcagtagcaatcatagctcactgtaaccttgaactcctgggctcaagcaatcttacctcagcttcccaaatagctggaactataggcatgtgtcaccatgctcggctgattttgtggttttgtttgtttttggtagagacagggtcttgctgtgttgcccaggttgtctcaaactcctggcctcaagtgatcctcctgccttggcctcccaaagtgatgggattacaagcatgagccaccgcaccctgccttcttctttttcttttctttttttaaacaggctcgattcactttatttttcttgtgtaaaattcctgtgttatagccacagttggagcctgggtcctctgcacagagactctggtgtgggtcttgatgaggtggtcagtgaattcctgacggggagacttggtgaatacagtctttttccagagatcaggggtcaggtagctataggtcttagaggtggcctaaagggtggctttggtgaagttgtccagggtagcagtgcagcccatggcagaggtatagcagttgtcaataccatccatcagcagccgtttcctgggcatgggccaagatgatgccattgccttgggtggggtgggggagggataaggcacaccagcacagagccacagcagcctgtcaccttgcaggggacggcgtggggcttgctgatcttgttcccctagtggcctctccaaacaggaacagtggagagcttgaccaggatcatggccccttggatgacattggcaacctccttggagcactgaacatccagaccgatgtggccaccgtagtccccgatggccttgaacctggtgtgctggccagcgcgggtctgcttttgcagaggtgtagtcttcaaaagctcatcctcgagaggtgaccccagcaaaaagtcaatgatctcagactccttaatgggcagggagaagagctagaccttctccagggacttgatcttcatgtcctggaccaggcagcccagcttggtgatgggcatccactccttgttctcagccttgcctctgagagctccatggcctcagccctggctccaggccaaccacagccatgaccctggccccaatatccctgccaaagtctctgaggaagctgctgggcctcccattccaggccctccactgcactagagtcatctgccatttgatatttgtcggagaagcagcttttttttttttcttaaccttctgccatgaggtgaagaattgactcccctttcaagaagtttgatggtgaaaggaaacaagaggctggcagtttgagaattatcacatcaccaaatcttccaagaaatttgcaatatgttgttgtcattttgtaggcttgaaaatatgcagtggaaacaatctagggaaatatgtttgatgattaagtatgtaaatttccagatgttttaaactcaatttaatattggtaattccaatcaagttgtagttctggaggtcagggtgtttagtcaagccttaaaacaaagttaagatcttatctgaatacaggtagctgtaacagtatagtgtacttttagtgggtagatgtatatagagtctgaaaacattcttatgttcatttagaatattcatctacatatagacttatttcttccccataaatcattatgtgttgtccaggtatgatttgatcaacaataaggtttttccactttgctgctagaggctgttttctgtgtttatgatgaaaacccagttgtattgtccacagcatctcttgggagctgagctctgggtgggggagttaagccctgggcagcatttttgtcctgttgatgaggtatcttttctctgccaggtaaagcggtaccaatgtacctttgagggctgtccccgcacctacagcacagcaggcaacctgcgaacccaccagaagactcaccgaggagagtacacctttgtctgtaatcaggagggctgtggcaaagccttccttacctcttacagcctcaggatccacgtgcgagtgcacacgaaggagaagccatttgagtgtgacgtgcagggctgtgagaaggcattcaacacactgtacaggtcagtctcgtctccaatgctctgccagcctctgaccttgaccttgttgtgatggcagagctctttccccttgcagaggagttgttttcactttcagggctttaaaagagcgcagctgtgttcaactacgtaaaattcatttctgccagatctcagaaaatgaaagaaaaaaatttaaaaatgcattagagaaacctgttacttaaagatggacgtatcttgggctggttagaagcgacagtacatttctgtttagatttgcatctcatggagcagcattctggcctgggcatttcagtgcttggcatagagtactatctccccttggctcaggatctttgtgctaaggcttctgtcctacctaagcttgaaggacttttctatcctgagaaatggggagtggcctattcagtagccaattctctttttcacgtttgtatcaggagacttaatagtcttcagtattgagtataaagtaatagaaataacagtagctaacacttaaaaatactcactgtgtgctaggcatgattccaagtgctagtccccacaatagctgataagtaaatggaagcacagaggggttctataactagcttaagtttccccatccaagcaggatgtggggtcaggatttgaatcccaggaagtctgtctccagagtcacactcataccactatgctattctctgcgtttcttttggggcaaaatatgttggatactaatatgttatgggtatagaattcttacgcacttgatcctgaagcacattaagctggcatggggaggctctgtagaactttatgacaaagggaggccaggcgcagtggctcatgcctgttatcccagcactttgggaggccgaggcaggcggatcacctgaggtcaggagttcgagaccagcctggccaacctggtgaaaccccgttgtactaaaaatacaaaaattagccaggcgtggttgtgggctcccataatcccatctacttgggaggctgaggcaggagaatcgcttgaacctagcaggaggaggttgcagtgagccgagactgcgccattgcactccagcctgggcgacaagagcgaaactctgtctcagaaaaaaaaaaaaaaaaaaaaaagaattttatgacaaagggaatttttctggaatattttgcaggctgaaagcacatcagaggcttcacacagggaaaacgtttaactgtgaatctgaaggctgcagcaaatacttcaccacactcagtgatctgaggaagcacattcgaactcatacaggggaaaagccatttcggtaggtcttactgttttctatttgtcactgaccaggtttcagctgggggtcttgatatactctggaatttttcaaaaaagaaagaaaactccctttactagctcttgatttagcagtgttagctcaccccaggacagctataaccaaccactgcagattagaggggtgctgatggagtccaagaacatccttactctgtggatgatggcctttctgcctcattttttcccatttatttccaagaagcatttgttgaaactcagttatgtggtgggtacttttattagtgctagagaaatactccgaagcaggccttcttcttaagaacctttgtctggtgacaaaaaaccacaaatttgtggataatatctgaggctgcaagatggccaaagtgccttaagcccagaggagggatacctacctaagaatcaaggagggagggaatgaggagacaagagaggaaatgagaggtagggatgcttagcttagtggtgcagttgttacttgttcaaattattgctttgtaatatctcgtgtgtatacacaaacatataggagcatccatttttattcatatatgtcaacatatgtatatctaatagatacatttactataaacttgaaggagggacttgggttatctactttcttctctgctcatagtatatagcatgattccaggcattcaacaggtattcaaaatcagctttgggatgattatatgacatttttaatgagataatcagtttgtaaggatttcccctaaatgtaatatagatagatgtattgccaaaaactgcccataaacaatgtctttgaggccgggcatggcggctcatgcctgtaattccagcaatttgggaggctgaggcaggtggatcatgtgaggttaggagtttaagaccagcctggccaacatggtgagaccacatctctactaaaactacaaaaatcagccaggcgtggtgtcacatgcctatagtcccagctactctggaggctgaggcaggagaattgctggaaccagagaggcggaggttgtggtgagccaagattgtgccattgcactccagcctagatgacagagtgagactctgtctcaaaaaaaataaaaataaaaaaaaaataaacaatgtatttgaattttggcaggggatattcaaggcattagatatgctacctgttccttcttaaaccactcgttttgttagggtacttagaaataaaaagtcgttagagacagtcaactcttagatgccaatcaaatggaattgtgggctgggcttatgtctgtaatcccagcgctttgggagactgaggtgggaggatcacttgagcccaggagttcaagaccagcttgggcaagtgagaccctgactctacagaaaattttaaaattagttgggagtggtggcgcatgcgtgtggtcccagctatttaggaggctgaggtgggaagatcgcttgagcctgggaggtcaaggctgtagtgagccatggtcatgccactacactccagcctgggcaacagagagagaccatgtctcagaaaaaaaaggaattgtgtttttaagttacagatgcattcctgagtcatgatccctttaagggcaagagtagttagattgtaattggttactctacagatggatgctgtgaagcttaggttattccccgcccccccccttcccgtaggctgctgagaggactctgatttctatccagtcacatgcatttatttttgtgatgattaaaactgcatttttcttgaatattcaatgagactttagacatgatgatgattgcatgtaattaaaaatgaaaatgctttagagaagctttctatttaaagaaataaaatattttggtttataagaaaatgcattcattcatataagtaattaaggaatgtctgctatgtgcaggaactacagaaagagctacgtggatcctgtactcaagtagtttacactctaggagagcagataccagatgtatccacagagaaaataagattggaaatgagagttgccataaaagaaatgtaaagaaaagccttaggagttctgaggagggaaagattccttttagctttggttatcaagacagtaaaagagaatgaagtagatctcgacacacaagattatagataagttacttgagcctatcttctgattgattttgttcttatgttacattgcaagccatgtacatatttgagagccactttgcttactcttgatattcctaatgttccactggcagatttttcatatggactgtcactgtcaacagaggtctgttaagtaattcatcaaaagacttttgttgtcagggctctcaacatggaccttacctgtaggacaagaaatacttatcctgggctctcagttctctctgatcccagatatgccaccttactttttcaagaacctctcatcattcccatctctaaaaccagtgtcattgatctgatcttagtgttctgaatatttgttttagtttctatttataagagatgttcagaggccaggcacagtggttcacgtctgtaatcccagcacttgggaggccgaggcgggcggatcacaaggtcaggagatcgagaccatcctggctaacatggtgaaaccttgtctctactaaaaatacaaaaaattagctgggcgtggtggtgggcacctgtagtcccagctactcgggaggctgaggcaggagaatggcatgaacccgggaggtggagcttgcagtgagccaagattgcgccactgcactccagccttggggacagagcgagactcgatctcaaaaaaaaaaaagacgttcaggataaagatctattagctaatgactcctgtttctctttccttaacaaatttaggtgcgatcacgatggctgtggaaaagcatttgcagcaagccaccaccttaaaactcacgttcgtacacatactggtgagtttaggccaatttttgtttcatcaagcctgtaactatcaattttccattgagacctgtagagctaggtggatatacagagatatagatcctgtatatattcaggtgagcataattagctcagccttacctagaatgtttgggtttctttcagaggcggacctcaggtattcaaccttaagagatgaaaccaatacagagacactctaaaaaaaaacaacctgtgagaaacaaatctactctttaaacttcccagcagtaggcattcccaatgctttgctcagcattgagtttgaggactgagatgattaatgtgtaatttattgaacttttaacaactgttacccaaactctcttaaaaatacttacttacctctattagggaaaggtagatttcttaatccagtgaaatgactttatggtaaattaacactactttgttattcttgcaggtgaaagacccttcttctgccccagtaatggctgtgagaaaacattcagcactcaatacagtctcaaaagtcacatgaaaggtcatgataacaaaggacactcatacaatgcacttccacaacacaatggatcagaggtgtgtagtgtttttgtctcttgatctgggtaccatagaacttcaacagttgtttgtgtatcacaatcaaaggttaaaatgtcttctctgtatatctgttagtgagcgggaagaagtcagggtcaagatcagtgtcttgacttgtgtatttaaccacctactcgacgtcttcacccagatatcatctactcttgtcaaacttaacatgtccaaacctgttcttcctgcagtcttcctcgtcttggtaaatggcggctctggttttctagtggcaaaggccaaaaatcttatagtcattcttgactcttttttccctcacactccacatccgccagcaaagtctgccagctcatccttgataatttatctagaatcccatcacttcttctgattacttcattcagtctactgttgtctttttgcctggattattgcaataacctgttaagtgagcttcttaggaccttttccccctcttctgtccactccacaatagactgtcctacatatatcagccagagtgatctttctgaaccataaagcagataatgtctgtcctctgctcataacccacagtagctttttaaatttttattttatagatttttaaaaattattttaatagagataaggtccaagcagtctttccccttcccccacccccgccgcccccaccctctgtctcagcctcccaaagtgctgggattacaggcatgagccaccccacctggcctcccagtagcttcctgtatcacttgaagtaaaagtcagtctttatagtaggctatagggccctacacattctggcctggttgcttctctgatctcatctacctcgcttttatttttgttttatttcattttatttgaaacagggtcttgctctgtcctgtaggctggagtgtagtggtgcaatctctgctcactgtgacctccacctccctggctcagggatcctcccaactagctgggaccacaggcatgcaccaccacacccgggttttttttgtgtttttagtagagatgtggtcttcaccatgttgcctgggccggtcttgcactcctaagcttaagtgatctgtctgccttggcctcccaaagtaccgggattacagatgtgagccactgtgccctgcctacttttcttcctctcacttcagccatatggtcctctttgtggtttcttgaaccaaggagtgtccactcctgcccctaggcctttatacttgctgtaccctctgcttggaacatcttctctagatatgtgcatggttgataccctctttccttcactctctactcaaatgccacttacctaaaagggcttccctaaccacccaataaaagagcaactcctatcccagagttccctactgcccttactctccataacacttatcctcttgcacattgtatatttatttgttttttgtcctctctgctagaacgtaagctctacgtggggaggagtttagtttgttcattaatgtatccctgggtctggaacggtgtctaatacatagtagatgcattatgaatgtttgttgagtgtgtgcatgaataggagcatctgaggtaagcagggctaccacctaaagtgtgaattgtgactggcattctgggactccagagttcacttagtctgggcagtggaatttgaattctaaatccccagtaccactctgagtaaggagcctttcagtgcccatgtgggaaacacagtggtggaaggaccattgacttttcagtcagaagcactggatttgtcttctgctaattagctgtgtgtttgggggcacttgattcctactgtctgagcatcagttttctgatatttaaaatgggaatataagtttgtggcaatttgttacaaaaagaataaaaaatggggatatagagtaatacttccaagatttatatgaatggcaaatgaggtcctgtgaaatcactgtaaatgatgagaccaggtatacagatagtattaatttcacattattataggtttgttactttggagccttagtcataagataatgttaaaactctttattattattattatttttttttttttgagacagagtctcactcttgtcgcccaggctggagtgcagtggcgtgatcttggctccctgcaacctctgccgcccaggttcaagtgattctcctgcctcagcctcccgagtagctgggattacaggcacacaccaccgcgcctagctaattttttgtatttttagtagagatggggtttcactatgttggccaggctggtctcgaattcctgaccttgtgacccacctgcctcagactcccaaattgctgggattacaggcgtgagccaccactctcagcctctaaaactctttattaatcatttttaagaaatgtaagatattcttgtaagaatatcaggatttttaaaaattaactaattcacggggtggggcaggggagggatagcattaggagatatacttaatgtaaatgatgagttaatgggtgcagcgcgccagcatagtacatgtatacataatgtaacaaacctgcacattgtgcacatgtaccctagaacataaagtataatttaaaaaaaattaattcatttagcccttgctttggttggcttatacttcttcagataatacatgtagacatgtggaacattagggactttgtaatcaaatgttttgttacatgatatgccactgtaaatcctgatttttgttactcaattagaattttttctctttcacaggatacaaatcactcactttgtctaagtgacttgagccttctgtccacagattctgaattgcgagaaaattccagtacggtaagtgtacctgtaataccagtgctagaaaaataagggcaagaattaagcactccctttggtgggaaaattgaggcaggccagtctttgaagttttctaaatttaattgtgtttaattactgaccatgtaggattttttcttcttctgataagagttctattagagcctgttctctctgatgcctgattccttttgacgcaggtcactcactcggtaacctggccccagaaaatttcttttttttactcatttagcaaatatttattgaccaggcactgtgccagtactgagcttatagtagttaaaaatgttggtatagtttgtccttgaggaacttaaagtctagtactgtaagacataaccagaattctagtttctggactttctcaaatcctatctatatgacctggcttggtcttttcctttttcattttaattttatttatttattttttttctgtgcaatggggagagaaaaatttcccttctttaggtttattagctttttgaagaaaacctcttacacatatacaggcctctatctgctaaaggacaagcccactttatcttaatctgattgctttgattcaagctgttaggaaatttgactgccattcccatggctccatgatgcaacttacaaaccaatgcattgagtctgagcttatgcagcctcctccatgttgaacatgagagttttatagtattgctaacactaattttgagtttgggttttttgttgtcgtttttcctggtaaataaatatagcataggctagattttctgtgattatgtgcataatgaataaatatgatgggaagtatttgaacagagactgaatgattcaggaatgctgtgaaagagtggttagtggagtcaattacagcacttctgaagttgtaggttcttgggcctccccccaagcctgctgagtcagcttgtctgaccgtggcatctgaacctgcatttttatgtaagcacgacaaggcctaattctccttctggtagtggcagagttgctcttatgagaccaactctcccgcagaaaacagctaaaaattctagacaaaatataaaaaacaactgtggaaaggcactggtgagcaaccaatagcaagcagaggtaaccttggaagaagggattgcttggaagatggtaaaggcactgggtaggcttgcaagttttatggcttatccaccttgggcaagccccagttggcacccaacgaggcagccaaacttataaaaactcaatcttactggcttgaataaccagaggacagagttcagggtggccacagcacctggaaagtgaaggcaggtagcctggaaaggaaagagtcactaagggggagccccaagttctgtgtataaactctctccgaatctctggctgacccctgcgccatggatgtgtgggatagactctaagcagcccagccaaggctaaagatctacacaaagatcatagctgcatccactgcaagggagatgaagttaatggaatattcagacaaacaagtcaacacacttccaagaagtgtaacagagtccagagtctctaaaatatatcatttgtagtgttcagagcaatcccaaattagtaaacacgtgaagaaacaggaaaacatgatccctccacaagagaaaaggtaatctgtggagatggaccccaagatgacccatctaatgttaaaattaacagacaaggattttttttatttttatttttttatgcgacaaggatttttaaaagctattatatgctcaaggacataaaggaatatgcttgtaatgattgaacaaataggaaatctcagcagaggaatagaaaccgtaaaaagtgtaccaaatggaaatctaaaacggaaaaatatagctgaaataattcactggatggggcttaacagcagattggaaatgacagaagaaagaatcagttgagttgaagatcaataatagaaatgaatcaaactaaagagcaaagagaaaaagattaaatgggtacatcacatgacttttatgcatattcctattttacaactaatgttctaaaagaaatttctgcactgggtggtctagatgccctcaaagctacccagcctaagatttctaggaataatatccctttaacgtgtaactgtgttaaatagcttaggagtctattctctggccaagactatgacatatgactaacgagctttctggagccctagggtcaccaggaaaataccctggcataaggggacaccaagtacttatgaaaaagggaagcctttcctatcacaatttatataatcaagagagagaagcactatcccttggggtttaattatagatcatgctcctggtacccagtgtttatctcagatgtggaaattgattttagcctttcaaactaaggccacaattccttgaagcaataggattaatttttcttttttctttttttttttttgagacagagtctcgctctgtcgcccaggctggagtgcagtagcgcgatctcgcctcactacaagctccacctcctgggttcacgccattctcctgcctcagcctccccagtagctgggcctacaggcgcccgccaccatgcctggctaatttttgttgtgttttttagtagagacagggtttcaccatgctagccaggatggtctcgatctcctgacctcgtgatccgcccgtctcggactcccaaagtgctgggattacaggtgtgagccaccgcgcccggccaggattaaattttctttgcttgaaaaaaaaattagggacatgtgcagtggctcatgcctgtaatcccagcactttgggaagcagaggtgggtggatggcttgagcccaggagtttgagaccagtctgggcaacacagtgagacctcatttctagtaaaaataaaatattagctgggtgtggtggtggtattttctaataaaaatattttttttaatagagacctcatctctagtaaaaataaaatattagctggtgttgtcccagctatctgggaggctgaggcaaaaggattgtttgagccctggagtgagccatgatcacaccactgcattccagcctgggcaacagagcaagaccctgtctcaaaaaaaaaaagaaaaaaaagagagaatcaggacttgttaaaatcaaatagtaaatttatatgagataatgattttatgggtttctcagcagccatatgtatgcatatcctagaaatgaactttggtttgctcagatcttttgttagaggagagttgaaggtgctagggaatggccttctcgaagccttttggctgctcagctccaggatccatcctggtcccagacagctacctgtattctcctcttctttgccctttgctctttgctccttgctccaggcctggaaagctcagcctgttcttgtcttctctacttgtgaaagttgttcctacccactttgctcccagcgtttttgccctgaagcttggcaggggcttcagcattttcctttttttaaattttaacaagctttttattgaggtacaatatacatacagaaaagcacatgtattataaatgtacagcttgatgaatcatcacaattcgtcacacccatgtaaccagcaccccggtcaaaaagaacattcccagccaggcgtggtggcttacgcctataatcccaacactttgggaggctgaggtaggcggatcacctgaggtcaggagtttgagaccagcctggccagcatggctaaactccgtctctactaaaaatacaaaaattagccgggtgtggtggcgggcgcctgtaatcctagctactcgggaagctgaggcaggagaatcacttgaaccgtggcggcagaggttgcagtgagctgaaatcgtgccattgcactccagtctgggtgacaagagcgaaactctgtctcagaacaaaagaaaacaaacaaaataacattcccagcaccccagaggcccccccctcacatacccccaaaagccatgatctctccctgcagacaaccactattctgacttacaacaactaagattagtttttcctgtttttttttttttaatgcttttatgattggaatcatatacttgtttatgtgtggcttttcttctcataacattatgtttaagaaattaagccatattattacatacagttacaggtcattcattcttcttgttgaacaatattacactaagtgaatataccacaatacactaaatgaatataccaatatttgttctttctcctgttgggcctttggatagtttccagtttggagccattatgaatagtgctgctgtgaacatttttgtacatatgttttggaggcacacaagcccattccttttcttttccctagtattattgaggtattaggttggtcaaaagtaattgccattgaaagtaatggcaaaaaccgcaaatacttttgcaccaacctaatatcattgacaaatatagctcattcgtttttaattatgttactacctataatgatttataaacagaacaaaagtaataactatggctggtcgtggtggctcacacctgtaatcccagcactttgggaggccgaggagggtggatcacgcctgtaatcccagcactttgggaggccgaggcgggtggatcacgaagtcagaagatcaagaccattttggctaacacggtgaaaccccatctctactaaaaatacaaaaaacaaaattagccgggcatgatggcaggcgcctgtagtcccagctacttgggaggctgaggcaggagaatggcgtgaacctgggaggtggagcttgcagtgagtcaagatcatgtcactgcactccagcctgggcaacagagcgagactctgtctcaaataataataataataataataataataataataataacaactatgaggaggttgcaaagcttatgctcagtggtagttgttagtcaactatttttcaaactggattgcaccttttcattgggttttaaaatagtggtttataatcagcatttcaaagacatcaatagaatagaaaaaaaatcagaggacattgcacatagtaaggataaggtctgtttcatagacttgtttcagttacacatatggatatgtatataatatgaagaatgtatgtatatacagtgtaaaatgtatttcttactttgtgtcacaatgaaaatttgaaagtcacactattggcctatgagttttaactctgtccggactggaagttggaagttgtcccacatagatttgagatggagtcttgctccatcacccaggctggagtgcagtggcttgatctcagctcgctgcaacctccacttcccaggttcaagtaattctcctgcctcagcgtcccgagtagctaggatttgaagcacgcaccaccatgctcagctaatttttgtacttttggtagagacggggtttcactgtgttggccaggctggtttcgaactcttgacctcaagcgatctgcctgcctcggccccacacagtgctgggattacaggtgtgagccactgcgcctggcctcacataatttctgacttcaccttctatcatattggcaatcaggatcactgaaatgaagaaaaaaaaaaaaaggaatcactgaatttcccctccttcagctgatagacgtagaagagaatcatcagctggtggtggtggctcatacttgtaatcccagtgctttgggaagactgcttgaggccaggagttcaagaccaggctaggcaacgtagcaggaccttatctctactaaaaataatttttaaaaagcagccaggcatggtggcgtgcgcctgtagtcccagctacttgggaggtctaggggaggatcttgaacctaggagttcaaggttgcagtgacttgactgcgcctctgcactcccgcctggataacagagctagaccccgtctgaaaaaaagggggggaaaagaagaattgctcccttttggctccagtgggcaatttaatctttgagcacttctagattggtggacagccccactcatcaccacacttctacccaatcccaaagtgatccttctgagttctgccttctagaagcagagttgttacaaaatgaccttaaaacgtatgttggcactagggcaagatctgccctaaaaagaggttttagtttggtatatacagtgtgtttaagttattttcaattacatgtgacccttgaacaacacaggggctaggggtgctggcctcccaacccataaccccctgcacaaccaaatcctagtataacttttgactcccccaaaactgagctagcaatggccttagcctactgtgattggaagccttactgataacataaacagtttagattagcagatattttgaatgttatatgtattatgtattgtattcttaaagtaagctagaaaaaataaaatgttaagaaaatcacaaggaagaggaaataaatttactatttattaaggggaagtagatcattgtaaaggtgattcatcctcatcgtcttcacattgagtaggcggaggaagaggaagaggaggggttggttttgctgtgtcaggggtggcagaagtggaaaaaagtcccaagtataagtccacttgtgcagttcaaatgcatgttgttcaagggtcagctgtacttgcttttatttacaagttggtagatttcatgtaaaaatcaaaatttctgggtctgatgtggtggctcacacctataatcccagcactttgggaggctggggtgggaggatctcttgagcccaggagttccagaccagcctggacaacatagtaaaaccctatctctacagaaaaattaaaaaatcatccagatgtggtggcccatacctgtggtcccagctacttggaggctgaggtgggaggatcacttgagcccgggagttgaaggctgcggggagctatgatcataccactgcactccagcctgggcaacagagtaaagaaaccctgtctcaaaaaaaagaaagtcaaaattttgccacttgagttctggtaatccctggcctgcatattcccatggcagcattcggctgaagcccttgaggtgactggcatgcattctctccagtatgccacaacccacctcccttgcttcacgtatttcttttccctctctggactttgtaggcagttgcccttaccactcttgccctacgaactgtaggggtagaggtggattggaggttgaccatggatagaagaactgtagtctttccccttccctgaactaaagtgaagagtgctcgttttagttagtgcctgtggggaggcaggccctcaggacattgtgttgggtctcccccctcacattttacctttttgtttttaatgcctctgaccttttattaagtataaaggtatcactattgttcaccattgttgtcttgtttattaccatgcatacatactagaatatcatagatattatgaaaaatattcacaatgttattattacatgaggaaagcaagttgcagggtaatgaatattatataatttttttgttgttgtttacggagtcttgctctgtcgcccacgctggagtgcagtggtgcgatcttggctcactgcaacctccgcctcccaggttcaagcaattctactgcctcagcctcccaagtagctgggattacaggcgcctgccaccatgcccagctaatttttgtatttttagtagaaacggggttttaccatgttttccaggctggtctcaaactccttacctcaggtgatctgcccgccccagcctcccaaagtgctgggattacaggcataagccaccacacctggcctgtaatctcattttttaatgtaagatttggtcttttagatcagaagtcagcaaggttttttttggtaatgagccagacagtaaatattttaggctttgttgattccatggtctctgtcacaactagtcaactctgccattgtagcaaaagtagcacagataatatataaatggatgcatgtgcccgtgttccaataaaactttatttacaaaaacaggaaatcaactggcaagtcatagtgtgccaattcctgttttaagtgtttgaggggctgggcatggtggctcatgcctgtaatcctaacatttttaggagtctgaggttgagtggattgcttgagcccaggagttcaagaccagcctgggcaacgtagtgagattctgtctctattaaaaaataaataaataaaaataaagtatttgaggacccaaatctttagtgtctaaggcttaagaaaatacatgttactttaaatagcagaaggtagaaacaaaatgcatatcaaaagattttcattctagttctgctgctttgaatgtgttttctcatggtgaagaattgtctcaagatggccaatctcacatctttgtctctctccatcagacccagggccaggacctcagcacaatttcaccagcaatcatctttgaatcaatgttccagaattcagatgatacggcaattcaggaagatcctcaacagacaggtttgtcacacggactctttctactcacatctaagcacttgctgacacactgagtcacaggcacaatgaatcattctagttagcgtaaatgaagtgagctttctataaagggtcagaaagtttgggtctttcagtttaattccatcttttcccctacttccctcagtcctgaagaagagaatctcctttcccagaatcttctgttggctgtaaaaccaccaaaatggggaggagctgtgagatttttcttctacattttttttttttgagacagcgtctcattttgtcacccagatgggagtgcggtggtgtgatctcagctcaccgcaacctccacctccaggcttgagtgatcctcccacctcagcctcctgagtagctgggaccacaggcacgtgctaccacacccagctaattttttttttttgtatttttggtagagatggggttttgtcatgttgcccaggctgctctgaaactcctgagcttaggcaatccacccgcctcagcctcccaaagttctaagactacaggcgtgagccaccatgcccagccttgtgagctctttcttctgatgtgatacactgtctgtgaatggacaggacccacaaatccacaaacttcagctgcatatatcatactgtgtttcatgaaaatttgtctgtaaaacttcccattagtcagaaagtatagtcactagtcatgtcaaaaaaaggatgtttagtctcttttccagaaaagccttaagacacttttttaaatggttagaactatattgggtcttcacatttaggaagtgaggttgatggtgaaacgtgatactttgaccagaggtgtcactaaatgaaaatgacagaaagctggcctgctagctatgaagagatcagctcagtggacttcagctgtgttttgtttagcccataatgactgtttttgtggctcatctaaggcttgggatatgtatatatatttctatttctttttcttgccagcttccttgactgaaagttttaatggtgatgcagagtcagtcagtgatgttccgccatccacaggaaattcagcatctttatctcttccacttgtactgcaacctggcctctccgagccaccccagcctctactacctgcctcagctccgtctgctcctccgcctgctccctccctaggacctggctcccagcaagctgcatttggcaacccccctgctctcttacaacctccagaagtgcctgttccccacagcacacagtttgctgctaatcatcaagagtttcttccgcacccccaggcaccgcagcccattgtaccaggactttctgttgttgctggggcttctgcatcagcagcggcagtggcatcagctgtggcagcaccagccccaccacaaagtactactgagcccctgccagccatggtccagactctgcccctgggtgccaactctgtcctaactaataatcccacaataaccatcaccccaactcccaacacagctatcctgcagtccagcctagtcatgggagaacagaacttacaatggatattaaatggtgccaccagttctccacaaaaccaagaacaaattgtaagtattatgtatgaatatacccagtggggtgaagtgtatttacataggtgacatgttcagaagcttttacttcaaaaagaaaagtggctgtcatatccaccgtgaaacatgtaattctaccttttagtcattttccacataatcaagtggtataaacgtaggaaatgctgtggtcagtacctatagtaaggaggcagagaaacagtctttatctagcaggaggcactcaaacaaatattcctactgatactggaatctaatcacatcatctagtataaaaaagcagtcagcaaactccagaggtcccagaatattccagaaaaaggttgttttcaaggcagagtcagactgatgtgagggactgatgtgacccagtcagatggcaccggacagcagtggccaagtcagagagctaacttgtgctcccacagcccatcatagaatcattttctgaggaagtacttggtcttgatgactagggaaatgacttggtcattcagttaatgcttcatcgtgaagaattgtctcagggtggccaatctcacaactttgaaagcctaatatttgccagacactatactgagtatctggaggatacagaaaagagaaaaaacatgatttattttttataaaaacatatattctagttaaagaggctaaaaatgccaaaaagaaagttaatattaccagtaggttaaatattaaatactaataatggtaatttaaaaaacatcaacagctattattcattgagtccttactatgtgtaaggacttattgtgctacatattttttaaaattgaggatctgcaatgtgtcagttattacctacgtacattatttttagattacttttttttggactttattgaacagatggtacagagagtttccataaaccctttccccacccctagtttctcctattattattattattattatatattttgaggctctgtcacccaggctagagtgcagtggtgcgatctcagctcactacaacctccacctcttgagctcaagccatcttcccaccttagcttcctaactgggactacaggcacccaccaccatgactggctaattttttgtattttttgtagagacggggtttcgccatgttgcccagactggtcttgaactcctagacccaagcaatctgcctgcctccgtctcccaaagtgctgggactataggcgtgagccatcatgcccagccctcccctattattattattgttttttctccctatcatcttgtttttttcccctattactaacatcttgcaacagtgtggtacattggttacaactgatgaaccagtattgatacattattgttatctaaagtccatagtttagggtccattctttgtgctgtacagttctattggttttgacaaatgcataatgtcatgtatctaccattaagcaatatccagaatagtttcacattttttaaaattccttgtccttcacttattcatcccttctaccacttccctctcccctagcaatcattgatatttttactatctctgtatagctgcagctctatatgtcacacaaaacacattttaacatattacaacaatcctaggaggtaggtctaattttcccaatggagagcagaggtccagagaggttaagtgactggctgaagttcacagagctcacaagtggcaaagctgggatttaagcataagcagattgatcccagagttggtggctcttggccactgcgttgaggggttcagacactaatggtttgttgggtggccatacaggtcaggtcagccttgagatatgggtaggaattagatggagaaaaggatgtactaagttggagaacctagaggtggatgtatgctactattagacacactagaaaggccatttggggctcaacagggagaacactcaaattccagaactagggtgccaaccccgtctagatctagagagcctatgtccatttctagatagctagagtcattggaaagggctttccagtattgtgacccagcccgcctccatgtggtttttattgttttctctggccctgtcctggggtgctgagtgaaacaagtcatccattttcttttcagatatttagggtctcacttctcctttttttttttttttttttttttttttttttttgagtcagagtcttgctctgttgcctaggctggagtgcagtggtgcagttttggctcactgcaacctccgcctcctggcttcaagcgattctcctgcctcagcctcccaagtagctgggactacaggcatgcaccagcacacctggctaatttttgtatttttagtagagacagggtttcaccatgttggccaggctggtctccaactcctgacctcaggtgattcgcccacctcggcctcccaaagtgctgggattacaagcatgagccaccacgcccagcctccattattattttatagtgtcatctgctataacgtagccagaagctttcactttcctcccacactcatcttagaggcaattttaaatttcctttttagcgagataaaagacaaagctgcctcaagataagacttcaagaaagtggaaaccttttagcccatgtaataggaagtatactagagcgaaaagggtgattttctgggcataggtttatagtcctacttagtaataatataaataatgttctggaactcctgacctcaggtgatccgcccgctttggcctcccaaagtgctgggattacaggcgtgagccaccgcgcccggtcttaaataatgaatgtttactgaatgttcaccatgtgccaagtgtcctacgtgcatcatctcatttcatcctcacagaggcctttgaagaggtttttggttattgtcttagtccattttctgttgcttataacagaataccccaaactgggtaattgataaagaaaatacatttatttcttacatttatggaggctgagaagtccgaagttgagaggccacatctggagggccgccctcctggtgtggaccctctgcagagtcctgaggcagcacagggcatcacatggcgaggggttgaacatcctagctcgggcctctcttcctcttcatttttttttttttgttttgacacggagtctcactctgttgtccaggctggagtgcagtggtgcgatctcggctcactgcaacctccgcctcccaggttcacaccattctcttgcctcagcctcccgagtagctgggattacaggcacccgccaccacacccgtctaatttttgtatttttagtagagatggggtttcaccgtattagccaggatggtctcgatctcctgacctcgtgatctgcccgcctcggcctcccatagtgctgggattacaggcgtgagccaccacacctggcctttttttttgagatggagtctcgctctgtcacctaggctggagtgcagtggcgcgatctcggctcactgcaagctccaccacccgggttcacaccattctcctgcctcagcctcccgattagctgggactacaggcgcccgccaccatgcccggctaattttttgtatttttagtagagatggagtttcactatgttagctaggatggtctcgatctcctgacctcgtgattcacccgcctcggcttcccaaagtgctgggattacaggcgtgagccactgcgcctggccttttttaagagagagaatttcactatgttccaggctgggctggccttgaactcctgggctcaggtgatcctccttcagtcttccaaatagctgggactataggcatgtaccaccacaccctccttctcttactcttcttataaagccaccagtcccactcccatgataactcattaatccatgagtgaattaattcattcatgacccagtcacctcttaaaaacccagcctctcaatactgccacactggggattaactttcaacatgagttttggaggggacagatactccatccatagtagttattattcctgtttttacaggtggggaaacaagactcttaagaagttaaatcacatgcccaacaccaacaactaataagtggcagagcttggacttgaatccaagtgtggctgaatccagggcccacccttgaactatgctgtgcaccttacagcacaaggcctttacagggctgtctacctgtgagaggaagccttaacctgtccttggcatgcagcttaatctctgagggggaaaaaaagaactttccagctttcttagaagtactagggggcagcagggaatgtggagagcctgaaggaaagctagccctgggatccctctgagaagacaatctgcttgagaaaagcaaccttggaggaggaggagcctttggatacagaacctactggattaggcagctgggagccagccaactagtggcgtacaaagctaactacgttgtcagcactgaatgtcaaacagtgcagtgacctcatgtcagagcacaaacaaaacatcactcagtacaaaaatccctgaacactaagggttttctgtcttcttggatgaccattacagttggtgaggcttcaggtccctggggatctgccatattacagtggctataaatgagatttctttttcttttttcagcagcaagcatctaaagttgagaaggtgttttttaccactgcagtaccagtagccagtagcccaggtatgtaattccatgttagccttaagagaaggcaactctgtgggtcccttgaggcacagctaattattgctttgtcccagtttctaaaactttaaaaatctttaaacagcctcagttaaattcttcacattgtattgttggctagagtatttcatattctcacaactattagaagttagtatacgtctggccaaaataccgtgtttaacattctttaactagtaacagttctttccctttcagatacagctttaaaatgtagccagaaaaaaatttttgaatcacagctaatgctaaagagggcagttgttaattcactggactcttttctaattacagtaatgaagaaatagcatctgggtcagagacacatatagagctgaaagttccttttattcaaattctttattttatagattaagacactgggacccagaaaaattaattgactcccccaaggttgtaagtgaatctgtggtggaaccaaagcactagttgtcaggcctccccgttcccaccctgttctcctgcccactggcctttgttttgttttgtttttgagacaaggtctcactgtcacccaggctgcagtatggtggcacgatcacagctcactgcagcctgggcctcctgagttcaggcaatcctcttgcctcagccccccaagtagctgggaccataggcatgctccaccaccatgcctggctaattttcttttttttctttctttttttttttttttttgagatggagtcacgttctgttgcccaggctggactgcagtggcgcaatcccggctcactgcaacccctgcctcctaggttcaagtgattctcatgtctcagtctcccaagtagctgggattacaggcattcaacactatgcccagctaatttttgtatttttagtagagacaaggtttcaccatgttggccaggctggtctcaaactcctgacatcaagtgatctgcccaccttggcctcccaaagtgctgggattataggcatgagccaccacgcccggcctaatttttctttattatgtgtagagacagagtctcactatattggccaggctggtctcaaacacctgggctcaagagaatcctcccttctcagtctcccaaagtacagggattacatacaggcatgagccactgcacctcatcctgcccattggtctttagctctgtcaagacacacaaagcctggctgaatatggagcaagtgttcgtacaacacatgagagaaagagagatgagtaagatgtcctaaaggagctcagagtctcctgggcaggcagaaccaagcaggtcctgtaccgcaaggagagaggtgtggaaggaaaacagcagcactgtgcatgtgtgccgggaggctgggtaccggcttcatccaagctagtcctctgcataggcctacagagagtgggggagtgagctaggtcttgaaagatgagtgtcagttctccagaagagaggtgtccagggattttagtcgtaaggaagagcccacaggcccaggggtataaagaacgtgtcaggaaaagtaggcctccacagggagggtgcaatggagaatgactggaaatgaagctggaaatacagggtgcatctagatcgtgtgtgtgactttctaaggaaacgggactttgtctcgggctggggagtgtccctcttttacctcagagggcatgtggtccaatttaaagcagaacgaagcccgaagtgtggcaaccatccttcccatggttcccatggcactctgctctcacctagtccatgtatccctgtccctcatgctcctgcccctgcagctacttgaagagcagtctctcttgcctctctcgcagggagctctgtccagcagattggcctcagtgttcctgtgatcatcatcaaacaagaagaggcatgtcagtgtcagtgtgcatgccgggactctgcaaaggagcgggcatccagcaggagaaagggctgctcctcccccaccccctccagagccgagcccccaggctcctgatgggcccagcctgcagctcccagcgcagactttctcttcagcccctgttcccgggtcatcatcctctaccttgccctcctcctgtgagcaaagccgacaagcagagactccttcagaccctcagacagaaacattaagtgccatggatgtgtcagagtttctatccctccagagcctggacaccccgtccaatctgattcccattgaagcactactgcagggggaggaggagatgggcctcaccagcagcttctccaagtgaagggcccatgtgtgctcacctctgggaaaagcgggtgagcaggaggcatgaggtacaatgcctgccatcatgggtcagaaatttgaaggatgaagaaatctactgtttgaaatcctcacctttcagacgtattttctttattcacatcccaggagcatccattttaaggaactattctttggaaaaaaacaaaaaacaaaaaaaacaacaaaaaaagctaagttataagtgaactgtttggctgcactgtatgtcacttttgcttgttgtcatgtgaacttggaaactaaggttactcgtgtgcataaaaattctaaatgaaagggtgtggtttccatcaatctgatgctgcccatcgcttgcactggggtctttgtggatcgggcaggagttttcagtgtgttgggtgttgctccttcctatgtgtcttttgaatctgaggctgacatttgcttggaaggccagacccttgctccatcagagagggcagtggcaaaggccagtgaggcagctgtgagttggacagggttcaggtgagatggtgttgtcatttgtgcttagtgttggtggtgctcagggtggataacacgggtcgttctgcagcccgcttcagcacaaataggcagcttaaggcctggctcacaggctgtggggttgatctggctctgcagaggccctaggcagcttgttgactgctgtctgttgatgacgtgtgtgcaaagcaggctctagcaacatgatcactgtccttgccttcctggttctttctctcggttggttgccagggcttgcagatcgcagtgaattttccttggggaacatcgctgttttgtcctagagtgaacttgtggcttatggccagtgctgtttggtggtctgccttctttttaatggtattttcttcctcagagcagaagggctgcattttgcttatcagaagaaggtgcagatttaagggaattcatatgaggtggcatgtaattggcaggccaggtgtcctggttccaggttccagccaggctttgggttgccccctccatctctgcccccctctggattttgcatacagcctcatacagtgcaaacaaggatgtgacttgctcagcttagtcatgtgatttatttaaaaaaaaaaaaaaaagaaacacaaaacgatgatcttctactcagggtatagcaaaacaaaaaaattccctttccaccaaaaagcctgaaatgttgcaataagttatctcatttggaatgtttcattaagttgtgttataggaaaaaattgtgtgtgtgtgttatagaattatatccatatgtctgcctttggctccaagtcattgcctcttaaaataaaagatacaatccatactagcatgaaaagtttccctcaacaggctatattaacatagtcatgagtgctgaccaaactcaccgagctcagaggccaggcatggcctgaggtgcagaataggcctctgcctcccaagagccctttccttgccctgagcaaggagtggtgttccacaaacaaggctgctcttctaagccaacagtgtcaggcaggaagcagccataattttgccttgcattttcattccctaatgtaaagggatctgcattggtcactctcctgttctctgagccattgctcagggccagccaagatattattgagaacagataatttaccttggagccagaggccctccctgcctttagcaaggatgttcagggacagacaaagagggcagtggtggtgaatgttgttactgccatgaggagaaatggcagtaagaaatcttaactacaagcagccaatttctcattccaggaccctagccagaataattgacttctttttttttttgagacagagttttgcttttgttgccctggctggagtgcagtggcgcaatcttggctcaccgcaacctccacttcccaggttcaagcaattctgcctcagcctcccgagtagctgggattacaggcatgcgccaccacgcctggctaattttgtatttttagtagagacggggtttctccatgttggtcaggctggtctcgaactcccaacgtcaggtgatcctcccgcctcagtctcccaaagtgctgggattacaggtgtgagccaccatgcctggtctagggaattgacttctttttgaccttctgcactcccttccccaaaaggattgtggcttctgttgaccattgacctcagcagaagttgataaggcaggaggtttccagtcctcctggaaaaccaactgctgagcatgagttgtccttggctgtctctgggcctcgcacccatgggaagttttgaggtagggcccttgctgtttacaacttctgagagagtagtgatgggaccccaaagtaagcttgtatcagagggcagtaatgaccttcccatatccccatcctgtggtcacctgggatttgggttccctggggcggaagtgggaaataggagcccagggaaggacatctgaagcacccacagtttaaatagcgactcttcttggttagccagggctgtgctcatgttgggccctacccaggtcagtggccttttcactctcaaagatcgggggtgacgaagcagcatcttaaacagtgtttaggctgacagatttttccagttgaagaagctgaagtatctgccttttgagggtgactctagattacaagagagactatcagatccaatcagcttttgaaaaatcaggaatgtgcttaaaatgccagtgagtggttgtgaagatcaggtttatttcccaggataggcagtctttctttccctccttttccagttctcttttcctacctgtccttccataagcctggtctctagtgccgaggaccttggagaagagagggcccctagctaagctggagccagaaagaaccttcatggtgagtgtggtttcccaaacttgggaaatgaacctagggtgagg

SEQ ID NO: 12548 - DNA, 9884 bp, Human
tgatagtgaccaaatttttccttgttgtccttctgatgggcgtgaaatggcagctcactgtggcttgaatttgccatttctctcttcactaaacgaggctgagcagttagtgaagttgctgctgaaacaaagaatgaaaggaagccagcgtgaagatctaggagcaagagacgtaggggagaggaggaagagcagcaggtgccaaggtgggaaaggtctgggatgttggaggaacagaaggaaggctgggggtgggatccttgtgcatgggggagggagagaggctcaagccaatgtcagctggggtcagagcagcggggccgagttggctgaggagaggactttggcttttactctgagacaggcgcatgggagggtttgagcagaggagggggtgatctggcctcactttggcttcaagcaaaggatcctgattggagctaaattgacacgggacggggagtattccgcttaatgactgcttactgcctctgtcccccaccctactgcccgctctccagctagaaccaggggaggacgattttgttcacggctgtcacacccggcaccaagtgactaaacagacagtagttctgcccttcaggttggtggtggtggtggtgtggggtgcttataggtttttatagtcttccttcacaggtggaaacaagaacggtgagacctgtgaggtttatttcagagccacccccgggcctggtacgcctcccagggaagctggggtgggggtgcagctgcccctcacttgggcccaccccacatgcattcagtcagggcccctatggagccgtgttacagcctttagacacaggatcgaggatcttcacggggtgaggagacacgcccggcccatgccttctttctcccaccagcctacagggatctttttcaacgaaactctaaccaggtccctcctcagctgaaaatccttcggtggctccccagtgcccttgaggcaaagtccaaactcctacgaggccctggggcccagcacatctgacccctccgggcatgcccatcccaccccatccctggaagctgctctctaggagttactctgaagcagttgccacttcttccctcgggccttttcccttgataattcttcacttcctctgggaagtcaccccgaccccctgtcaggtgacccgcctcttaacggtcgccgcgtcccgtctctcccccaccaaagcacacttccctttgcattgtaattatctgtttacttcgtctgtctccctcactggaccagaagctacccttcgggagaggctctgagtgttctgtccggggctgtgccctggccccaggtacagtgccccacacgtgctgggcgctccgtaaacactggataagggaaggaacgggtgctcttggctagctgggccaggctgctttgcaaaaaggccgtggcatttcaagccgccgagagccacgtgcggtgtccctttcctcgcttcctccccagtgatgtgcgtttccctcgtcaatgccacgctctccaggcgccagccgggcggaggaaatttccgccccctcccaagcccgaggcgggggcgggcgtcggaaggtcaggtgtcccggccggcgcgcagcgccagggggcgtcagaagcgctcagaccaccgggcgctgagccggtgggcgcgcggcgtcctgccggggtcccacctcgcagaggcctcgcttcgctcgacgtcccgccccggacagccccagcaccggggacgacccgcgctgcgccagcgaaccccgcctcggaggagtccccgcccgggctctcaccgccacgcggcgcgagcccggccagcagccggcgcacctgctcggggagtggccttcggcggagacgagcctccgattggcgcggaggtgacaaaggggcgtggcagataaggccccgcccctcccaccccccaccaccccccggagtacttaagggagttggcggcgctgctgcattcattgcgccgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccaggtgcgttggaggggttctgggctccaggaggtttgggggagacaggcgaaggctgcgtggggggcacctgagggaggcggcctgcctgagccaggatcgagtcacaggatgttttgtggaccattgcgggctcgggagaccgggcaagtgggtccccagttccggggatctgtctgggtggttgggggagtgccgtgtagagggcaggggtcttcagcttggggggcctttgtagccggcgagaggcggaggagctccgcaagaggggaaggagaggaggcctgtgtcaggagggccctctggacgctgctggggagagtccggagtccagagggttgaggggaggggtggggagacgagatgtgtgtgaggagggggattggggcagggtggtggctccggggctgggatgatggggttctggcctcaggctggagactggggacttaggagagggagatcaggaaatgacctccttcaactgggggtcctacgtgtgagagactcagattgggtgacctgggcgaggagggcaggaacctggtctgtcctgtggataatttttttgatctaattatgtattgagaatcggccccacccagcccctggccagcggtgggctcatgtttgttgattgagtgaatgatttaattaacgcctgactctgctttttctccctcagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggtacgtgcccctccaggcgcccccaccgttgctctctctggcagcttttgtgaatctgggcttgctgttctcattcccaaagctgtggacactgaggccccgagtcttctaacttctagctcaagttccagggcctggctctctggaaacgtttggcagaaactttcttcatcagctaagcagatgggcaaagcagacaccttcccaatcccctgcagcctgtttctcagccaaatgggtcggagctggatatgggaaaggtgcaaccaacaccttgctgtgggggccaggtgtgaaggggcccacccggccacaccctctcccgggtccgccccctccctagccagacaggatgttgtcagaccccccgcctggctctgaatccttctttgagaactttctcaaaacttaggctgatgtttctcttctgtgagcctcattttctctatctttcagatgggcatgagaacagcttttggggtttctatacaggctaaatgcaggaatgcatatgggaagcacctggcaaagtgccggtacctgctaaactctcacaaaaatggttccttggcatttgctctgcttccttgctgtgtgactttgggcaagcaacttaacctctctgagccttaggggaaaactatgatagcatatgttttagagagtggctgtaaaggtggctaatcactttatagtaatttattatacccgaacggttctcaggtcggcttccccacccccactgaatcctagcacacagaccaggaaacggcatctttggggcagaaaacacaatcacgtcttttgaaaatttactaaatgtgtaaaaaactttctggacatggagaaaaggtagaactttttagaacttgaatggtggcagccactgtgcctggagctgctctttggagagtgacagttgagggagaagattccacagggttcaagctggccaggttctgccatttcctggcctggcgcctgacctctgagcggtgagggttagtgaggtgtctgggaggactggcaattcgcgggctttattggcatcttattcgactaaggctacccatttctcttccttcgtgcaccaattgctctgattttaacatgtaaaggtccaactgcctggcctcctgggtgcctgcccagctcacagggctctattttgggacagttgaacccctcagggtgctgcagtcctgcctgcctctctcacctcccatctggacattattttaatgtaaaggcatggctgagacacagaaatccccttgaaatgtatcattgcggtcctcattgactcccattgtgtgccttaatggtgggcccagtgggtgggggctgggaggggtggagcaggtgcatggggcagcggtgcccagcacctgttccagtcacagctgctggcccactgcatggcaggcccctttaatccggggatatcgcatgtacagtgcccccctcggcgccctttgtccccgccggcctggtgccgatttcacacttgccaggagtaccatgaaggcgtctggggggcgagggatccaaggagtgggggtctgtgcctcctgcgtgtgcacacagcccccgcccccagcccatcatgtcctagaatgtctccttccccttttgtttgggttcaggtctcatcacactttgggcacttactgtacaggagggtagtgctcaggacttcaccaacagccctgggaagggaagggaggtgctgtcctaactctggtcttacaaatggactccagccccttttccagatctccagagtcagcccttagttcacaagggtgaacttacccttctcattcacatgaagacttagaatgcaatcaacaaacccttcaggcgtggcgtgtggaggctgctgagtaatggcagagtggagtagtgctcaggcacccctcccccaatcctctatgtcccccaccctttggagtggcgagtttccatttctgccccatgagactgagtccagctctcaggcgctccataagtccctattgaatgcatgggtcccattggagccatcctctggactctctcctaccctggtagctcagtgtggcaccctaggcacccaggaggtgatggaatgaattcactctcagctcttaaattccatccagcgctgggatttcacaggcgggccctgaccttgcgggcatatcagactgggcgtgaggggattggagaattgcatgttttttaaaaagactattcagtattatggaatagtgtctagcacttagtaggagctcagtagattaaaaaaaaaattatagacagggtcttgctttatcgcctaggcttgtctcaaactcctggcttcaagcaatcctgcctcactcggcctcccagagtgatgggattacaagcgtgagccaccacacccagcctcaatagatttttgtttaatgggttactgttatgaccttttatttggaaaatgctgcatcccccagaaaaaaacaaatcaacattattggtgtttttggaactatatagctttttggttggagcagggattgttatgaggcatgagtgagggggcagactcctctgaggcctctttaatttttaaaacagacttatttattctctaagggcttgttgaggatttactgggcacccagctccatgtgcaagacttttcccaacacagccttggccaggcagatggtgtgtcagggccacaggtttccgtagcctcttgggtgatagaaaggggcccaggccctgggctggggctcagaagggactcaaaggaggcccttgcccttatgggactcagcctgattggagaacagacaaggagatttgggattacagcgcaggaggtggggtggtgaggaaagcaggctgctggccgggccccaggagtggcctaaccagcttggaggtgggggtggggaagcctcttaaggctgactctggctttggcccccaacagagtaaatcaaggaatgactccaggactgatggtaaggacaccagtcacgtcctcccttgactgaaggcagtaagggcagtaggtgaaatcagaggctttggggtcctgccaggggaacctgaacatgctacttctgggcctcagtttcactgtctctgaaatgagaccacagtaggatcaagtgacagtaggatgaatcagtaaaggtgttgagtcattgttgaccacttcgcacgtccctgcgggatgtggatgagtaccctaccttctgtcacttatcaacccctatgagtggggggtgaatagccccattttacaggtgggaaaatggaggctcagagaagccagacaacttgctcagagttgcacagtgggaagcagcagagctccgtcaggtcccggcctttggaccctggctgtgtgtttgacggaggcctggctttcctgggatcatgggattctttcagggtttggggtatgcggggagggattcccatcactgccagccgttgtcccacggctcactcggcctttctggcgttctctccccaggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccgtggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacccccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaagtctttggtgtcatagaggagtgggtattttgaaaggtctttggtaagggaggaggggacaggaattcctgaagcttagatatttctgacacagccttaaatcttgtccttggaaacatcatagggctttggagtcctgggtgtcactgtcagggaccttatgagactgggttttcccgttggcctgggtgtcctgtctgctgctgtttgggtgagccagcggcatccatacgagctcttcactatacactgtggctttttactttctcgttcttgaattttgaagttgatctggcccacggagtgcaaagctggcttcctgggtcttatcaactagacaggctgcaaagctctgccccagcactgcaggtcttttggggtgggattgtccgcttcccccagatgcgagtggaatgcgaccaaggagacagaggatgtccttcctgtttccaagggctccaggcccccttgggcctccttgtcagtcccacacctccgtcttgctgctgggtaccaaatggcctttgatgcgaggaaattggctggctggagccagtagggtgagaagccaggccaaagggtaggggtcactcagcttcctgctccgaggacggcgggacggtcagcatgcgtcttgggctagggtaattcattccccgccagccgatggtggtgacctcaccactgggggcctcttggggccaggagaaaatgagtgtcctttttgaacacaaaaggtgctggaggtgccagtttcctgtgaggagctgaggcgtcccagagcttcggagccccagagtcaggctgggggtggggggagcttcatgttccaaaggagagatgattctttcttctaaacaggaaatggtgacccgcaggccgggagcagcccttaatgacttgcagctttcctcccaaaaggaaaaaaaaaaacgttctctaacaatcgccaaattgtggcctgcctccctgaagggaagttagggagttggggggatgggggttgggcatccatgagctgaaggcctactgtgtcctgggtccctgcgggtccctctaggtcgtctccatccacccacagtaggtgctgaatgaatgatttcatgacttcacataatccctgggggtcgggcctccggaaaatgaggcacagaggtgggcttgcctgaggtcaccaagcccggcccctcaggtcatcctgggagttcggtaggctgggctcatgccgctgactctcagggcacctggagcaaggctctctccctctgggggccccagtttctgtgtctataaaacagggtgacagtagtgccttcctctcggagactgtacagaggcattcattcattcaggggtttcgagggtaccatatgtgccaggccctggggttacacccgtgaacaagacaggccatccctgcgttcatgggacgtatgttctggtcggggagagagaaagcaaacaagtgattaaataaacaagccgcttttctacagtgatggtgccaggacagaatgaaagggtgccaggcactagagaacaacggggtggggctccccaggccaaggcagtgagagccctggaagagctgaattccagcccggacctgaaggaggagaaagatgccggcagggaaggatctgggggagggaatagcaagcctgctggaatgtgctgcccccatgagaaagaccaggatggcggagggactgggaagacagggtgggagaggagagtgggcccagctctgcagagcttgtggtgctaagcaggtgggaattttgtctaagcccctagggcagccactggggctgtaaagcaggagagtgctgaggcctgctgttacctttcctacaaagatctccctggctgcttgggagaatggatctcaggggtccaggaggagaaagacaaaggcagggagaccatgagaaagccagagggggccaggcaccctggctcatgcctgtaatcccagcaatttgggaggcttag

SEQ ID NO: 12549 - DNA, 4270 bp, Human
gggctgcagggaggcaggtagaaaaggcttttgggttttcaggtggggggcagtctagcctgatcagaaaggaggaaaaggccagggccagatgtctgggtggagtgaagggaaaaagtgatcccagaagaaggattagcccctgaaagtccctgaagtaggagaagggtaaaggtgtggttggtgaaggaaagcaggttttcccagattagcaaccagtcagggggaggaaggtgagagtgggagagtcataagtaaattattctgaatgtgtgtagtttaatggaattgggaaaaagatgggggaaatggatggaagggtcttggactctgagacaaggggtctataatcagtccatttcattatttctagcttccaccttcaccaaggcagacaaggagggcccacctcagctcctctgctccccctccctttcccacctattcatgtgtgcaagagtgccctgtcccacagaacacggggaacaaccatctcaatgacaaggacagcaggtggcaaggcctcaacaggactcagatgtccccccagggttaactcatgaaaccctccatgaagcctgctgctcacccctccctcaaggcaagccctgcacctgggtctgaggatgagggtggcagtgaaaattaggccagtgacatcattttcagccagccagtgccaaaaaatatcaggtggtgttcatcaaaaaagctgagccaaccggtgatgaggatggtagtgtgagtcatgtgtgacaggtgaggaatgaaaacagagtgcccgagagcttctatttccttgaggcagggctcattcatcttataaaagccagctggccattgccttcacaccaaacccaagggaccacacagcccattctgctccgtataccaggtaagtctctgattgcaacaaactggcaattctagtgtactttttcattattagaaattagctaaaggcaaatatgtgtaagcaggttaatccagggtttcaatgggagatagagaatagtggaatatctttattttaagttaaattacagtctggatttgaaaggaccttagagatggttagggctcccacctcagtagatagtcattgaactgggagtcctggagaagattgttcaaatgcccatgggaagttcatagcagaactagaactcaggcccagagcactctcagtaacactgcaatttccccctgacaagatatttatagaaattttaatttattagatggatctctactgagcatttattccatttaaggcagtatgctaggcactttggacaaatcaatgcctaacgtacttacttaacaaacataaaacctagcaggaaggtaatacatatatataaataaatgaaatgcaaagtagatagtaattggcatgacggagatgggcagagaagggctgtgcacttttgggagaccttgctcaaggagaccctcctaggggtgtcaagtgatgtgagctatgatggaggggtatttggacaagcagagatgggaagaaaagcatttggaagggactgtgtaagcacagaccagaagcaaaaccatagaggcttagatgaatataaagccatcctataagtcacaggctttctacatggtactaggagaggaaagtggtctgatgccattttccaaaagacctaatatgcggacctcatgtccctcagaagccagctttagtagggcatttttccagaacagatataagttgccttgggtaggaagggagccaagaagagaactccaataaaatggagcagaagaaattgccttttagctcctcctcttcaaagggcctgaaaattatccaagcttatttcatttttaaatgtaatgggggagttaagggagatgaaaggctttctcttctaaagggtcctgaaataaaatctgtttggcattgaatttgtatccatctttctttaattgaatcactgtgtcagctttctgtctctagaaaaaaacacatttgaagcatgaattctcagcagcagaagcagccttgcaccccaccccctcagcctcagcagcagcaggtgaaacaaccttgccagcctccaccccaggaaccatgcatccccaaaaccaaggagccctgccaccccaaggtgcctgagccctgccaccccaaagtgcctgagccctgccagcccaaggttccagagccctgccagcccaaggtgcctgagccctgcccttcaacggtcactccagcaccagcccagcagaagaccaagcagaagtaatgtggtccacagccatgcccttgaggagctggccactggatactgaacaccctactccattctgcttatgaatcccatttgcctattgaccctgcagttagcatgctgtcaccctgaatcataatcgctcctttgcacctctaaaaagatgtcccttaccctcattctggagggctcctgagcctctgcgtaaggctgaacgtctcactgactgagctagtcttcttgttgctcgggtgcatttgaggatggatttggggaaggatcaagtgaaccatccctagtcttccttcaataaataacttttaactccacatctggctgtgcgtcactggttgattcaacctctgttgccttctcagcgtgaagtaggaactaacactgtgaaggctggttgtgaggtctgtagtcagaaggtggccgatcctgacactgagaatgtgtgtgaatgtgtatggctgctgtacacacaggacactcctgggctggaagtgggagtatgttcagggccaccaacccaatctgttactttgggtaggcagagctagagcaaggcttttttcttttaccttaatgtttatatcttaatgacttgcagtgagtcacatgtgagtgtagatggtgcccgcttcaagccatcatcatctttgtttagttgattcctttttaaaaattattccaaagaaacagtgcttgtgcatagtccagcctagtgatctgttctgcactcatcttccttttctgatgcccccaatacatggagccaaggacttgaacactcacaccatacccacaaacacatatttcactcccacacttcccacacagggatatactcgcatgcacagacattcaaacacacacacacatacgtagatctccaaaatcccaacactcacacacacacactccttcacacacttggatctcccaaaccacccaacactgacatacacacacacatgcactttctctctctctctctctctgtctctctctccctctctctaacttaatcaccttagtcctatgttttttcatcgagtgcctgctgtgaagatacctgatgctgcagcaggaagaaggagagttgaatccataccacctgccctagaagaaccctaagagaggtgatcttcagtctccttcccatacaaacataagctctcaaaaaagtacacacatgctcctctctccacacacacatgcatgagcacgcacacactgtacttttgtaagacataaaagttgaatattttatccaataactgccgaatagacacatttgtctcatcagcacataaaatattacagaccacatgttataccacaaacaaatctcaacaaattttaaaaatcaaaaccatatcaaggatattttcttacaacaataaaataaaactagaaatcaataaataataagaaaaactttagaatttttgcaaatatatggaaattaaacaatatgctcctgaatgatcaatgggtcaatgaagaaatgaaaaaaaaatttaaatttaaaaattaaaaattttttgaaacaaataaaaatagaaatacaagataccaaaacctgtaaaacatagcaaaagcaatagtaagaggaaaggggttttttttttagcaataaatgcctacatcaaaaaaagaaaaaaaaaagctttaaatgaagaacttaatatgcataccaaagaactagtaagcaagaacaaaccaaacccccaaaaaaataaagatagagcagaaataaataaaataaaaactaaaaagctttacaaaagattaatgaaacaaaaagtggatttttttgagagaagactcaaataaataaaatcacaattgataaaagagacattacaactgatatcacagaaatgcaaaacatcctaagagactattataaatagcaatacacaaacaaatggaaaacctagaggaaatgaataaattcctgggcacatacaacataccaagattgaaccaagatcaaacagaaacct

SEQ ID NO: 12550 - DNA, 45842 bp, Human
tgaggaaaaaactcagttaagacataagtttcaagttttaagacagagggcacatttctatgtttattcaaaaatccataaatatgggacaatttggccagtttcaacttcaggacattttaaccattgtggactcagtgacctgtgaagtgtacaggccagggaaacttcctctttgccttctgaagtttcactgaaaaatcaactcacaaaaggcagattaattggagaaaaggtattcaattttatttaactatatgtttacacagggagaaccacagagtgattacccacccacaacagggtttagaagcttatttactggtaaatcaggttatgggagaggggaaaagaggaattctgttgaggagatcactagggagaatgaatggatcagggagtagagattaacttgtacattaccttgtgaaagggtttgttcaggaaaggttacattcttagtcttacagggagaggaagaaaaacgaattgttccttttggtgggtctggatcttaggcagataaaggaacttcactttgggagaggtggtagggagtagaggtcagagggaccttgaggcttttccagttcagtatgtcaaagtgccatattttggggtatcagtttctgactcccaacacattctttgtcttctttttttgtaatggatcatgagataacaggtaggggaaaaagaacaattgtcctccttggtgggtccatcctatctttatgtagacaggggaaagtctcttccagagcccgttgatctctaagggtctttacttcaaaatcttcattataccagggagccatatgttggggtggaatttcctgcctccttcaacccccagctccaaatttggaaatggcttctaatttttttaaggaaatgtcttttatttcctttggccactgtgattgatttcacgatggatccatgaaccaagaaaggcaatcaaggctaacaagtttcaatttcaggactactgtttgagctactgagaaagtaaaatctctttttcgttgtttgagctggaaaccttgtcactccaaggacagtcagtaaacacttttcaatgttaagggaactgagagagagagtttcctgagagaacaggaaggcagagagacgaatgagaagtgagaaattggtcctggccatgttattgttcctctagtccagtttaactggtgataagcttaacttgtgataaagatcctagatccctttccagtcctgctgcatccaaatctcccaggaagtcctagaaaatgtctagtctcccctgaagctagccctactgccagaatttgaggaatatgaaccaataaatttccattatagtttaagagaatttaagatagatgtgtgtattagttcattctcacactgctaataaagacaaccaagactgggtaattaacaaagaaaaagagatttaatgggctcacagttccacatggctggggaggcctcacaatcatggcagaaggtgaaagaggagcaaaggcatgtcttacatggcaggaggcaagagagcatgtgcaggggaactgtccttcataaaaccatcagatcttgtgagacttattcactatcacaagagcagcatgggaaaaaaacacccccatgattcaattacctcccactgagtccctcccatgacattggggattgtgggagctacaattcaagatgagatttggttgaggacgcagccaaactatgtcagtctcttatttgccaacaaaagcatcctaactgatagaggccagacagatttgtttctttttgttttttcaatcttttgttgtgaagaagtaagcataaactctcaataggttacgttttacaagcctctgatgaagttcaaaggacaaccatgcttaggatttccaggacaacctggaaaaaaaaacaggttgagaaataggtgtgttaatctcccttccctctgctcctccctctggccttcctttctttgatggaataggccctaggacacctttctaaaaagactccctgtggtgttcagaatcactcctacagtcaggttctccacaatggatctcagtgctgcaagtcaccgcatacctctaagtgatggaaacagcattcccatcatcggacttggtacctactcagaacctaaatcggtaagcttattttttctctctttgcttgcttgtttgtttcttttaacatttgcctatagcataatctgcaatttattttaagcagatctcattgacttactttttgtagtaatggaagcaacctcaatttgtaataatgaaaggactactatttactgaataggtattgagccaaaggttaaactaaatcaattcatgattaaaaattagtttggattagagaaggagaattttctgcttcctttactgaaatttagctaaatgctgattactagagtgaactgagccacatgaaattcgtgtgtttatgacttgtgttttttttatatgagataatttttagttcagtctaacaaacacctagtgaatacttgccatgcactaagcactaggcgatagaagtgtcatatatgaggaaaacaatgtctctgttatctagggattaaaaatcaaatagagggggcagattcttgacaactaattgtagaatgaccaagataaggatcaatgctattctagaactctctgtaaacagtctctgaaagcatatgtattggtccattctcatgctgctattaaagacataccctagagactgggtaatttataaaggaaagaggtttaattgactcagagttcagcatggctggtgatgcctcaagaaacttacaatcatggcagaagggaaagaaaacacgtccttcttcataagatggcagcaaggagaagtgctgagccaaaggggaaaagccccttataaaaccatcaaatgtcatgagaactcactcactatcctgagaacagcatggaagtaaccttccccatgattcaattacctctccctcggtccctcccacaacatgtggggataatgggaactacaattcaagataagatttgggaggggacacagccaaaccatatcagcatagaaatggaaataattaaatttgaccatgaagattgaaatgggcttcctttaaaacatagtaaagtttcagcttatgagaatatctgttccttgttgcagttcaacattaaatgctgattacgagaataaatagtgacatgtgtagaaatgctactgaaatttgagtggtcatgtatgaatgaactatttgaagctgagcatgaatgtaccagacagagaagcacagctaaagcaggacattttggcaatacgaagtatagagacattttagttagacagagaaggatatatgatatatccagtgaatgccaagcccatagtgcctggcacagggagttaatggtgatggcagctgaatctgaaaatgcagattaagacagggattaccaaggaccttgaacaccatgctaaggagttggaactctgtttgtttgtttaaggcagggtcttactctgtcacccaggctggagtgcaatgatgcaatcttggctcactgcaacctctgactcccagactcaagcaatcattctgactcaacctcctgagtagctgggaccacaggcaggtgccaccatgcccagctaatttttgtattttttgtagagaaggggtttcatcatattgcccaggttggtcttgaactcctgggttcaagcgatccgcccgcctcagcctcccaaagtgctggaattataggcgtgagacactatgctcagccaggagttggaacttcgttctatagtaatgagacatcatctaaagtttagaagcaaagaaagagcatcactagatctgtgtttttgaaagataaaactcaggttgtagcatggagaatggaaggcagatgaggagaaataaactacccatagcaagagtagttaaaacttggatcacaatcccacattccacttcaattgcacacctcccttgtttttggtaatgcaatggaaaattactcttggaacaattatatgagtttgatccttggcccctttctcttctttctttgcacaatgtctctttatgatctcattcataatcttggctccaaccacatatatgcagagattctcaaagctatattctctattgtttgttatctctcccccatgtaagtcccttacaggagataactattgttcaaagatgaaagaaatgatgaggaagtctaattatggggtacaagctatggagaaggcatggcctagaaagttaggtgggggaatattccttcctgagtggctctggttgagactgctgtagttgcagcaagttttcagaatctgaatgagccatggggcaaaggagaagtgtagtccaagctcttggtgagtacctaggagaagcctaaaacacccactacattttgcccctgagcaaagggaggtgggggtgcagggctcagaacccatttctcaggaatgtgccatcctttaaacattccttttattttatttattttatttttattagaggcaggtttttgctatgttgcccaggctggtctcaaactcctgggctcaagtgatccacctgccccagcctcccaaaatgctcggattacaggcgtgagccatgacacccggccctaaacattccttactttctctccaatgcccatagaattccccttttctgatcacccagggaactttgtttcacctggggaaaacaaagccttgctcttataccaagtaattttttcagatctggttttaagctgaggacagggtgaaggtctcataagctctacctaaggggaccaggggccaggcagaaagcataaatgagtagtttcagagagttaagtcttttctccattttgtcctacttccccattctgatactagacatgagggcaagcaatgccttattttcctctttatttctacaagaaaaaagaaaaaacacaagcaactaacactcgggggactattattgagaatataatagacatcacactacaagagggtggcagcttgtcctccagtacagccaatcatcatgaataataatccagttgttggccagtcttctaacactttttggagaatgctgtaaagtaattattaatttgtaagcaacagcaactcattcagattttggatgacatctggatggcatgctgtcttgtccaacttgtgtccaatcacaaatgtgccaattacatcttacaatggatttccactgacccacccaaacttacgttgtagtggatcttatataacccagctcataatgggcagctctggccacacagtcacatcatgtcccatggtcagatgtactatctctacaggactcagcagcaatgtcaacaatgtagatggcgtgacttgctccagaaccctacaggcttaccttgtaattctccaactggggcttgccataaactccatgccacatgtaaacaatagggcctgctgggtcatatggcccaagtggcagggatgcttgtggtaaagtctggagttctgctgagcccctccccattctgggcctaatgaaagctggtgtattcatgtcacacagtaaatgggtaggaatagtactgcaagtatggaatatgctgcctctggagcctgagggcgccttttgggtactgtgcttccttcttaatgcttttcctagtatacagccatacctatgactttatcttgaaagaacttccatcagccttccaataatccattttttaaaattcttaatagagacgaggtatctctatgttgcccaggatggtctgaaactcctgaactcaagcaactctcccaccttggccttcaaaattgctgggattataggcatgagccactatgcccagcccaatgatccatgctgactgctttggtttctttaaattatgcaatgcacttgttggctgcctatgtaacttgcctttagggtgggggtgccagatttagcaagtaaaaatataagatgtccaggtaaatttgaacttcagatgaacaatgaataatttttaaatataagtatgttccatcccatttaatatttggaatatgcatatacaaaaaagtcttgcccatttgaatttcaaatgtaactgagcatcctgtatgttgcctgaaaactctagggatttcctgtctaattaaccatctctgcaaagcatcgctgtgggttatgctctttggataccactcattttgataacagtgcccacttcacttctgaagttagtactaccatgtagcctctattattttaaaattccatcattcctagtttttaaaataaggacaggatctcactatgttgcccaggctggtcttgaactcctaggctcaagcaatcctcctgtcttggtctcctgaagtgctgatgttagaggtctgagccaccacacctggcccctaattttttagtaaacctagtttttcaacatctcccacagtctgccttgtctacagaggacagccgtaattgagctcaacaactctggtgtttttgttgctaaagcactgctgtctctttgataaaaggagtgttctctgggccctgctgcaaaacatagatcatccgtggatttccagccttacatagtatatctactatagtgggctcccttctctgagcttcctgagccctcttttgaccatctgccatggtatttctggaatgtctacttcatgtatgtggatgtcactttttccaagatttcaagagttatgctggcagtgtgttagcactgtttcctgaggtgttaagtcacgtatcagaagatggtgtttccatatcaataaactctcctttatccaacttgaaattccaccttcctcttgatgctgcaccccaagatccactctcacacacactctccacctccattgcatggtgtcttggtgtgcagctccctcagtgtatcaccctctttcttcctttatccagccaggagatctcataagggataatatccaaaatataaaaggaactcctaccttttttttttttttttttttttttttttttttttttgagacagactttcgctcttgttgccccggctggagtgcaatggcacgatcgatctcggctcaccaaaacctccacctcccgggttcaccaattctcctgcctcagcctcctgagtagctgggactacaggtgtgcaccacaacacccagctaatttttgtatttttagtagaaatagagtttcaccaagatggccatgcccagctaattctgtatttttagtagagacggggtttctccctgttgatcaggctggtctcgaactgccgacctcaggtgattcacctgcctcggcctcccaaagtgctgggattacaggcatgagacaacaagcccagccaagaactcctaccttttatatttagaaggatatattctaacatgactccatggctgtgaaattagtctccctaccaagtgatattcactggaagccttctcttggaacaactaattattggtctggtgactaggaggcaatatgcaggtagatcctgcctggagcacgtgttccaaggcagcagcttctgcgtcattttcaaaggacacagggaatgctggacattaacctggaggagcagtgctggatcatttctgctgatttaccttcttccttctacctaattccttcttgctatgtccgatatgctactgatgcgtccatttaattttagatatcttatcagatttttgtttgcttgtttgttttgtttatagaattgctgtgtttggttctttcctaaatcttctagggcacttttcatagtttcctgtcctctacagagattttcaagtttatttctttgtttttaaatttaattttcttttttttttattttaatagagatgggggtcttcttctgtcacccaggctggactgcagtggtgcaatcgtagctcactgaagatctcacctcctgggctcaagcaatcctcctgcctctgcctctcgagtagccaggactacagacaggtgtacatcaccatgcctggataattttttaatttttgtttttattttattattttattgtaagacagggtcttactatattgcccaggccagtctcaaacccctagcatcaagcaattctgcatcagccttccaaagtgctgagattataggcatgagccaccatgcccagcctcaagcttatttctttaatcaaaacaatcatagttattttaacttttgactaataattccaatttttcattgtggtattactctgtgactgaattatttcacttagtataatgttctccaggttcatccatgttgtgtactgcagaatttccttcttttttgaggctgaataatattacattgtctatgtaccacattttctttacctgctcatctgtcagtgaacatttaggttgtttccatatcttagctattgtgaataatgctacagtgaacatggaagtgcaaatatttcctcaagatagtgattttatttcctttggatatataccctgaagtaggattgctggatcatatggtagttctatttttaattgtttttcttgaccaacatgttctaatatatctttaatttttttaggaacctccatactgttttccacagtagctgcaccattttacattttcaccaacagtgtacaagagttctaatttctctacatcctcaccaataattgttacctttcagttttttgataatagtcatcctaatgggtgtgaggtgttatttcattgtagttttgatttgcatttcccagatgaatagtgatattgatatttatatacctattggccatttgtatgtcttctttggagaaatgtctactcaagtcctttgtcaactttttaatcaggttaggtttttctttggggttttttgttttgttttgttttgtttgtttttgcttctttgctattgagttgtagaagttccttttaattatatcttggatattaaccccttgtgagatatacggtttgcaaatattttcttctattccataagttgccttttaactctgttgagtgtttccttttctgtgcagaggctttttagcttgatgtagtaccaacaacctatttttgcttttgtttcttatgcttttggtgtcatatccaagaaatcatcacctatcccaatgtcatgatgctttttcccttatgtttccttctaggagctttacagtttctggtcttaaaaatctttaatccattttgagttgactttttgtgtatggtgtaagatacaggtccaatttcactctgatgacagttccaatattaggatctatggttctgtttaggctctcagttgtttctaccagtcttcctttatggaactttgttttctggggtacctgaattcttcagctgtgtgcaggttaatactacttttaaaaaagtatttgtgagcgagcatcaagggtgaaaaacaagtattttctttcagacaacatttgtgtgtgtttgctccaggttccctggaggcattgctacccagtgacgatgtgaaactggtcagcagactccagctacataggttatgaattctcccagggactggaggtggccatagcctgttagggagtttttttactttcctttttcatctcctacacctctcatttctgcattcagactttcccataaaatgtagtttgaattaataaatgcctactgtcttttcagtacttttatggtaatcttttcaaaagttttaatctagcttttttttttttttttctttttttgagacagggtcttgctccaacacccaggctgaagcgcagtggcatgattacggctccctgcaaattctgcctcccaggctcaagcgagtcaccagacccggctaatttctgtattttttatagagatggggttttgccatgttgcccaggctgttctcaaactcctgggctcaagcgatcctcctacctcagcctcccaaagcgctgggattacaggtgtgtgccactgcgccagcataatccagcatttttaattttcttaagtagaaggagatgctgtcagccattttaggaaaccagattttttgttttactgttcagtgagattgtctttaattgtggaatcaaatttttatattttagattctcctatcatatcatttatgtggtatcctatttgatctttccgatttttttcaaaactggttttcctaaaaaatgtgtcacaatttatgtagaatttttttgtgccacatttaagaattacaaagtgtgggccgggtgcagtggctcacgcctgtaatcccaacactttgggaggctgaggcgggcagatcacaaggtcaagagatcgagaccatcctggccaacatggtgaaaccccgtctctactgaaaatacaaaaattagctgggcttggtggcacacacctgcagtcccagctgctcggaaggctgaggtaggagaatcgcttgaacccgggaggcagaggtagcagtgagctgagatcatgccactgcactccagcctggtgacagagtgagactccgtctcaaaaaaaaaaaaaaaaaaaaaagaattacaaagtgtggtcctcatgtccacagtcccaactagttcctccatactgatgagaattaagtacaaaatagtaatacatctcactgctgcttctgccttctgagggacaatatttttcagcaagtatataaatataaacatataaataaataagtaaatagtagatatccagtaagtaaatatccagcttttagaagagactccctggtgatagctgaataattgaagattttcactactataacttgcttctgtgccataatccttattaaatgagtcatcatccaaatatacagcaccatggtggactacactcctaccttagcccttgcctttgccactttctttctttttcttttctttcctttttttttttttttttgagacagagtcttgctctgtcactcaggctggagtgcagtggcatgatctcagctcactgcaacctctgcctcccaggttcaagagattcccctgcctcagcctcccaagtagctgggattacaggtgtctaccaccacgcctggctacattttgtattttttagtagaaatggggtttcaccatgttggccaggctggtcttgaactcctgacctcaggtgatctgccccgcctgggcctccgaaagtgctgggattacaggtgtgagccaccatccccagctgtactttctttatcctaaatgctctcctctgtacttcattttttgggttaatcttcaaaaatacaagcacctactttaatacgcatttgtctggggctcccttcattgtgtactttagctcttcatttaaatgatcagttccagcccataaaatctcagtgatgtttctgagattctatttaccatctagtattaagcttcatatattaataatatgtagagggaggccaaggcaggaggatcacttgagcccaagagtttgagaccagcatgggcaacatggcaaaaccccatctctacaaaaatgtatgccaggcatggtggcacacgcctgtagtcccacttactcgggaggctgaggtggaagaatcacttgaatctgggaagccgaggctgcagtgagccataatcgtgccattgcactccagcctgggtgacggagaccctgtctctaataataataatgataataatgtagatacttgagaatgaaagtagatgtttattttcttccctgtaaatttctggacaccacgcctcacctccccttcccactgtactttggttgtcacacttgtcattcataacatctcattttacaggcttttttctggccttttgactcaattactgtccaagtcctattaatcatgttgttatttaattaaccaaacaaatatttctaatgttgctgaaatgtgtgtctccttttcccagctatttgatatttgtgactatgaatcttataatatcatctatgtagccagtttgttcatttttcgtatcctcttatcttctctatagtgatgacttccaactgtagcagggggaaaaaatacaatatatgtccccaaggctttctatatcctgcccaggactataaaatcactagaaatacatttcagatttattctctcgctcagcctacaacaaatcaataggtgtggaccagagttcacatgtctgatgtgatttgtccagcatttggttagaacactaaagaaagcacaagtagttaaccaacatttgttgagcaagatcagaacaatcaccctttgatatgaagtcagcacaaatcagaaaatagaatcaaccctctcacacacacacgctctaaaagatgctttgaaaattatatttgatgagactagatgtttgtcttcagagaaatctcattgctgtttctcattaagaaaaaatgtaactaaaagaaacacattcgtatatttaaatgccatcataactgaggcatagggaattatgtggaatctgaaaaatggtgtcttactctattttgtgctgctgtaacagaatgcctgagactggataactgataaagaacagaggtttattctcttacagttctggaggccgcaaagtccaagatcaagatgccggcaggttagggcccagtctctcacttccaagggtgtaccttgattgctgcattctctggagaggagaaacactattactcacatgacagaagagggagcacccactctcacaagccctttttatggtgacattaatcctaaacacctcccattaggccctacctcccaacactgtttgtcaaattggagattaggtttcaacatgagttttggaggggacaaaaataatcaaaccatagcaaatgaaaaatcagtgttcagggaacaggatatgctcattcttatgtttaacgtgagttaataaaatgaacaaacctgtagctaccaaatgttattaaaatatatcctaaaacataaaatgttcctcaacaatattttttcctcagtttcattgagatataactgacatataataaactgtccatatttaaagtatacaatttgaagagtatgacatatatacatctgtgaggccatcaccacaatcaaaataatgaacatatctatcaactctataagcttcctcatgccactttgtaatccctccttccacccatacttcccccaactcctgaccccaggcaatcactgatctatgtctgtcaccacagactatgattccatttatataaaatgctagaagagaaaaactaaagtatttattctttttggtccggcttctttcactcagtataattattttgagattcatccatactatgtgttgtcatcaatgctacatttcttttctttttttttttttttgagacagggtctgtctatgttgcccagtctggagtacagtggcatgatcatgactcactgcagccttcaactcccaggctcaagcaatccccctaccttaccctcccaagtaactgggaccacaggcgcatgccaccacatccagctaattactttactttttgtacagatggggtctccctgtgttgcccaggctggtctcaaactcctggcctcaagcaatcctcctgcctcagcctcccaaagtcctgggattacaggtgtgagccaccacaccaggcccacttcattcctttttattactgaggagtattccattctgtggatacatctcaatttgtttacccaaccttttgatttataatttagccttcttcaatcagcttgtgccctcctgtaaaaaggcttccatgaattctcttgtcacaggaaatattgatcaaatcacatttttgatgccacgaagctgagggcagacctgggacagatggtgtctcccactgagggagcggaggcccctgggaggtcagtttctcctgctgctgaacaccatcttccaatcacaacagcaaggaattgggaatgtgtcattttagctgtaaaggaatgtacatgcaaaatgtcctgattaatgattattaaaggaaagaccatttctcttttccccaaacccaacctctttgtcacttcagacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaaggtgagatcttgccttcagcctccactggggacagtgagaaggtttcagttgttcattttattattcatcttccgtgtgtgtgtgtgtgtaattgcactcatgagtaggcagtacttaataacagtttgggtttgtttgtttgtttgtttgtttgaaagataagtgttcaaatgagaccaaaatcatgcaaaataggattttcaacattcttgtatcatattaacgaattatttattagtttgggagaagtaagcagagtagcatttaggggagagaaagagggttttaaaaatgtatttggctgggtgcggtgtctcacgcctctaatccgcacttcgggaggccgaggcaggtgttttgcttgagctcaggagttcaagaccaacctgggtaacatggcaaaaccttgtctctacaaaaaaaaatacaaaaattagccaggcatggtaacttgcacctgtagtcccagatacttgggaggctgaggcaggaggatggcttgagccagggaggtcaaagctgcaatgagtcatgttcatatcactgcactccaacctgagtgacacagcgagaccctctctcaaaaaaaaaaaagcatttgagcaaatgtaattaactcagacatggtattcagattttgtttaataaaagcaaacaaacgtaaattaaaaaaaaaaaaaaacaagctcataaggtcaccaatccaaaagccagctatgtaggcttcctgggcaggcacattatgcaagccttttgcttaatgactcatattataggagtcatttcttactatgatagaggctaaagttagcatacaaggaaaaggtggtcaaaacatgctttaaattgtcctttaactttaatcctttaaattgtccaaaaagtacagttgtgaatagaaagcaatatttatacgtatacaatgtcaatatgggctgtatgtaataaagcatacttgggcgaaatattggtgtttacttacgtaaacagaaacagtgtgtgcagctgagttcatgtaatgtgccattgctattgcctcatcaggactgtcttcactgcagctcagcagcacctgagaggcaatgtgggggtgattaagagcctagactggtgcaaggttgcccaggtcagaggcccagatctgtcactattggctgagttgcctagcatttctggacctcaattttttttctctgtaaaatggggataataatgtcaactatttcataaagttgttatgagttcacatttacaaagcactcacaccgaacctggcacaaagctaatactatgtatgtttgttgaataaaagtaaattaaaatatcatcagcctatgcccaggaatgaaaaagaaagtaaaataaatatcaaacagaatttccacttagatgggattgcaataggaacaccaaagagacccagagtagcaatcaaaacacacgtaacacatttttccactactctcttcatgttaaattttctctgtgtttttaaggcaagaaaaaaatcattgtccaacagaggaaaaaatcagatattaccaattttgcttaccctttcttgtgaccaaaaaaagtatgattcaggccgggtgcagtggctcaagcctgtaatcccagcactttggaaggcagaggaggaaggatcacttgaggtcagaagttcgagaccagactggccaacatggtgaaaccccatctctactaaaaatacaaaaattagccaggcgtggtagcaggtgcctgtaatcccagctacttgggaggctgaggcagcagaatcgcttgaacccgggaggcagaggttgcactaagccaagatcaagccactgcgctccagcctcagcaacacagcaagaccccgtctcaaaaaaaaaaaaaaaagaaaaaagaaaagtatgattctaaacttatatccccccaaaaaaatctgtgagcaaaactgatattccaaaagatgtactaatttgtcctgtgggtataagcaaccttggcaccgtatgtctcagacacttaagggtacacatgctccagtaggatcaaccaaaccttgatccttcattatgtaatgccttagcgaaagagtaatttaattgctctggggtctaagtaggaccaaataagaacaaaagatcagtgaaagcaaatctaaatctatgcactaatttaaaatttcaccaggctttcacaccacctgtcacaatgtgaaggacccagtgaagccacacgcataaccatattccttgctcattttatcagagtggcatgacaataaagtatcacgctaggtcaggacatctagaacattgtgtaaccctagttatacaatgaggaaaaatgcaagcactaagcatcaggaaattcacccggaaatggggaagactgccatcaaattaggtactctgtggtcaaggaggatctgtaagtctcttgtggtagatttgcataaaattatgtctggagatgtgagggtgatctggctgtaacatatgtcaccccattagtcaccagggctaattcagctgatctggctgtctaggcaattgtacctcttgaagctgcactctcagtggaagaggacggctttccctgatgaaggaggagggtttttaggtcaagtgtatgtgagtagctgcactcccctactagaacctccaaacaagctctcaagctaggctctgagtgtcaagagttttatcagctcatcctatactcagatgacactgcatcataaacatatttttgtgaaatgaaatgtgtgaataaaatgtgtacaagcggctaggcacggtggctgatgcttataatcccagcactttgggaggctgaagtgggcagatcgcttgagcccaggagttaaagaccagcctgggcaacatagtgagaccccccatctcaaaaaaaaaaaatgtgtacgagtgttttacaaagaaaaaggggctgccttatcgtaaaaagcgtgtagacattagttaattctccctctttgattctttcagctatgggctacaaatcatgtcccagagatggtccgcccaaccctggagaggacactcagggtcctccagctagattatgtggatctttacatcattgaagtacccatggcctttaaggtgagttcagatgcccaaaggtcaggtctctgcaccctggcaaccatgagccaatagctatgtgcatgaagctctgcaccatgagccaatagctatgtgcatgaagctctgcaccatgagccaatagctatgtgcatgaagctctgcaccatgagccaatagctatgtgcatgaagctagcgtattacttggcaccacagaatattgtggtgttttgttaccacagatcagagagtactgacctagtctgacaaatacccgagaagattatgttagcagactcaggcttggtttccaagtttcttgattttttaattcaatgcaatttctattataccatgtttttacaactatagtttaagctctctgcatcaaaccaacatgtagtcctctaactgtagcccaccattgagacacacacccttcttcccactcacacagtcacaatctccgccctcatcctcactttgttaatgctgactcttgttcaaatgtcagatttctaacctaagtcttaaaaatttagaaagacccagtgtacaattatgtgttgcttagcaatgggatacattctgagaaatgtgtcatgaggtgactttgttgttctgcaaacatcatatagagtgtacttacacaaaccgaggtggtaaggttttatttaccatggtagactgcattacttttgtaataacatgaataaaacgcaaacacgttgtgcctaaatggtatagcctattacagacttaggctagatagcccagccgattgctcctaggctataaacctgcacagcatgttactattctgaatactgtagacgatggtaacacaatggtaaatatttgtgtatataaacataacatagaaaaggtacagtaaaaatatggcataaaagataagatacacctatacctggcacttaccatgaatggagcttgcaggataaaaattggatgagtcacggagtaagtggtgagtgaatgtgaaggcctaggtcattactgtacatgactggagactttataaacactgcacacttagggtacacaatgaatcacataatattttttcttcaataataaattaacattagcttattgtaactgttttcagcttataaatgttttaattttttaactttttgattctttgtaataatacttagtagtaacactaatactaattacttttttttttttttttgagacagagtctcgctctgttgccaggctgaagtgcagtggtgccatctcggctcactgcaacttccgcctcccgggttcaagcgattctcctgcctcagcctcccaagtagccgggactacaggcaagcaccatcacacccggctaagttttgtatttttagtagagacagggtttcaccatgttggccaggatggtctcgatctcctgacctcatgatccgcccacctcggcctcccaaagtgttgggattaattacttttttaataacatgaataaaacacaaacatgttgtacagctgtataaaaatattctttctttgtattcttattgtataagctcttgtctattaaatttttttttaaacttttttgttaaaaactaagacacaagcacacacattagtctaggcctacacagggtcagcatcatcaatatcagtgtcttccacgtccacatctcgtcccactggaggttcttccggagcaataacacgcatggagctgccatctcctgtgacaacagtgtcttcttctggaatccctcctgaaagacctgcctggcgtttttttacacttaacattttttaaaagtagaaggagaacattctaaaattatgataaagtgtagtagaacaaatatataagttgtatccatagtaaaaacagaaattgtttactatcattatcaagtattatatactatacatgattatgtgtgttctacttttatatacctggcagcacagttggtttgtttacaccagcaacaccacaaacatgatgtcactaggtgataggaattttaaactctattataatcttatgggccaccatcatacatgcagtccaccattgaccaaaatgtcattatgcagcacatgactctacttaaaagtgagaaaataaaatttacttctctgtgactaactaatgacatttacatctttttggacttgatagataatttctattcttatttttgatgggttcaaaggcacaaaaggtaaaattttaacagtgagaaatgacacaatatagtgacattaccttccaactgaacctataattgggaaatcaatatttgaagcttaagtacgacatgttttttggtgtttgtttgtttgtttgcttaaggtagggtcagccggggacagtggctcacatctgtagtcccagtactttgggaggctaaggctggcagatcacttgagtccaggagtttgagacaagcctgggcaacatggcaaaaccccatctctacaaaaaatacaaaaattagccaggcttggtggcatgtgcctgtggtctcagctacttgggagactaaggtgggaggatcacttgagctggggaggtggagggtgcagtgagccaagattgcgccactgcactccagcctgggtgacagagcaagaccctgtcttggaaaaaaaaagaaaaaagagtgggggggcagtcttgctctgtcacccaggctggactgcagtggtgtgtggctcactgtagccttgagatcctaggctcaagcaatcctcctgcctcagcctcccaagtagctgagactacaggtgtgtgccaccacactcacctaatttttcaatttttcttttgtagagacagggtctcgctatgttgaccatgctggtctggaactcctggcctcaagccattctcccacttcagcctcccaaagtgctgggattacaggcatgagccaccatacctgacttcacatgctttttgaatcttaagtttttttaaacaaaaaatcttttttgctaaaatatttttagcactttattattttttaagtgtcaagcagacagaattttagccaacaaaatattaaaaattatgacatgtttaaaagataaatgaacaagaatgagagtcaatagcatagatttttaaagggttgggttattcttccaataatacctgactgtgaggaagaggaatgaaggaaagagacaaagaggcttatcgggatgaaaggatgagtaaaataggcacaatggaaggtcaagggaaacacctagaggtatctaatgtgggttcaggcttgataaccacctgattagaatctgggaaagtaaaaatcacgtaacagaattcatgatggaggcataaggccattcagaaggtaagtaaaattaggaaacacaaggtaagaaatatggagcagaaatgtgggtcataagtgttgagaaattcaaagtgcttagaaatcagagacagaatggataattaacatgaataataatgtggcatcaaggagaaaagggactgttccctgctctcagggagatgggaggaagttgaaaagacattgtctttccctaaagcagacaatggggaaaatgttttccataaaggaaaactgagtttcacaaaggtgaaatgctagaggaaaaaattaaaatttttgttttgttttgttttgttttgttttgagatggagtcttgctcttgttgcccagactggagtgcagtggcatgatctcggctcactgcaatctccgcctcccgggttcaagcgattctcttgcctcagcctgctgagtagctgggattacaggcgcccgccatcatgcccggctaatttttgtatttttagtagagacagggttttgccatgttggccaggctggtctcgaactcctgacctcagctgatcggcccaccttggcctcccaaaatactgggattataggtgtgagccactgcgcctggccaaattaggaacaaatttaagagcataatggattttgtccaattgcttgattcccttctcagtctgttttgtgctgctataaaagcatgcctgaggcctggtgcagtggctcacacctgtattcccagcaatttgggaggccaaggcaggtggatcacttgagcctaggagttcgagaccagcctggacagcatggtgaaacctggtctctacaaaaaaaatacaaaaaaattagctaggtgtggtggtgcacacctgtagtcccagctgctcaggaggttgagatgggaggatcacctgagcctggggacatcgaggctacagtgagccataatcatgccaccgcactccagcctggacagcagagtaagaccttgtctcaaaaacaaacaaacaacaacaacggaaaaagaatgctatcattcagaaacatttcctttaaaagaaaaaaaaaagaatgcctgacactgggtaatagataataaacagaaatgtattggctcaaagttctagaagctggagagttcaagaccaaagtaccagcacctcactagagccttcttgctatgtcatcacatgctggaacgaggaagggcaaagagcacaagaaagcacccctcctcgtctgagccctttttacaatggcattaatccacgactgaacaactcccattaggccccacctcccaacacagttgcactggggattaagtttccaacacatgaattaggggggacacatttaaaccacagcaattcccaataagaaaatccctattaccaaagtcaacaaagactttcatcctgccaaattcaatagacattttgtcttcctattatttgatctctttcaatacagttgactaccaccttcttctgtaaacattttcttctcatggtgttcgtgacatctcatgaccctctcatggtctttggcagcttcttctctgccagcttccaaatgttgttatgcccagtcctctaccctcaatattcttgtcttactagctacactctctctataggtgacttaatccaatcatgtggatttaataccattttacatgctaatgactccaaattttatctgtagccatgacctctctctgagctcttgacttctctgttcaactgcctccctcaatatccacttgaatgtctagtgaccatttcaaagtcaaaatatccaaaatgatattctggattcctagccccaacctcaagaaatggttaccaccaaccacccaaggcatctgggatcatctttgatttctccctctccctcattcccaccaccccacctcatttccaagccaacattaaggcatgctggctctactactcattcatgtgctaatctgttcccttcttttcctctctactgcagttgccccagtcccagacaccatcagctctcccctattgcatacagcccgttaggttgatttccccagaagcagaccctgagatgaagagaatgcatacaagagtgatttatttcgaagtactgttaagggagtggggaaatgtggctgaaaaataagaggttaagcagatgtgaggtagaaatcagagtcctacagagagcaacttaggctaaatgtcacagaaagctctggagacaaagttgttcacatctcagaattacacagtcacaaggcaaagaaacaaatattgatacttgtaactttagttcaaaggctgtcccagcagggggagcagggtgtaaattcctgggcacatctaattgagtagatacacaagtcccagtagcctgaggtctgtcctctaacagatgcaggtgtcagctgtacagagtgagaggacagtgcacacaagacaggtactggcatcccaggaagcatgggcaggtgtcttaatccagctgggccgctatgacaaaatactttagactgggtgatttagaaacaatagacattgattgctcacaattatgaagactgggaagtctaaattctattatttaattcccagatataaataaaatgaattacatttattctttttttttttttttcagccaggagatgaaatataccctagagatgagaatggcaaatggttatatcacaagtcaaatctgtgtgccacttgggaggtaagttcaaatgtgcttcttattttaaaagacgatatttttaaaactgtgatctgattattcctgtcatatttatggagagagatgcaccctttactttcaatgaaaagtaacagtcagaacaggcattcctaaccataagtacaggtatatgaaatctccacttctgggtactaaataattcttacttttgttttgctggaatgccaaagaaaagagagaggggtggaaggaaaaacagtgtaaacaaaatatgttctaatataaaagtaattaaaatatatgaataagataaattcacaaatcaaaaaatatatatcaagttgttaatatgatgcctacaagaaacaaacttaaaatgatacataaaaaaactgaaaaacaggccagtcgcagtggctcacacttgtaatcccagcactttggaaggccaaggtgggcggatcatctgaggtcaggagttcgaaaccagcctggccaatgtggtgaaactctgtctctactaaaaataaaaaaattagccaggcgtggtggtgggcgcctataatcccggctactcaggaggctgaggcaggagaattgcttgaacctgggaggcagaggttgcagtgagccgagatcatgccactgcactccagcctgggcgacagagcaagatgccgtctcaaaaacaggaacaacaacaaaaacctgaaaagcaattctgttttttatttctgggaaagctgctggctcttttcccaagatcacaagagtagacaactataggaaaataataaataaacccttatggattcgtggtggggagggatattttgaacttgtttgcttagaggtggtgtggcagctccgacctagagtagaagtcaacccaacaagcaggaagaagataatacaggagaggatcggttggtccttttgcacttccttcacccctgccatagcctgggaacaaatgttgccgcacaggtggaaactcaggactcagttgtagagcagccttgagattctgaacttgtgaaaaactgaggaaaaacataagttacccactgacctctggcagtttttttttcccaccgatgtgattccaaactccaaaagtttggaaattacactctggtaagtacctctttctatatacttgcctgtgaggcaacagctgaaggtctgagctgtggagttgtttcgaggggcgaggaggaatgatttatttcccagtgcccggggctctgtccaaaagaacacgcagtcactcccgacctcattggagggaatcaggtttggacagttggacattttgaacattctgttctaagggactgcctaacaggatagccagtatccccaggaaaaaatgatttcacagcccaaagtaataaggcatttgtttcacaagaagacaatacatctcaattactgatccaatgtaaacagaacagagaaccaggaacttctaaattaaccaattaatatattagagaacataagaaaagatattagcaatataaaacgtgaacaaacaacattttaaaaaacaagctaaaataaaaattaaaaaataaaaacacaatgcaattggttgggataaatagaagaaaatggtcaaattgagatatcagaatgaggaaatctctcaatatgaagaagaaaaggacaagaattttttaaaatatgaaagaaaagctaagaaattcaaagaataaaattagaaattccaatatccacacaactggactctaagaaaaaagaaagaagaaaaaataaaaggaaacaagaaggtgggcatagtggctcatgcctgtaatcccaatgctttgggaggctgaggctggaggatcacttgagcacaggagttcaagaccatcctgggaaacatagtgagacacccatctctacaaaaaagaaaaaaaaaggggggtaatagttaaagaaaaaaaaaaacacgaagatcttaaagggaccatggagcacaaaagaggaaagatgaggaatatcacgggtgaggtgacctgtagtcccagctacttggaattctgaggtgggaggaccacttgaggccaagagttcaaggccacagtgtgctatagtcatgcctttgaacagccactgaactctaacctgggcaatatagcgagatttcatctcaaaaaaaaaaaaaaaaaaaaaaaaaaaaaacataaagagaaaatgttaaaacttccagagcataataaataatccaataaagaaggcaaaatggaataacaaaaataatcaatccaagacaaagcagaaaaaaaaagaaaaggggcaataaacagatgagaaaagtagcaaataaagggcaagatgggagatttaaactcactaatatcaataattgcagtatatataaatggtctaagcaccccaattaaaaggcatagattatcagaatggatataaaccaagtcccactatacattatacacaagaaatccatcttaaataaaaagtcaccaacaggttaaaagcaaaagtctttcaaaaagcaaaaggatagaaaaagatatattaggctaacactagtaaaaataaagctgcagtcgctattttaatatcaacaaatacttcagagcaatgagtattacatgggataaagaagattattatataatgataaaggagtcaatcctaaacatctatgcccctaataacagagcttcaaaatacatgaagcatcatctaagagaaccgaacagagaaagagaaaaatccacatttatagtcagagattctttttttttttttttttttttttgaggcggagtctcgctctgccgcccaggctggagtgcagtggcgcgatctcagctcactgcaagctccacctcccaggttcacgccattctcttgcctcagcctcccgagtagctgggactataggtgcccgccaccacgcctggctaattttttgtacttttagtagagacggggtttcactgtgttagccaggatggtcttgatctcctgaccttgtgatccaccctcctccgcctctcaaagtgctgagattataggcatgagccaacgcgcccggcctatagtcagagattctattaaaatgatatcatactaaaatgataagtatacagaaagagctataggatataggagatttaaacattatcaaccttcttaacctgacatttatagaacacttcaccaaaatataagagtgttttctcttccctccctccctccctccctccctcccttccttccttccttccttccttccttccacgagtctcgctctgtagcccaggctggagtgcagtggcgcaatctcagctcactgcaacctccgcctctcgggttcaatcgattctcctgcctcagcctcctgagtagctgggattagaggctcacgccaccatgcccagctaatttttgtatttttagtagacatggggtttcaccatgttggtcaggctggtctcgaactcctgacctcgtgatcaacatgccttggcctttcaaagtgctgggattacagatgtgagccaccgcgcccggcaacataggccatttttcgagccataacataaatctcaataattcttcaagtattttaattatgcaaggtatgttgtctgatcaaacaggaggcacacatgtaaataacccataagacctaaaaaaattaaaatctttatctagatgtaatttatatattagcaacacacaattggaaattatttttaaaaacaatgctaaacattaaatatttaaagataaatctaaaagaatctgtgcaagagctatacagtaaaaacaacttattactgaaagaaataaaagatgatccaaaattcaatggagagatataccatgttccttgatcagaatatcaagatgttaattttccccaaattcatctgtagattcaatgtaatcccagtcaaaatcccaatagaaatggaaaacctacttctaaaatttatatggggcctggagcagtggattatgcctataaatcccagcactttgggaggccatggcaggtggatcacatgaggccaggagttcgagaccagcctgggcaacatggcaaaaccctgtctctactaaaaacacaaaaattagccaggcatagtggcgcccatctataatcccagctacttgaaaggctgcagcatgagaatcacttgaacctgagaggcggaggttgcagtgagccgagatcccaccactgcactccagcctgggtgacagagtgagattctgtctcaaaaaaataaaataaaatttatatggaagtacaaataacctataatagccacaacaactttttgaaaaagagcaatagccaagcacagtggctcatacctataatcccagcactttgagaggctgagtggggagaattacttgagcctaggagttcaagaccagcatggggaacactgagaccccgtctctacaaaaacatcaaacaattagtcgtgcatgggagttgcatgtgcctgtggtcccagctactcaggaggctgaggtaggaggatcacttgacctggtaggttgaggctgcagtgagctataccactgcaacccagcctcagtgacagagcaagactccatctcaaaaataaaaagcaataagtttggagggcttatactaatttcaagaattattatacaactattagaatcatgacagtgccatattagcataaagaggaacatatagatcaataaaacataatagagaatgttaaaatagacccatacacatatatggtcagttgattttcaacagaaatgccaacgcaattcaatggggaagggtaatcttgtactacaactggcccataccagcttgcaagaacccgttgtgcaaacctcttcctaactccacattcagtgatgtcgggttgttagcttgaatagcccggtgtgaatagttacatcacagacattctcaaatactacaaactggggagcttttttcttcctggatagctggttgttaaacatttatcagtattccactggaggtgttcatgatcttgattgtaatgatgattttacaggtgtatgcacacattaaaattcctcaaaatgtacacttcaaaaatgtgtagtttattgtacatcagttataactcaccaaactagaaggcaaaaataatgcatgataaaaagttgcacatctacacatgctcagaaattttgccacataaagactcacactggaaatcattaggtccgattgatgtactaagtgaaaggaacaaaaatctaacagatgctccaaaaaaaatgcataaagcaaaagtgatcaaattaaacttaaagtgtgtattatctataaaaatattaagatcaaataataaaaggaaaatgaacccataatacgctacaattaaagtttatatatatactattagcatcacagatgttgagggtagataaataccgtgtgaacatgctaagttattgtctttattagaaaacttcttaaaagtaataaagagttaagaagaaacaggataagtgggataaattgaaataaatcaagatggtagaaacagttcaaatatatgtatggttgcaataaatgtagataaaataaactcacctagacagagattgacaatttaaaaggaggcacctaagcaaaaagacatgtgaaagttaaaactttacaggtaaaaaaaaacacacactcaccaaataccggaaaaagttggtattactatattaatatcatataacacagacttaaaaattaaaagcattattagggataaaaagagttgtgcgtgaagatgaaagattgaatttaccaaaaagatatactaattttaagcacatatatatcaaataaagtatcttcaaaatatataaaacaaaaaattgacagaatacaggaggacattggctcatgcctataatcccagcactttgggaggccaaggtaggaggatcacttgaggccaggagtttgaaatcaacctgggcaacataatgagacccccctcatctccaaaaaatattttaaaaacaaaatttagccagtgtggttgcagatgcttgtagtccagctactcaagaggctaaagagggaggatctcttgagcccagaagtcaaggctgcagtgagcaaagatcccaccacagcactccagcctgggtgacagagcaagatactgtttcaaaaaaaaacacagaagaacattaataaatcaccagtatagtaagagatttttgacatattcctttcagtttttgacatattccttctgttaattttgacatattaatttcagttactgagaagccaagaagagctagacctaattttatatataacatgtgtgtatgtatatttacatacatatatgtatgagagagagaggagagacagagtgttacatccaaaaatgggagaatgtatctatttcacatataccagaatgtttataaaaattgccagccaggcgcagtggctcatgcctataataccagcactttgggacactgaggcaggtggatcacctgaggtcaggagttcgagaccagcctaaccaacatggtgaaactccatctctactaaaaatataaaactagccgggcgtggtggtgcatgcctgtaatcccagctacttgggaggcttgaacctgcgagacagagtttgcagtgagccgagatcgtgccatcgcactctagcctgggcaacaagagcaaaactccatctcggaaaaaaaaaaaaaaaagtgcccaggtactatgccataaaaaaagtacccaaaaatttcaagaagtaggatcattttaaaaaattgtttttaattgagatagggtctcactctgttgctcaggctggagtgcagtgacacagttataactcactgcagcctcaatttccccagctcaagtggatcctcctacttcagcctcctaagtaactgggactacaggcatgcaccaccatgcctagttaattcttgatttttattagagatgaagtctcactctgttgcccaggctggtcttgaactcctgacctcaagtgatcctcctgccttggcctgccaaagtgctgggattacaggtgtgagccatcgcgccctacctgggatcactaaagtgtggtaaataccttgagaaaatacaaggggaagatatggcatacacatgttttccaaattcaatcatagaattactgccttttcccaccatccttcttttactttttttcgcaagatgcttattaacatacccaggaactttcctttttaaagaattcacagtcacccttataaacattcattcttgcttcttgtgaggcttgtttgttgacctgtggacatttactctacaggcgatggaagcttgcaaagacgctggcttggtgaaatccctgggagtgtccaattttaaccgcaggcagctggagctcatcctgaacaagccaggactcaaacacaagccagtcagcaaccaggtacagcctaatagcttccactagggtgtggggagtgggggcaggatttacatgacacaaagaagcctcagctgggagtcaggaaggctcatgattgctccacctaaatctcatcatgggaccctgtgcaagtctttagacttctttctattggtgtcactttaaaaaacggacttggggcctggtgcggtggctcacgcctgtaatcccagcactttgggaggccgaggcaggcgatcacgaggtcgggagtttgagaccagcctgaccaacatggtgaaaccccgtctgtactaaaaatacaaaaattagctgggcttggtggcacatgcctgtaatcctagctactcagggctgaggcaggggaattgcttaaacccgggaggtggaggttgcagtgagccgagattgcgccactgcactccagcctgggcgacagagtgtgacttcgtctaacaacaacaacaacaacaaaaaaaaatctaatgaaaatcaatgaaaaaaaatgagaaaaaacactaaggctcaacagaaaaaggagtaaaaggaatgaacagaaattcacgaaagacaaattgcaagactggtacacatgaaaaaaaactcactattaattagagaaacttaaattgaagtgtgatttttctattgcacatcaaattagcaaagtttttgtcttattaatatttttaaatataatgcccccgtgtaggcaagtgattaaatgctagtgagtgcaaattggttcagccttactaaaaaaacaatttgtcaatatgtatcaagggccttaaaaaatgttcacagtcctttatttctgcaatctatgctaataaaaaaatatcagaatgcctagatagactgatgtgtgtttactacaacattgttcataatggaaaaaaatggaaacaacataatacaaaaaattaaggggatgattaaataagttacaagacattcatattatgtgaaatcttaacaaaagatgttcttgaatccattttaaggaagcaaaatgaacaagatatgaagggacagactaggacacgaaatgtatatagtatgaaggagattctattaataaaatggattttattgaagaattttttttaacagtacaattgcattcaacaacgtggccttgattttgtgctctgctctccaatgcaaccacataggttgagtgccatccgtatttcacccagccaaaactcttgaaattttgccaacaacatgacattgtcattactgcatatagccctttggggaccagtaggaatccaatctggtaagtaaaactttaggaagcatttcctttggtgtagagtgtgaggctcatgtgaactactgtatttgattggaatgccttttggtttgcctgtgcaacctcttcaagtcattatctgtatatatgaattagaacttttcatactttcctgactgagctgttgtaaaattgattacattataggtatgaaattgcctatcagtgcctgatatataggaatgctcagtaaaagttagtttaattattatttgacaaaggagtttctatggccatgttttgcaaattttcaatcttttgatctctgtattcaatagtgatacttctactatgatgtgctccataaacttaagtagaaatttttctactttaagatgattccaaaagttgtgtctctatttcttccacttcagtcttcctacctttccctgtatgccagctctctctataagactcatcaaaaaatattatttaccctctgaaggaggcagctccataaacttgccttgcttgatcttcccatactacgagtaactctccattcagtgcatactctgcactcagagaaactggttacaggtgacctgcagtgtcctggtaggtgactgggtgaatgggaagacagaggaggaggatggtttattaacctttggttctcattatgcaaactaattatgatgcatgttttgatatttttaagggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcaggtaagagaattgcttttggagatgtgaaaagatgggtatgtttgctatttttgcttttatagaatgtgttcagcttaataggaaacctgtaacactctcatattttattttataccagccccttgacccatgtagcccatatctaggtttaattttcattcaatttgagacaattgctagtacttcagagattgctttgctacttgtacactatccagatctcttatattttctctttccttatctactttttattttttgttttaaattttttttttgtttgtttagagatagggtcttgctatattgcccaggctagtctggaactcctgtcttcaagcgatccttccaccttgacctcccaaagttctgggattacaggcgtgagccactgtacccagcctcttcccttatctattgacccttgacactacctactcacttctctaccagcacaacagaaattgagtgaataaaatttggaattcataatagtcaactttccaccttcttaatggctctggtaaaagttgaggacaaatttgaaaattattgaagaggaccatttagacttcatgaatgctaattgcctttacttccctctataagtaatctatgacttacgttgtaacttccaagtgaagaaagaactagacaaaggggtaattcatttattccgctactactaaagactaaactgctaggtaaacacaaccatagaaaagtgccatacaaaattaattaattacccattagctaatttacatttcaaaagtaaattgcctgtttagccctactcataattaaagataaataaaaagtaagatactagttgtcccttcatatcagaaaataatcaaaatacttggtaatatttggggaaacaggcgctttgacacactattgttagaaacattaatttgtatgagatatggaagagtaggttaaattatttcatgtccatcaaaattcaaatgtacatgttacatgatttatttatatgtggaacctaaaaaagttaatcacataaaagtaaggagtagaatagtggttaccggaggctgagattattgaagggagggtgctatgaggagatgttggtcaaaaaagttgtgattacagttagaaggaacaaatgtcaagagatctattgtacaaaaaggtgtctatagttgatgatgatatagtgtattcttgaaaaacataaagagagtgcatcttatgtgctcttaccacaaaaatgataactatatgaggtaatgcatttgttaattagctagatttaaccactccacaatttatatgtatgtcaaaacatcatgttgtatatgataaaaacatacaatgttatctgtcaaattaaataaattcaaatacacttatccattgactcagcagtcttaccctatagatgtatttgcacatatatacatgggtgcacacacacagacagatgtttattatagaattctttgtaattttttaaaaactcaaaacaatcttcaacaggattttataaaacaagctatgacatatttgtacactgaaatatcatatagccatttaaaaaatacaagtactgacataggaagatagccacaatattagacaattacatcttcagagcttttttgctacatgatagaatgcaactcaaactttagcaaaaaataaaagataatttattggcttgcataactggaaagtccatgagtagatcagaaatggctagacacaggtactcaaatgatttataaagagatttagtcctctctctctctccctcctttctctccacccacatggtggcacagacaattcctaacagctccaggataatcaattactcatactcagtgaagagtgaagatgatcagaaacaaagtcttctatcagggtctctatcaatccctgattagctcctgaaggtcaccctcatattacccactgtggccactgagtaggataccctgaccccagggctatatccctattcctgtgctgaagaagttaacagacagctccactagaagggggaaggaaagttcgtaaaaagaaaaaaggcgaaaagatgctgaatagttacatcaactcctgacaataacatttgccaaaatgcctcatcctaaaaagtggttgacactcttttccacaatcttagaaagagatcaactgcattactaatgtgtaggctcattgaagattaaaacacattttgatggactttttgaggactgaaaattttgctgttcaaaaattataggagtgttacaagtgacctttgcgatggaaagcatttggactttatagcatctagcaaatcgcaattttgtaccagagaaaatgccactctccttgaaattttcattgtaactaattatgttatattccatatgtttccatagccttgataataaaagaatggaactcagaggtcacatattccaagaaaaaaacggatacagatttagaaggaaaatgagaatgaaaatcacagccaattctcactctttagggaatagactcacccaataaccatgaattttgctgggtatgaaagcaaggagcaacaaaataataaattatgctctcttagaatgaaggtaaaataaactgttagaaatattttaaaagaatggcaaagatcaataaagcataaagaataaagggaaaaataaatattttgatgaaaaaagaaaagcaaaagaaaataaaaactatgtagtaaaaagttaagactgggcacagtggttcacacctgtaatcccagcactttgggaggccgaggcaggaagattgcttgagaccaggagtttgagagcagcctgggcaacaaagcgagatcccattgctttaaaattaaaaaaagttaagttaaatcatcagtttaggctgggtgcggtggctcactcctctaatcccagcaccttgggaggctgaggcaggtggatcacctgaggtctggagtttgagaccatcttggccaacatggcaaaaccccatctctactaaaaatacaaaaattagccgggcatggtcatgggcgcctgtaatcccagctgctcaggaggctgaggcaggagaatcgcttgaactagggatgcggagtttgcagtgagctgagatcataccatagcactccagcctggatgacaagagtgaaactttgtctcaaaacaaataaacaaaaaaccatgagtttaaaaactagataaaattaaaggtaaacatgaagaaagctaatacggagccaggatattttaaaagttaaaattttaaaaaaaagaaattataccaggtgtggtccagctttgttgccatcatccactggcctccattctttgaagatgttatctctgggctcactttcactttctccaacactcttcctctcataattcttagtgaattcaacatccacaccagtcgttctccacccttatccgacagctctttgacttcctctcccataagaatcttgtcctatatatttcagccactaattcccatgcctagcccttggaaattgcaataacaacttcctaataaatcctccatagcctcaatttcaaacatccccctctctttcctacactagcaattgttcctctctactgtgtaactcccaccaacattcacatatgtagtaacctcctatcttaaaaaataaaatccaacctagactcactttcctctccaagtattatccacttctctcttctgtttcaaacatctggaaagagaagttgttctcgctgcttcccattcccttcccccactatctcttgaagccattcaaaccaaacttttaccctgaccatcccactggaacagcccttgtcaaagttaccagtgacctccacattgctagatccagtaattctcagtccttgtcccacttggtctttcaaccacatctgatacagttaacaatatctccttcttcaaacatttactgaaagggaaaactgtaggggaagcagtttgagaagaactatcaggagctcagttttgtaatatgagatcctcattcacttaggataatttgtgccatgggagaaaaaaaagaccactgaaaattaatccacatacgacaagaaaaaacatgacacagaaataatgtagagagggtgaatttgaaagcttatattaagatcgaaaccaaagtttatgaaagtaagttcacttctattctcaacaaaatgtaggttacaattgcaagtttattaactcagaagaaacagtgaatcagtgttgattttttttaaatatgcttgacaaaattacataccacaacatgacatcctctatttcacaaaagttttgcagaatgttcataaagagaataattatcacaaaaattttggagggctttatctgaaggagatttttaattctttaatttttttttcaagtcacactcttttgacatatctatcaaagtagatttttaactgtgcaggattcttctttgaaaaagatcatacctataattagaacaaatctccaagatcattttctttgatttcataaaatcctgcatctttgcaaggtttgcaacctcactttgccattagattattccatatatttactggataagaggctgatcctccaagacttaaaggagaggactagtgtttagcaaaaaagaagtctgagtaaggattcattttataggcgattcattcatttttatattgtgcacatttttgattccttatgtaatctcataaatgccaataattggataataaatcataaaagaaaatggttccctgaaaagagtacttggaaagaatccatggagggataattaagtaaatcgtgttccatctacacaatgaataccatggctaaatgaataaagtcaggttgcatattgtgatagaactatcactggggtcactaagatattatgtgaataaaggaaagttgtagaatcataaagatatggtccaattactgcattttcctcttaatgtgtgtagtatttgggaggaatatctgggaagggaaataagaatggggtgatgagtgacaagattttcattatttattccatatgggtctatgtacttctacagtgtttcatttctttgcaaagagcgtatatttatgtactacttatataattaaaatctattaataattaaatatattaaaagttaaaggatagaaagataaaataataaagagaagataggttatatacagataatccaaatgttaaaaataaaaggaagtgaaaaaatatatataaatgttaataagggacaatcataaaaccagaatataaataaagtataaaatctaagaaaaataaaacaatggaaatgtaattagaataaaaaggtagaagagacataaaaaatgagagaaaggatttcaacatagcaaattaaaagttaaaaacaaagcaaattaaaagtttttttaaaaagcaaatttaggccaggcgtggtgaggctcatgcctgtaattgcagcactttgggaggctgaggtgggaggatcgcttgagttcaggagtttgagaccagcctgggcagcatggtgaaaccccatctctacaaaaattgaaaaattagccaggcatggcaaaacatgtctgtagtcccagctacttgggaaactgaggcatgagactagcttgaacccaggaggtggaggttgcagtgagccaagatgataccacagcactccagcctgggtgacagagtaagaccctgtctcaaaaaaaaaaaaaaatcatatttagagactcagaattttttaagtgtaagacagtagttcagaatcaaaagaccagcatttcatacagaaataagaattcttcacatttgaaattttaggggatttcattaacatttgtggtttcagagcatttggaatttcttgtaagatgtccccagaaagaccgtctcaaaaacaaagggcagaacagagtatccagctccacctcagtgggtagccccccaacaccagcctgactcctcttagacatttgcagagatattcatacatctttggaaggctcccaccggtggccccactttctgatcccaagcttgaccttcaaaaatgttctattatttccgttatttcagatctttgacttttctctcactgaagaagaaatgaaggacattgaagccttgaataaaaatgtccgctttgtagaattgctcatgtaagttccggggatcattaatgggtattgaccagtggtattgaatggtcatgtgtcaagcaacaaggctcataagaaccctgacctatgtccatagcaccagggcaaagcatggtgggccgcatattctgaatgttaacatgcctgagggaaatacatccactacagggccttccacaaccctacactctcactgaaaagaagagtcctggcatctgtgacattttgtgacttcggtgaaggcatgcaggctaaggaacctgaggagaattaattcatcatgtacatatgctaaaacaacagcagcacaaatgttgaaacaacttatttatttattcctaaaaatgaaagtgatgcacaaattagagcaaagttataaaaaaaaatttctaagggagaggcatgatgatgttgtagaaagagcactagattgaaaccaagaacttagacttttagacaaatacttaagattttagtttccagctctacctattagctgacttcctacaagcaaaattccatatactccttcaaaatgtcaagttcagctaaccaactgaagtagctctttattctctaaatattacaggccctttaaaaaagaatatagttttggccaggcgtggtggctcacgccaatactttgggaggctaaggtgggcggatcaccttaggtcgggagttagagatcagcctggccaacatggagaaaccccgtctctactaaaaatacaaaaattagctgggtgtagtggcagttgcctgtaattccagctactcaggaggctgaggcaggagaattgcctgaacccaggaggcagaggttgcagtgagccgagatcatgccattgcactccagcctgggcaacaagagcaaaactccatctcaaaaaaaaaaaaaaaaaaagaatatatttgctatatatgtgtgtatagatatacacacacatatacatatatatactcatatacacacacatgcatttttttcttcttaatcattctctattaatgtttccagttcttcaaatcacctgaatattcatcttcatcttgaatctttaagtgaacattcagaaaatgctaagatgattcatatagtttggacacttactttactgatcctactgtttttcatgggtcagaaagtacagtgactggattaatattgaatttctgaattaataaaacaacttcctaatggaaatttttcagggggaaaattgtttgacatcaaaaggcaccaccacccaacctcaagaacaaaagagtaaacataaacacataaataacactttcctagaactaacagttataggttaattaatagctcttgaagataaatgacttctattgaatcaataatatatcattaagttaagaagagaaaccaggtgcagtgtctcacatctgtaattccagcactctgggaggctaagataggagaatcacttgatgctaggagttcgacaccagcctggacaacatagcaagaccctatctctacaaaaaatttaaaaataagccatcatggtggcatgcacctgtagtactagctacttaggacgctgaggtgggaggatcacttggaccccagactttgagtgagctaaggctacgctccagcctggtagacagagcaaggccctgtctcaaaacaaaacaaaaaacaaacaaacaaaaacagtataatcaatccaccaatgtactaattgttttacagacagttggtgacattattcagtttgacatctgacatatttaaaagcaattctagcaacttcggggaaaaaaaaataactcttaccaggaaataactagaaaaatcagcaaggtggaacaagaattaggccccattaatcacaaatactgtatcatttagagatattggaccatgatttttttcagcttttatcaagttgatttttaacatttgaaaatcttaatattttccattttaatttacagtacatgcagaaaactaaatcaggaacacacacattccagacattttacagaccatttcatcattgttatttaagagctaaattcactgccatcatcatcgtcataatcatccagcaaacttattttgctactcatcacctttctagatctcaaactctcaacacgcaggaggtctagtgagaggggcaagtaaaaatgctaatgagactgggtgtggtggctcacacctatagtcccagcactttgggaggccgagacagggcgactgcttcagcccaggagttcagcttgggcaaccgtggtggcacatacctataatccctgctacttgggaggctgaggcaggaggcttgcttgggagcccaggagtttgaggctgcagtgagctatgatcatgccactgcactccaacctgagtgacagagtgagattccatctgtaaaaaaaagaagaaaaaaatgctaatcagcagagggtgacactggtaataagagttttgaagagaaatgcccatgtagtggattggagaaggaggcagccagcgtcaagggaacagaaagggggaaggagtagggaagaggcatgtgcacatgacatgcctaagacatgattcaccactggggattctgttctgagtaaaatgttgataaggtggccaccaaccttccctcaacacactcacattcaggaggctgtccagagcttcaggaaaaggtgctggcttgagggaaaacagaagaggaaagtaggtaagaaacagcagaggaatgaataggagagaggggtagtggtcagtgaaattctcaaaggatgctattgaaacatacagctgtgcaatttttgagtgaacttttttctgtgggggaattgttttggcaggtggcgcgatcatcctgaatacccatttcatgatgaatactgactgccgggagttcctgaacagatttttcactcccatgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttaacaggacaacgaagtgcatgtggcagtgtgctggcagtggccttgaggctttggaccattggttacaaaacagacacagccaagataagatccacacacacattattaacaaggaagtgatttgctgcaccttgagttgagagggctacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaagggcctgagtctcaacatggctgctgatccatacttacacatcttactgtcaatcttgcctacattgattatagaaccactattacgtgaaaaggcttgaaacaaccaacatatacaaataaaaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagtccggcctgggtgaaagagcgagactccgtctcaaaaacaaaaaaaaaagaaaagaaatatattttattcattcacattaggtcactgtcatactgtcataggatgagagagttcttcaaaaattatgttttcccaagatcagttgcttatagataatgttcaatgacctcaagacatatatttttgagaaattatcattttaaaaaatttggtctatactgattgttttcactgattccaatattattacttataacactgacctctggaaaatattttgttcacaagaaataataaagtataatgatttgttgcatcacatgaatctccattctgtttctaaggttggggcaggggaagaatcatctgaagccagttaaaaggcctttgatttaatcctgctgtacatttagcactgggaagagaggaaagaaaaggggatgtggtggctcatgcctataataccagcaatttgagaggccaaggcaggtggatggcatgaacccaggagttcaagaccagcctggaacaacatggcaaaaccccatctctaccaaaaaaaaaaaaaaaaaaatacaaaaattagccaggaatggtggcacacacctgtagtcccagctactcaggaggctgctatgggaggatcacttgggttggggaggcagaggttgcagtgagccaagattgtgccactgcactcgagcctgggtgacagagtgagattctgtctcaaaaaaaaggaaagattgaaggaaggaaggggaaaaaggaaggaaggaaggaaaaaagaaaggaaggaagggagggaggggaaagaaaaaggaaggaaggaagggagggagggagggagggaggggaaagaaaaagaaggagggagccgggcgcggtggctcacgcctgtaatcccagcactttgagaggccgaggcgggcggatcaagaggtcaggagatcgaggccatcctggctaacatgttgaaaccctgtctctactaaaaatacaaaaaattagccgggcatggtagcgggcgcctgtagtcccagccactcgggaggctgaggcaggagaatggcgcgaactcaggaggcggagattgcagtgagccgagatcatgccactacactccagcctgggcgacagagcaagattccgtctcaaaaaaagagaaaaagaaggaaggaaagaaagaaggaaggaaggaaggaaggagggaaggaaggaaggaagggagggagggagggaggcaggcagagagggaggtatggaaggagtgacggagggaggaaggaagaagaaaaaggtggtaccattatgaaagagcagaaacttgagtcctggtccctgttgtgaaagtccttaaaaatactttgagggtattagtgtagaggtgagaatggaaacaacacctatcgaagcatttttaaaagacagacattggaaaagagtcccatcatttgtcagcgaaaaggtatttctaaaaattgggggagcgaaatcctctcttagtcataacagagatggaggaaaaagatctggagacagaaagtaggaaggtcaggaaagaacaacagtctgatggaagcttctgcatgttccttctccctccactgtcacccctctcaagcttcccatctgttatgggttgaactgtgtcctctcaaaattcatatgttaaaaagcccagaccccagtacctcagaatgtgatcttatataaaaatagggccaggtgtggtggctcttgcctgttatctcagctatttgagaggctaaggtggaaggatcacttgaggccaggagtttgagaccaccctggtcaacagagtgataccttatctctacaaaaattttaaaattagctggatatggttgtgtacacatggctggttgtgcacacacatagcacccagctatttgggtggctgaggcaggaggactgtgtgagcctaggagtttgaggctgaagtgagctatgatcatgccactgcactctagcttggatgacaaagcaagacctcatctcttaaacataaataaaatagggtcactgcatatgtaattaattaagatgagatcatactggggtagggtggagtaaggtgaaccctaaaccaatgagactgtgtcctcataaaaaagggaaatttggacacagacaacacacagggtgaatgtcatgtgaagacgaaaacagagatcagggtgatgcttctacaaggtaagaaatgacaaagattgccaacaactacaagaaaccaggcaaaaagcatggaacagttacacctcagccctcagagggaatcaacattgccaacacct

SEQ ID NO: 12551 - DNA, 96878 bp, Human
  misc_feature (1)...(96878): n = A,T,C or G
tttttgcaatcaagttgcaggagttccttatatattttggagattaacccctgttaaatatatggtttgcaaatatttctccccattttgtaggctgccttttcattctactgattgtctcctttgctgtgcagaactttttagtttgatgtatcccacttgtttatttttgggttttttttttttttttttggctgtgcttttggtgtaatatccatgaaatcattgccaagatcgatgttaggaagcttttcccctatgatttcttctaggagttttatgacacatttatatgtgtcatctttaatttcttttggcaacaatttgtagttttcagtgcacaggtcttttgcctccttttttaagtttaacacttcactttgtaattcattttgagttggtttttgtatatggtgtaaggtagggctccagcttctctctctttcatggatatccagttttcccagctccatttatcaaaaagactgttccttccttattgattggtcttgttggcatccttgccaaaacccatttgactatatatgtcaaggttttatttctggactccctctctcttttcttttttttttttttttccagagatggggtctcactatattgcccaggctggtcttgaattcctggactcaagcagtcctctcacctcccaaggtgctgagattaccagtgtgagccaccatgcccagccttatttctggactctctattctgttctcttgatctatatgtctgtctttatgccagtaccacaccgtattggttactgcagcattgtagtacattttgaaatctggaagtgtgcgaccttcacctttgtttttctttttcaaaattgttttggctatttagggtcccttgagattccataatattttaggatagatttttctatttctgtaaaagatgccatcaggatttgacagggattacaatgaatctgtagatcatgttgggtagtattgacatcttaacaatattaagtcttccggtccataaagctgggatgtcttccatttatatgtgtcatctttaatttttattttttattttattttgagatggagtctcgctctgtcgcccagactggagtgcagtggtgtgatcttggctcactgcaagctccgcctcctgggttcacaccattctcctgcctcagcctcccgagtagctgggactacaggcacccgccaccacgtccagctgattttttgtacttttttagtagagacggggtttcactgtgttagccaggatggtctcgatctcctgacctcgtgatccgcccaccttagcctcccaaagtgctgggattacaggtgtgagccaccgcgcctggccaatctttaatttttttttgcaacaatttatagttttcagtgcacaggacttttgcctcctttttaagtttatttcttcttaagtttttaggaatactatataaacattcctaagtatattcattttttgatgctgttgtaaattgaattttttgtttattcattgttagtatgtagaaacacggttgatttttgtgtgcttatcttatacctgcaactaaatgtgtttattaattctaactttcttgcataatctttagcattttctacatataagattatgttgtataccaacagaaataattttattggctgggcgcagtggctcatgcctgtaatcccagcactttgggaggccaaggtgggcggatcacaaggtcaagaattcaagaccagcctggccaatatggtgaaaccccctctctactaaaaatacaaaaaaattagccaggcgtggtggcacatgcctgtaattccagctacttgggaggctgaagcaggagaattgcttgaacccgggaggcggaagttgcagtgagccaagattgtgccactgcactccagcctgggtgacagagtgagactccatctcaataaaaaaataataataataattttatttctcctttccaatttagatgtcttttatttcattttgttgcctaagtgcactggctaggactctcagtgctatgttgtataggagtggtgagcgtgggcatttttgccttgttcgtgatcttggaggaaaagctttcagtctttcaccattaagtgcgatgttaactgtgcatttttaatatatggcctttaatatatggcctttttttttttttttttgagacagagtctcgctctgtcgtccaggctggagtactgtggtgtgatctcggctcactgcaagctccgcctccaggttcatgccattctcctgcctcagcctcccgagtagctgggactacaggcgcccgccaccacgcccggctaatttttttttttttttttttgtatttttagtaaagatgggatttcactgtgttagccaggatggtctcgatctcctgaccttgtgatccgcccgcctcggcctcccaaagtgctgagattacaggcgtgagccactgcgcctggcccaatatatggcattttaatatatgacctttatatatgttgaggttgttttcttctattttgtttgttgagtatttctcatgaagtggtgtttaactgtgccaaatgctttttctgctttaactgagatgatcacgtagtttttttttatctcctttcatcgtgttaatgtggtatattacattgatagatttttgaatgttgaaccatccttacattccaggaataaatcccacttgatcatggtgtaatctctcttttaatagttgaatatgattcgcaagtattttgttgagtatctttgcatcagtatgtcagaggcattcaaaccagagtgactttatcttgaataggggctgggtaaaatgaggctgagacctgctgggccacattctcaagaggttaggtattcttagccctaagacgtttatagttaagggaacagaaacagacccaggatataacagacccaggaactgtcctgatgtccttatatcttaagaacaaaaacattcctagttttaaaataagtctcactttaaagataataatatatgcacagtgagaacacgtggacactgggaggggaacatcacacaccggggcctgttcgggggtggggggctaggggagggatagcattaggagaaatatttaatgtagatgatgggttgatgggtgcagcaaaccatcatggcatgtgtatacctatgtaactaacctacatgttctgcacgtgtatcccagaacttaaagtataaaaaaaaaaatagataataataaaggctctcatgaaagacagtagttacacaaagattagcaatcctttatcacaaacccttgtagtagagcacatctcctccatgatttttgttatatataagcaagcattgtacctaggtgggcacgttcctcctcttattttttggaatgccatgctctgcctatggaatagctattctttcacttctttactttatttatttatttatttatttattttgagacggagtctcgctctgtcgcccaggctggagtgcagtggcgcgatcttggctcactgcaagctctgcctcctgggttcacaccattctcctgcctcagcctccctagtagctgggactacaggtgcctgccaccacacctggctaagtttttgtatttttaatagagatggggtttcaccatgttgggcaggctggtctcgaactcctgacctcacgtgtccacccgcctcggccttccaaagtgctgggatgacaggcgtgagccactgcgcccagcctgtgtggaggttttaaattactgttcagtctccttagaagttacatctattcaggtcttctgtttcttcatgatccaggcttgccaggttgtgtttctaggaatttttctatttcatctagtttattcaatttgttgtcatacagttgttcatagtactctctgatagtcctttctgtcaaatcagtagtaatgtgtcccctttttcatttctgattgtagtaatttgaggtttttttttctttttttctttttctttcttttgtttgtttgtttatttatttattttgagacagagtctcactctgttgcctaggctggagtgcagtggtgtgatctcggctcactgcaacctccacctcctgggttcaagcgattctcatacctcagccacccaagtagctgggattacaggcgtgtgccaccaagcctggcaaatttttgtatttttagtagagacagggtttctctatgttggccaggctggtcttgaatgcctgacctcaggtgatccaccccaaagcactgggattataggcgtgagccaacgtgcctggccataatttgagtttttaacttagtctgtttagctaatgaacatattttaaaaattcttttggatctatatgtaggagggaattgccatttggatcaatagtaatgctacgtttaacatattgaggaactgccggactctcccaaagtgcctggactgcacattttacattaccaccatcagtgtatgaaggttccaatttctccatattcctgccaacacttactgttgtttatcttttgttttttgagatggagtctcgctctgtctcccaggctggagtgcagtgacgtgatcttggctcactgcaacctccgcctcccaggttcaaatgattcttttgtctcagcctcctaagtaactgggactacaggcgtgtgccaccacacctggctaacttttgtatttttattagagacagggtttcactatgtcggccaggctgtctcaaactcctgacctcaggtgatccacccacctcagcctcccaaagtgctgggatcacagacgtgagccaccgtgcccagccttgttcatgtttttaattctgagcattctagcatgtgtgaagtggtatctcattttggttttgattagtgttgccctaatgactagtaatgttgagcatcttttcatatgcttagtggccatttgtacatcttctttggaaaaacatctattcaaatcttttgcctattttaagattgggttatttgctcttttatttttgagtgctatgagttctttatgtattctggatactagtcctttatcagatatatgatttgcaaatattttccatttgtgggttactttttctttttctttttttttttgagataaagtcttgttctttctcccaggctggcgtgcagtgtcacaattattgcacgctgcattctcgacctcccaagctcaaatgatccttccacctcagccccccaagtatctgggaccacaggtgtgtgccaccataccccgctaatgaaaatttttttcctttttttttttttgtaaatatgaggtctccctatgttgcccaggctggtctcaaactcctgggctcaagtgatcctcccatctcagcctcccagaatgctgagattacaggcgtgagccattgtacccagcctttactttcttgatactgtcctttgatgcacaaatatgttcaatgttgatgaagtccagggtatctattttttctttggttgcttgtgcttttggtgtcatttttgtccatctggtcttttactaacccccatataccctttgacacatatttagaggtcctcaaaatttttatttaaagatgggaggatatggaaatatttttttaaaaaactcattgaaacagactgcagtacggtctttaataatgaagatccccaaagcttctgtgtgaatactcagggcttctcaaaccatctcttggtaaaggctgatgaggatgatcatacatcctaccaaagcccctcactctttggtttgaggcaagataaaaaggaacactggtgatgaaatttaggataacaaggagcataaaagaggcagtacttctgccagtttgcccccaagtttctctaccaacatcttacagtgccttttgttaaggggaggacagatgtggtcccagggtccaggcctcttgctcttataaattcccattgagcagtagttctcaaagtgtgaccaggggtccagcaacagcagcagcatctgagcacttgttggaaaccagattcttggaccttgcttcagacccactgaatcagaagctctggagtgggacccagtgatctgttttaacaagcactctgctgaacgttcaagttggagagccgttggtgtagcattttcagctggtacaacctggagtctgccacctggagagtgtggttactcatcatctcctgccaagcgtgggatcaggtacttttggtaacaagtgacagcaaaccttaaactaacctactaaacagcgcagaaattaattcgtttgcatattctgcctaaaaagtcagtagggagcaggcttgttctccgttttcctgtgattctctctgtcttcctctgtgtattagctttgtcttcacacccacttctctcgtggttgcaacatggtttcctgcaaccatcagagttgtgtgcttcctaattagctccagagtgagacgacgtggcattccacaccatcaagcacaactcaccagcttagctctgatgacaccagccctgagtcagggcacgaggcagaaaattttcctgactggcttagcaccctgcttctacccctcccttgcaggggatgagtaagtcctacccagttctcatggctatttcacaaaggggaaggaagacatggtgtatgtggagggggaggtagccatggtgcccaggacatcaggactcatgaaatggcctcttcgctgtttgtccccaacccactgttttttccttaataatgcatctagagggatctttccaaagcaaaagcctgtctacaacacctcttgcttaaaccctttggtgtatctccccagacacacacgcacacacgcacacacagctctccagattaggttcatactttgagatgttcaagttctagttctaattgacctccagcctgctggattcccatcctttggaaccccatggaatgctccgccattacccgcttccacgcttttccctgctgccccacctctgcttctgtgttctgccaggaatgcctttacccttccccacgtggtaaattcacccttcaaaactcagcctggatatctgcttcctctgggatagctctaaggcaggttaatgaccgtgtccacaggcttctgggttacatagtcaccgtgtgcctgcaccactcatttctatatctccctcagctggtgatcttggggcagggacctgtttgattctccctgggtcctcagtccccaggcttgccatgcactaggagctcagatagtgtttgttgatcacatactacttttgtgtcccctactgttgcctagcaaagtagggcccctggtagacactcagtttataatgatcaatgcattaaactgaccacaaatctcagttcttcaggtcctaggaaaaccgtgagccacctgcaaatataggctgcttatgcccttgacaggttcagggaatccgtccttttagcactggggcggtttcactttggacttgatcagggcttagaggcctttagctttccgatcctgaggagcctccctttatccaggaagcaggggactggaccactgggaccttcatcacgggtgggcacggattccccatcccaatcagaagaatagctgtatctgtagcagtaggttattctaggccagttctttccattaaaaaaaaactaaagcccctaggttgaattaaaaaaattaaaaatttaaaagtcatgtttatttctaatatacagtttgataatacatatttattgaatataatacataaaagtacaaactacctgtaatcctcctatgggttttgtgcttccagtcttttttctaagcatgcatatgtagtaatttcctaaagcattgagattattattttattcatatttattaccatcgtctcagtgcattttatgctgctataacagaatacctgacactgggtaatttgtaaacaatagaaatttatctagctcatggctctggaggctgggaagtccaaggttgagggccctgcatctggcgagggccttcttgccatcgtggaaggtggaaagagcaagagggcatgcaggagagagccagcaactgaactcacagcctctagcccttttataatcagcactaattcattcatgagggtggagccctcatggtctaaacacctcccattactgttggtcccacctcccaacactgttacattggggattaagtttccaacacatgccttttgggagatacattcaactattattttatctgttactgttgagactattgttttattaattaaaccccatgtatttctgcaaaaagccctgacaagtttataataccaatcccctgtagccctcctgccactgataagctgaaggtaaaaatgttaagacccagatactaaaaaaagcaagtaaggcctgggagtcaaaccaaagctgaggaacttaacccagagcttcccagcagccaaggcaaaaaaataaataaataaaagggaagctcaaggggttgtggagctcttgaactaaagaagaggaagcaagccaggttgtcagaatgcacgagctttcctggtgctgacctctggagagggcacagggacgttgtataagagtgttgtgtaagggacagtttcactgaaagatgcaggaactgcctgggtttggtcacttctcatactgactcttaagaatagctgatgacaggccaggcgcgggggctcacgcctgtaatcccagcactttgggaggctgaggcaggcagatcgcgaggtcaggagatcgagaccatcctggctaacacggtgaaaccctgcctctaccaaaaaatacaaaaaattagccggatgtggtggcgggcgcctgtagtcccagctactcgggaggctgaggcaggagaatggcgtgaacctgggaggcggagcttgcagtgagccaagatcgcgccactgcactccagcctgggcaacagagtgagactctgtcaaaaaaaaaaaaaaaaaaaaacagctgatggcatgtccataacttttagttctcaaaaataaataaatacataaagaaattgtagttctgggaagacatttctttgttttgttttgttttccctaggaatcagactgagaggaaggcatatttttgtaggaatcctaagtgacgtgatctaagcatgaaacttactggtgatttcatttggtagagatttaacaaacacatattaactgtgtggcttttgtgctgttctttcatgtaaggaatctcatttaactttctcaatgaagttggaggcaagagatgattaggccattttacagatggggaaatggaggctcagggagattgacttatccagggtcatgtagtcaattaagtggcacaccaggactcgaccccaggtttacaatcttttcctctgtgttggcaccttgttggagaagcgggaagtgtctgaccttgttacatatccacggtgtattaggactgggtttttcggttttttttttttttggagacagagtcttgctctgtcacccagactggaatgccgtggtgtgatctccgctcactgcagcctccgcctcctgggttcaagtgattctcctgcctccgcctcccaagtagctgggattacaggtgcccgccaccacacctggctactttttgtatttttagtggagacggggttttgccattttggccaggctggtctcgaactcctgacctcaggtgatctgcctgcctcatcttcccaatatgctgggattacaagagtgagtcactgcccccagcctaggactaggtctttataagtaccacctcatctgttccttacagtaaatcctagagccacgtaatattagcccattttacggagaggattggcggttgtccaaggccatacagatggtaggtgttagggaggctaaccaggggttcccagccagggtttggtgatggaacttcaggatgtggaaggattcaatagaatggcacaggaacatttctgggtgagaggggagaggatggctttcacagagcctcaaaaaacccaaacaaaaataaatgagaaaaacagacccatgaactcaaggaaagaatcatagtgacagctcacataactgagtcccgacctggggccaggcacgtgtcaaggcctggatgagcttatcattcccatgagggttagggtgtatcatccccatctcacaggtcgcccagctagtaagtggccttgcatggtcactgagttttgctgcttttccatcatcacctcttgtggcttgttttttttctagcagttagtagaatttttcttcctctttcgtggagctgagaattactacaaggcagaatgatatgctgtgcttcaaaaggtcattgcctgtttccaagtcacctctgtctgttcccttgccactgggaacaagctggttaggtggtggttgggtaagagggaacaaatgaatggacgaatgaatgaatgaacaagtggatggaggaagtacctcttccttggcgttcgggatcagcatgcatggatccatttctgatgacttttattcaagggtgacaggtcactgtagtgttagagagaagtcttggggaagctgaggtcaggcccgttgttgatgaccaggcaggaccagagtgacccagaaggcctccttcctcctcagcagggagtggtgtggaagtgggccgtgccgccttccacagctctctgccgtggcacacagccctccaaggcaagtggcaagcctggcagggcctggaatggttgctacccctggaacctagtatctctagtatccctggcccacgttaaagtcccctgttttatctgctgtggtttcgtgcatcccagcccggcttatacccctagtgtagcccagccatggggtcccagttcagagcaacagcatcagcagccccattttacagctgaggacacagtctcagaggacggaagtgacctgtccaaggccacactagtgagcggtggacctgggccatgagcccagccgtgactggctccaaagccacgcatcaccacatcctcataggacccacatgacctcagggtcatatttacattgccaggaggctcctggaaggtaagccacaaactggaggcttcatcaaattcctgaggctgctccaccctcctctggctggagagctgtctctggtccagctagaccatggttgagagtttctttcctgtttagagacagcgtgggtcttcttgactgccccactctccagggcctctgctgagctgggttgaaggaacttcacaacaagcaggggccaggagctggaagctaagaggtgattctgcctgtcctgaagtttgtgacgccatccctcttcctcaaccacctgtagccctactttaagaaaaaagaggtcaggcagggtggctcacgcctgtaatcccagcactttgggaggccagggcgggtggatcacctgaggtcagatgtttgagaccagcctggccaacatggtgaaaccccatctctactaaaaacacaaacattagccaggtgtggtggcaggtgcctttaatcccagctactcaggaggctgaggcaggagaatcacttgaaccccagagatggagccaagattgtgccattgcacgctagcctgggtgacaagagcgagagtctgtctaaaaaaaaaaaaaaaaaggaaagaagaaagaaaagaaaaagcatctatgcaaagagcccggagtgggccagaaagagtgagaatgggagtgaaccagggctggaagaacctttcttttttttttttttttttttttgagacggagtctccctctattgctctattgcccaggctggagtgcagcgggtggatcacgaggtcaggaaggacctttctactgtaatcgtcctttctgcccctccactaggctgggagccccttgagggcctagacctggttgttctcccggggcctgcagcctgtcagtgtggagtaggtgtatgatgaatgaatgaatgacctgagggtttggagctctgcttccagtccaggaacaatctctgtggccttggtcagttacatccccttttttggcctcagtttctccatctgagctgatcttcaaggccctgatgttctgagccagcaaggtccagggttctggaagatggagagagcctgagacaggtgctgggattctgagaggacttggccagcttggccgggggaaggcatcctgaggttcttggctgtggagcataggaaacagggcagctggcaggtgggcaccaggcgcataggcgggagcgaggagggagggtgtgggcttggctgaagaggctgtttgctgaagcttcaggtcttcgtagcaacttagttttccttcttcagaaaatgaagcagccaagaagctcctctgggtgtcagagcctccagtgaggtttgaggcccactgggggagggggacgggctcccaaggcaggaggaggaagggctggagagcaggggcacccaggcattgggcatgggtggaccctgcccaatgggcctgtggggttcccgtctcgatggctgggcagccccactcattgtcactttgccctgtgttttctgcagatcatgattgagttctgtccagggggagccgtggacgccatcatgctgggtgagtcttacttgattcggtgcattgtcgggaccagacgactcgtttggagtcctaagcctgactgctggacagctctgtctaggactgggacctccactctcccattccatcagttcccatggcctctttgagcacctctctactatgtctgcttttgggagcagggtgtgggttctttttttctttctttctctttttgagacagagtcttgctctgttgcccaggctggaatgcagtggtgcgatctcagctcactcactgcagcctccgcctcccgggttcaaatgactctcctgcctcagcctcctgagtagcctgggattacaggtccgtgccaccacgcacggcttgtttttgtatttttagtagagatggaggggttgggttcttgaagagaacgcaggacattcgctggaagaccatcactccctgttccagaagccgtgtgtccttgaactggccactctccctcttgaggcctcttgatctaagatgggtatgatgccttctttgcgggaccccacacactctcaggaggtaaaaccgagatacccgaggaaggtctttgaaaagtggggatacccacacattcagtaaatgctctgtggggacggtgtcaggtctcaatgtcctgggcaagcttgagcaataatgacgacgatgatcacagtgaaatgttagtagtggccattcctttgtgaatagtcactatatgccagagagtgtggtaaccacgttcccatatgcggtcctcctctaatcctcaggtataaaatcaggaagagtattttatttatttatttttgagatggagtctcactctgttgcccaggctggagtgcagtggcgcaatctcagcttactgtaacctccacctcccgggttcaggtgattcttctgccccagcctcccgagtagctgggactacaggtgcccacgaccacgcccggctaatttttgtatgttagtagtgatggggtttcaccatgttggccaggctggtctcgaactcctgaccttgggtgatccacctgcctctgcctcccaaagcgctgggattacaggcaaatatcacttttatttttgattgggctgacacttgaaaggttaagggactcacccagatcacacaggagagctgtgaacccaggtctgggtgacccgctcctaaccatggaccatggcccatcctgcagcatccccggctcatgctacccttcagggcagtgagtgcagagaggctgaggagaggcctggaaggttgagtgacatgtccaggattctgggatggcccagaagaggagaggcacttaggataatgtcacaccattcaaggtattttccctgagtttacctcaggagggagccaactgtagtcctgacatagccttgaatgccataaacctgaatgttgaaatccaaaaagagcaaaatgcctaaagtctcaaatcctgtcaagtacaatcccgaaagatcaaaatcccaaaaatataatgctaaaatttttttaaaaattcttgatatttacttatattttaaaggggaatttgagaaatataaaaacttcaaggcgcttcataggccactttacacaatcaaataggcagtagtaacatacatactttgcaagcataaacagctataccaaagatggtggtacagctgtaacaattatgagcagattggctgggtgtggtggctcacgcctgtagtcccagcactttgggaggccgaggtgggcggatcacctgaggccatgagtttgaaaccagcctggccaacatggcaaaaacccatctctacaaaatatatgaaaattagctgggcgtgatggcaggcgcctgtaatcccagctacttgggaggctgaggcaggagaatcacttgaacccaggcggtagaggttgcagtgagccaaggtgatgccactgcactccagcctgggcgacagagtgagactccatctcaaaaaaaaaaaaatgaaaaaaagtcatgagcagatgacttgtacccataaagaggtaggtcaaaaagggagatgtataagtgcatatcaccaggattggtgattgtgtacacacagctttatagctgttgtctgaaatactgtaatgaacaaccaaagcctgttgacgagattgatcaaaaccctcagtgggtcactagggcatatgcagatgccgaaagagccaggatctggagaaagtttatcttccacaaatgcggatgtaccaaaaggacatccctatgtttactgaggaactttcagcatttttccatacatgcacaatgcttacacaccagcaatgctgagataatacactttcagggagtcaaatttgcaacaaacgcataaaaggaattagaactctctcaaagtctctataccatttatacctccagtattgaaaatgatgtgaagatgaaatacatagcatagtgaattgcaaaaagtaatgctatttaaaatagtgggggaaaaatatatatatatactaaagaccatttagttttttcaaatttaacatatgaccaagtgtattacagggagagattatgggcagttgcacagagaccgttcataagagttgacctcacaggatacaactatcctgtgattgagatttttaggattttagactttagggattttgatctttggggatttcaatatttgggattatggtatttgagatggtctcttttaggattatgatccaaacccatctcaggaatgtgtgaaatttacagtagtccatccccatcccgggctgtagaaatgtaggacccacaagccttcgttacagagccacttactgccccatggagttcccaggtagatgacagtagcggggaggatacatggcacatgttatatggctcttgggtgtgccttctctcagcaggcactgcctttgaagattatcatttggggggatagaatctaacagtataaaagtgatagtctggtatgaattgagactttaggttatgaggagccagaatactcaaacttttttaggtgggggaaaggtctgggatgtgggaggtggaatttatttgcacaaataactgaagacttcagggatggctagcttcaggcacagcttgttccaggagttttaaagagttatgataagagatggagtgcagcggctcaagcctgtaatcccagccctttgggaggccgaggcaggtggatcactttgagctcaggagtttgagaccagcctgggcaacagggcaaaaccccgtctctacaaaaagtacaaaagttagctgggcgttagtggtttgcacctgtaatcccagctacttgggaggctgaggctggaggattgcttgagcccaggaagaagaggttgcattgagctaagatcatgccagtgcactcagcccaggtgacagagtgagaccctgtctcaaaaaaataaaataataaagagttgtgatatggacttgatttctttctccaactcttggccccactgtcctctgtgttagccccattctcatgctggttttctgcatgcatcttgacaacaagatggtgtgggagctccagccatcacatctgaattccaagcagcagggtagacaacagggtagaataaccacccatcccacactgaagactcttttaaagagacttcagaaaagctccacatggcaccttgatttatgtctcattggctgtagcatatcacacacagctggaatggaggctggggaatgtggttttctagctgggtagccatatgtgctgatactaaaaaaagaaggggaaaatggaagccagctagcaccccctctgtgtcccctggtatgcagcttaactgaatgagcttagctggaggggagcatcagagatggaaaggcatggaagtgtactgtgtcctcgacctcattcacagctagggcgtgccctaggctacagctcagccagcagacaaacccttctctggctcccgtcccagttctcctcgtggtcctgactgctccagccctaggcagttttccccctgttggtggcagcagtgaaaggagcattttgggaatgatgatgtgcaaagagaagctgaaatggggacagctgacaagttcagagccaggtcctcgttgcagctctctgtttagtgttgaccttcctgcagatgcctgccctgcttagaggggtttctgcccctccatccatctccactttgccccgcatggctgggaagcattactggcctgagcttggggcccaggggtccattccctgaggtccattccaggtttctctttttggaggctttggggcacaggactggcccttttgtgagatggagagaatacccacgtggtatgtcactgtggggccattctatgtaacatccagggcctgttctgattggaatagatatggttggccatgccttgctggctattaaacatcttgggtcttggccgggcgcggtggctcacgcctgtaatcccagcactttgggaggccgaggcgggtggatcatgaggtcaggagatcgagaccatcctggctaacatggtgaaacctcgtctctactgaaaatacaaaaaattagccgagcatggtggcgggcgcctgtagtcccagctacttgggaggctgaggcaggagaatggcgtgaacctgggaggcggagcttgcagtgagcctagatcgtgccactgcactccagcctgggcgacagagcgagactccatctcaaaacaaaacaaaacaaataaacaaacatcttgggtctccaccctcttatcgtggaaaggatgagaggctagaattagatgtggtgtcaacggggactttgcaatgttgtagtttttttaataaggagaaggtattcatgcattgctgtgtaattgaaaactatttctaaaaatgtattggactcaaaaggctgcatattgtatgattccaattatatgacactttagaaaaaggcaagactataggcacagaaaacaaattagtgattacacagggactggaaacgggaagagtttactgcaaaggtcacaggggaatcttggaggatggtggatggattttgtatctaaattgtgatgggggttccatgactgaatatgtttatcaaaatttataaaactgtataccttaaaaaagtgaattttttatatatgtaaattatacctcaataatcctgactttaaaaagtgtatcaggccgggcatggttggtcacacctgtgatcccagcacttaggaaggctgcggcgggtggatcacaaggtcaggagttgaagaccagcctggccaagatggtgaaagcccatctctactaaaaatacaaaaattagccaggtacagtggcaggtgcccataatcccagccactcgggaggctgagaggcaggagaatcgcttgaacccaggtggcagaggttgcagtgagccaagatcacgccactgcattccagcctgggtgacagagacgtcgtctaaaaaaaaaaaaaaagtatattagctaggcatagtggcccatgcctgtaatcccaacactttgggaaaccaaggtaggagattgcttgcagctaggagtccaagattaccagcttggacaacgtagtaagactctgtctccacaaaacaaaaaattatttatttatttatttatttagagacagagttttgctcttgttccccaggctggagtgcaaccacacccggctaattttgtatttttagtagagacggggtttctccatgttgaccaggctggtcttgaactcctaacctcaggtgatctgcccacctccacctcccaaagtgctgggattacaggcgtgagccaccgcgccctgccaaaaattttttttataaactagctgagtgtggtggcacacaccggtggttccagctactcaggaggctgaggtgggaagattgcatgagcctgggagatcgaggctgcagtgggccgtgatccactgccctccagcctgagcaacagagtgggaccctgtctaaaacaaacaaacaaaaacaaacaaaaaattaggctgggcgcagtggctcatgcatataatcccagcactttgggaggccgaggcgggtggatcacctgaggtcaggagttcaagatcagcttggccaacatggtgaaaccccgtctctactaatagtacaaaaaaattagccgggcgtcgtggcacatgcctgtcatcccagctactcgggaggctgaggcaggagaattgcttgaacctaggaggtggaggttgcagtgagccgagaccacaccattgcactccagcctgggcaagagagcaagactccatctcaaaaaaaaaaaaaaggaaagaaacccaacaacaacaacaaaaaacaaaattaaagagtatctccttcccacctcactgggttactgcgaggattaaatgacagtatgcaccgtgtccttatcctcatgcctgacacattataagggctccaaaaatggtggtgattagatcataattatcttcatcatcatcattagtatttttgtcattcctatttcatttatatcagtaaattagacatgagcaagacacatttttgccattaaaaagattgcggcacatattccagccctggactcatcttagaaccaacatagcaataatccccctttattgcctattttccacactgagaactgaacatggctgatggctggagccctgcctatgtcgattataatcatcccatttcacagaccaggaaatgaagggccagagagcttgggcgacttgccagtaaccacacagctagtgagaggcagcacctgggtacggcctcggtctgtgtggtcctgaagcccatgcaggctctgatcctggcccctggctggagacacagaggttcaggatgaggccacagggacagggggcaggcagcttgcggactccagagagaagggtccctggtccaggagccctggtctggggcctggcttcccagagcagggcagttggtacctgcattcctggttggcatgtctattataccactcctgagggcctggctgggagagctgagccttgtggattcctgtccaggcaccactaggcaagccggacacagcagtgctgttgtaggcagagggaagactcggagcagtgccctttggtgaccaggcttagaagccgacagcctgggaacctggcaggccaagggaggtggctcccctggtcacaggggtcttgggtagctacgttgactcaatcaggacagtcctgtgggacgcagagcacaaggctgtcaccttggaatcttctcactcccctcctcccaccgcctccacattccgccagctccacctccctaatctgtccattgagcagctttcctcctctctgctttggtgcctatctggaccactgtgatgacctccagctgagcccctgcccctgctgcccagcaagctctttgctgtgctagagggaattatttgtttattttattttgtttattatttatttatttattttttgagacggagtctcgctctgtcgcccaggctggagtgcagtggcgggatctccgctcactgcaagctccgcctcctgggttcacgccattctcctgcctcagcctcccaagtagctgggactacaggcgcccgccacaacgcccggctaatttttttgtatttttagtagagatggggtttcaccgtgttagccaggatggtctcgatctcctgacctcgtgatcctcccacctcggcctcccaaaatgctgggattacaggcgtgagccaccgcgcctggcctattttgtttataatataataaatgctacaagcatagctgggtctcgctatgtggcccaggctggccttgaactcctggcctcaagtgattctccaacctttgcatcctaagtagctggcactacaggcattgagccactgctctcagccatgggaatttttttttaatgcaaaaatcagactgtgtctggcccactcagaacttctcgtggactacccactgcatttcaaatacaatgcagcctccacagcgtggcccgaaggtcctgcagagccaaggcctgctgacctctgacctcgagtcactttcccttcatttgccccctcccaccacacaagtctgttcccctttccaggaatattcttcctgctgcccaccttcccgctccctgcctgctcagacctactcaacctgtgaacctcagggaagaagggccctggccatctctcggtggacactgagtgatctgcagcgtgcgcacgtgggcgctgtgtctccccataaagaacaaaaggctcttggcaaccagccctccggcctctctggcccttccgcatccgcataccctggtgccaccaccaacagccagtggaaagtttaataggcaaaaaagaagagagagagaaaaagcttcctcatgctgagaaaatgggtcaccgaagagagggtctcctcagtggacactttttttttttttttttttgagactgagtctcgctctgtcacccaggctggagtgcagtggcgcgatctcggctcactgcaacctctgcctcctggggtcaagcgattctcctgcctcagcctcctgagtagctgtgatcacatgcgtgcaccaccacgcccagctagtttttgtatttttagtagagacaaggtttcatcatgttggccaggatggtcttgaactcctgacctcgtgatcccccccgcctctgcttcccaaagtgctgggattacaggcatgagccactgcgtctggccccagtggacattttggagacaccagctcatgtcagctgttgcctctgctggctccttgacctagagtgccctcgccccacctattctcttcctttaagacatagcccaaatgtcatttcctctgggcagccttccagttcccccagctataaggggttcctgcccattctgacatcccacatgcctgcacctcactctgttccaagtgtcactcaccgtttccatgtcccatctgccttcctgctccaagcacagagccagacacatagtaagtgccctctcagtgtctgcagacacaacagatctctctgtctcagtcgggcttatgtttacaaacctgaactctaaagccagaccctggtttgaatctcagatctgtgtcttcccacctgcatgaccttgagcgagtggcttaacctttccaagcctcaatttcctcatctgtaaaatggggacaataattgtgcctgcttcataggactgttatgaagacaaaatgggtcagtgcacatgatgtgcttagaaatgaatccagtacacggtgagcactccttaatattggtggctttttttttttttttttttttgagatggagtatcactgtcgcacaggctggagtgcagtggtacgatctcagctcactgcaacctctgctgcccaggttcaagcaattctcctgcctcaacctcctgagtagctgggattacagctgcctgccaccgtgcccagctaatttttgtatttttagtagaggtgggatttcaacatcttggctaggctggccttgaacccctgacctcgtaatccacctgcctcggcctctcaaagtgctgggattacaggcgtgagccaccacgcctggcctaatgttggtggcttttatatttctccctggcgtgggcctgacatttcagtttcctgtgtccagggcttactgaattgacagccgttctcctccatttccagagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctgggtaaggggctcagggtgggaaaggtggagccacagggtgtctgcctgggggtgttggcctggcctctgcaggccagtgggagtgtggacctcatgggggtgtggggtcctcacgcctacgccctcttggcatgtcagcagttctccccttcctactcttgattctttgctttttttcaattattttattttattttatttttttgaggcagtcttgctctgtcacccaggctggagtgcagtggtgcgttcttggctcactgcaacctccacctcccaggttcaagtgcttcttgtgtttcagcctcccaagtagctgggatcacaggcacctgccaccatgcctggctactttttgtacttttagtagagatgaggtttcaccatgttggccaagctggtctcgaactcctcatctcaagtgatctgcccgccttggcctcccaaaatgctgggattacaggtgtgcaccactgtgcctggccagcttctttctaatcaagagaattcgaatgagagtgatggatggagggatgacccagctccatccccagagggaaaacagtaggacattaagcacatatatcaaaaccttctttttttgttgttgtttttggacagagtctcactctgttatccaggctggagtgcagtggcgaaatctcggctcactgcaacctccacctcctcagttcaagtgattctcctgcctcagcctcctgagttgctgggactataggcacccaccaccacacctggctaatttttgtatttttagtagagaccgggtttcaccatgttggccaggctggtctcgagttcctgaccacaagtgaaccacccgcctcggcctcccaaagtgctgggattacaggtgtgaaccaccccgcccggctcaaaaccttcttctttaaatgtctcctctttgtatttttaatgtttttatttttttaaccaaaataacacatacatgtgtcatcccctcacgtgtctccttttgccatccacctgcagagacaagcgctttgagctcttctcatgtgtacttctgcatcgccaaatgatatggctacaatgcattttttaaagtaatgattttcggccaggcatggtggctcacgcctgtaatcccagcactttgggaggccgaggtgggtggatcacctgaggtcaggagttcaggaccagcctggccaacatggcgaaaccccaatctctactaaaaatacaaaaattagccgggcgtggtggcacacgcctgtattcccagctactcaggaggctgagacaggagaatcgcttgaacccaggaggcagagtttgcagtgagctgagattgcaccactgtactccggtctgggcaacagagtaagaccctgtttcacgaaaacaaaaacaaaaacaaaaacaaaaaaacaaacaacacatagttggtgctcaataaacagtcacttccagcatgaccaccactttagcctatggttagttacttcagcatccccaactcccaacccccatgccccgcccaatgtgctggagacttggcaggtggaccagtcaggaagccaactgcccatctctcactgctgccttcacccagcccagcattgctatttcctgctaccagcaggctgggggcctggttctttcactagagctaccatgcactgagccagcatctgatatgtgttaactcattccattctcaaaagccactgatatcatcttgcaggatggatttgggacctagcaagactgacttatccaaggtcacattgccgataagaggaacaactggggttcaaaccaaggcagctgggtccagagcctacgtgcttaaccactaccctcttgtcgcctctcttagtggcaaatgataaaaacccacttcctaagagttaaggcagacaggaaaatgtgtacatcatggagccaaattggagaagaaatacagctgggtgggccttaaagttagttgaaacctggaacataaacgctgccaggaccgtatccctggcccttaacgctgccaggaccgtatccctggcccttggctttctgtgcatgtaggttcggctcccagaccaaccctctccaccaagctcaggataccatctagtttcacatttcccggcatcatctgctgctgcctgaacccgaactcaccattggaggctttggcatcaataatcccaggggagggctctgactggccccgtttggcccagatagtaatccttggaccaatcagtgaggcccaggcaggagggggtctcccacaggcccggcttgtcttcagtctctggcacggagggtggggtcacgtgacaacacggaagtagccctcgcccccgcaatgaggcagtgtggtgggtggggagatggtttttcagaggaagggaggattcggactggccagaaaaaaaaattgcggtctacctaccctgcccagcctgtgagaatcacacaggcccagcagaggggaagtaagtgaggcagaagcttgagggatgggaagcaacaagaaagggctgggttggcggtgagtgcgtggagggtgtcaggaagacagtgcagtgtgttgcgaggaggagagtcagtgaaggccgaaggtggggggtcaaaccggaagacgaagcccttatcaaatgggcacgcgtctctaggttcctaaaaaacggaagaaaataaaaataaccggccgggtgcggtggctcacgcctgtaatcccagcactttgggaggccgaggcgggcggatcacgaggtcaggagatcaagaccatcctggctaacacggtgaaatcccatctctactaaaaatacaaaaaaattagccaggcatggtggcgggcgcctgtagtcccagctactcgggaggctgaggtaggagaatggcgtgaatccgggaggcggagcttgcagtgagccgagattgcgccactgcactccagcctgggcgacagagtgagactccgtctcaaaaaaaaaaaaaaaaaaaaaaaaatatatatatatatatatatatatatatataattttaatatacataaatttggagctatacacagcaaacccgtaaatgtttagttgtcagtattatagtttttaatctgaaaaataatgagtttttaataagcaacatgactttggtaatcagaaaacacacacacacacacacacacacacacacacacgagagtagctagagtcctgtacacaatttggaataagacccacaaaaaggagaattaaggtccttcctaatcctgccagaataaaccaccactctccgtgggcttccctccaagtctttttttgtctgcagaaaagtcggatcagatagtgggaaagagcacagctgggtgaccttctgtgcattacttagtctttcttaagttaagcttccttatctgtaaaatgggagtcataattttccctgccttaaagggtcatagatataaacgatgtgtgtaggaatagatatgcagatgatatgcataagtttctttgcacagtgctatgcatatggtaagttctcagtaaatattagtttttcttttttttttttttgagatggagttttgcttttgttgcccaggctggagtgcaatggcacgatcttagctctccacaaccgctgcctcctgggttcaagcgattctcttgcatcagcctcctgagcagctgggattacaggcatgtgccaccacgcctggctaatttcgtatttttagtagagaggggatttttccatgttggtttttgtctcgaactcctgacctcaggtgatctgcctgcctcagcctcccaaagtgctgggattacaggcatgagccaccgtgtccggtgacaatattagtttttataagataaactaggattattatatatatatacagtttcctagtctggtttttaacattgaatatcagcgtattcctccatatccttaaagattcctcagaaacatgattattttcgtgtttttcttgtacccatcacaggcacaaaatgtaatttacctatcagagccctgaggaaagccctgaattggatacttgggtttctcatgaggtttatcatctttacgaaatcatgcagtgatgagtgtgcttgttcatggatctttgcgtctctttctgtaacataccttgaagaggaattctcagaagcagagtgctgggtgtgtgcagtgagttggggttttgttcatcctgcagccggcatgccctccgtgctggtcataccagttgacaccccccccagtgcagtgtgcagttctcttttcaccacatcctggtccctactgggttttacttaatagagaaaaaacaaaaaaacccacaaaaccaaaaaactttgctacatatgcatttcagttttttaaaccatagaaacaatacactctatcaaaaacattttaaagaacaaaagtgggtcgggcgcgttggctcatgcctgtaatcctagcactttgggaggccgaggcaggtggatcacctgaggtcgggattttgagaccagcctgaccaacatgatgaaaccccccgtctctactaaaaatacaaaattagccgggcgtggtggcgcatgcctgtaatcccagctgcttgggaggctgaggcaggagaattgcttgaacccggaaggtggaggttgcagtgagccgagatcgtgccattgcactccagcctgggcaacaagaatgaaactccatctgaaaaaaaaagaataaaagtgtgtaaagtgaaaaatgtagggtcctggccgggtgcagtggctcacacctgtaatcccagcactttgggaggccgaggtgggcggatcatgaggtcaggagatcgagaccatcctggctaacatggtgaaaccccgtctctactaaaaaaaaaaaaattagccgggcatggtggcaggtgcctgtagtgccagctacttgggaggctgaggcaggagaatggcgtgaacccaggaggtggagcttgcagtgagcgaagatcacaccactgcactccagcctgggtgacatgcgagactctgtctcaaaaaaaaaaaaaaaaaaaaaaagtaaggtcccttctgtgcactgcccccaccaaaatcccacttccagggagatgaacattaagtttgatgtgcagacttccagaccggtgtgtgtgtgtgtgtatgcacatgcgtgcagacatgtacacacaagatgcatatattattcctttaaagataatcttctactggagtacctgcacttggatcatttctggaatcatgctacacattttataagactcatcagtcagtcagcaacatgtttgggacatgtattaatgtattagagatacacttccaagttagtccatacaaatacagcctcattctttttaagagctgcatgttatttcatagctggggtgaaccacaacttatctaaccattcagcaatgaagctccagcaacactttggatgatttccaattttccattctttttggctgttgcttttataagcatccatatatattatagatctggttttagagatggatttctacaaatagaattgctggcaaacaagtttttaaaacccagttttattttttacatatatgagtaaaggcattttagcaaattctgtctctttatttatttatgagcatgctcattcgataaacctgttgagtgcttcctgctccagataacgtgccagggatacaactgtggccacagcagaaatgatctctttctttatggaaattacagcggagaaagggagatttcccttatctccgccgcccttgtctctaatacattttaaaatgggaggagaagggggagtgttttcatcagaagagactgcatggtgaaaatcccttttgaattgctcaagggcagccatcagctatcaagggacactcccttataaactctgcggagggagcaaacaggctcagttctctgggctgcaaggtggggctgccccactctcccatctgggccccatcgtgtggggcagaaggggaagtagcagctacccaaagagctggctggtgcgtgcctgagggaggccctggggacctacggtgtgtcattgcacgttggtggtttctgtttctcgtctctcttctcaggaagggatcggcagggcctgtggtcggggagtggccaccttttgggatcctcaccctgggcctgagaggcagtcactgttcccaaaaggtttcctgggatgggatgatgtgccagcccttagtggtgtttgcgagggagccaggcccacaggggggcctggctgacccagcaggaaggtggggccagcttcccattcttaccctggaggcccaggggagccgcctgccagagtcatcagcagagccaggctctacctgggtttcctgcttctgcacctcacttgcagcacctgttggtcccacttcaggaggctgagggccccctgtcccctcttgctggccagactgtcccctgatatagcaactgctgtccagttagcactaaccggggctcagaagccagctttcctgaccactcccaggaggtgccggggggtcttagttcagcctcagccttgccccagcctgaaaaaggctggactggctcatgggccggtgaaagaatcaccatcttctcgcttttgccacgagtggaccttgcatcacagtgctttgcgtttgtcatttaatcctcaggaaaacctgcgcaatggttctgtgctatcacccccgtgtcacagatggggaaactgaggctcagaggctttgtaactgccctgcccgtctcctgccttatctgcttccacccccggccccctccttccggccaggctgtgtcctgtccccgctggtccctccagcctgctgtttcctgcctcccagtctgtttgcagttttctctgcctggaaatacctcccccagatcctgagtttgtgtctaaagtagctccccaccctgcaccccagcactgtgttcttctccctgccttctcagccctgggcccttctcgctgccaggcattccgggggttttgccaggtgcctgtcgccaccacgggaataacatgtggcatgtcaggcaggacttggttgctttcatctctgtgcctagaacagtgtcgggcacataatagatgtgcagttagtgtatgctgaataaaactgtccttcctccaaagcccccagccctccctccatgaccgtcccctcgaggtcacaccccctactgtgcactcttgagtagccccggtcctgtcttcccaacactttccatgttaggagtagatgtttgtttatttgcttactctctgctcccccaactaaactgtggattccccgagggtcctcattgtattctctgatcccggctagtgtctcgctcctgatggagcctggtgagcacctgaatgaatgggtgagtggacagtgaagcagaagagcagaggctggaaccaagttctcccgtattcaggcccagcctcttggcattgtgctgcctccttgtttcacgttgcaagtctgaaaggagctcctggatacagctcatttcaagaccaggcactggtgcccggggtggcctgaagttgtcataatgctgcagcttcttgggatgaatcgtccaaaggcagccatcatctagcaggggacacccctcataaattccattcagggagtttcaaatggagcatcccgggttctctcaaagtgttgtttcatcctgaatctatttttcagtcaagatgaaacttcaccacagaaggcaggagccctggagaaaatttctcttggtagcgctgaattcttctcttagcagcgggtgtgtgaggaaagactgagagtgttggaatgcatgtaaagatacatcttattggccggtcctggtgcctcacgcctgtaatcctagcactttcggaggccaaggcaggaggattgcttgagcccagggttcaagaccagcctgggcaacatagagactccatctctacaaaaaatacaaaaattagccgggtgtggtggcatacacctgtagtctcagctactcgggaggattgcttgagcctgggaggttgaggctgcagtgagccatgattgtgccactgcactccagcttgggtgacagagtggactctgtcatgaaaaaaaaaaaaaagtgttcatttatttttgctagtcctgcaaataatacactttatcatagcaaaggtgtggaagtctcaccacccacacacagccatttaagtagtgtggtatatttcctccaagtcagttcagtgtgtatttttcccctttttggagtgagaggggcatgattctgaccagacagtatattcaactgtgtatcccccttctccccacttaaccttttacagtaatataaatagtaatcagtaaggccgggcgcagtggctcacgcctataatcccagcactttggaaggccaaggctggtggaccacctgaggttaggagttcaagacaagcctgggcaacgtggtgaaactccatctctactaaaaatacaaaaattagctgggcatgtcggcacatgcctgtaatgtcatctacttgggaggctgaggcacaagaatcgctggaacccgggaggtggaggttacagtgagccaagattgcgccactgcactccagcctgggtgacagagcaagactccatctcaaaaaaataataataaattaataaatagtaataaataccgcccaggttggagtgcagtggcacaatcctggctcactgcagcctctgcctcctgggttcaagtgattctcccacctcagcctcccaagtaattgggactgcagggacatgccaccacacctggctaattttttttttttttttttttttgagacagtctcactctattgcctgggctggagcgcagtggtgcgattgcagctccctgcagcctccacctcccgggttcaagcgatttttgtgcctcagccccccaagtatctgggattacaggcgtccaccaccacacctggctaatttttgtatttttagtagagactgggttttgccacgttggccaggttgatctccaactcccagcctcaagcgatctgcctgtttcagcctcccaaagtactgggattacaggcgtgagccaccctgcctggcctccatttttcttaatctatataaaaagttttaaaatcactgcctgatagccaagcaattatggttgtttttagtgtgtcactattattataattttataatggcactgttattataatgggattttgattaacatcattatgcatttttttaaatttaagactgtttcattagggcagagtcctggatttggaattactggattaaaatggtatgggtattttaaaggttcttgctatttattgccaaattgctttcctgaaggctgctgccagtgcaggctctcgttagtagagaggaaagtgttcatctcggtacttcctctcagcagcagatagtcttacatttttaatgctttctaatttgctagatagaaaatggcatctgttagtcgacttggaatgtgtacccctgagtccacatccccggcttttaccccagggctatgggtggaaaacgctagctgagattttgtcttgcagctgactttggtgtgtctgccaagaatctgaagactctacagaaacgagattccttcatcggcacgccttactggtgagtcgtgtagcttctggaaatggaatggactggatgtaaaaactctccaaggtgaccaccaggcgctttagacagagaggggccggaagacaagggctacacgccctgcctcgtggcttactagctgtgtgaccttggacaagctgtttagctttcccgtgcgtcagtttcttcatccataaaattagggatataatggcccctacttaataaggctactgtgagaatgaaatgaaatggtgcacatagaaggcactccattaataactgaactagaatccataaaacaggattcagttcgtgatttattcgccacgtatgtattgagggccggggatggggaccgtgaaggtgaacagtacaagttcaattcctaccgtcatgtgaagtctccctggacttctgtagtctgtcgtgtttccttcttttccagaactattactttaaaagcaaaacactgtcactcaatttcacgcctgactactctctgtttgccgtgtttccaattttttcatgtgcattacttgccattgtgtagtttgggctcctttcttgcttgcttgttactcacccttgctctctctctccccccttttatacctgtttctcctctctgtgctggtgtcttctcgcccacccacctccacgcccctttttttttgctccgcaccttcccctccgctcccacccgccccctccccaggactctgtgttccgggttgctgctgccatctcgcggtaggcatcggaactgcagcaggacgtggcggggagccgcgtggaggcgtttttctgtggaagagcgtcctaaggaagacagtgggatgcaaagtcacgcagatcatgattcgggagtgctgccaaccccgacagtggctcgtggtggcccttgaccctgaatgtccaagaagcacctgtaaaggccagattcttagccctatgttgtcccttggttggttcaggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcagaccctcccacgctgctcacgccctccaagtggtgaggggcaggggcagggccacctgccggggtgcctgcgccgggattagggctggaatatgtggtggacggggctggggaggtgcagtggtagcgttctcctggtgctgctagctccaaaggagaggttggggcctgggggtcttcaggcgtttctgagccccccgggcccttcgtgcctctttttccctttgtgttcctttttttttttttttttttttctgagatagggtctcactcttttgcccaggctggagtacagtggtgcagtcatagctcactgcaacctcgacctcctaggctcaagagatcctcacacctcagcctcccttgtagctgagagtacaggcacccaccaccatgcctggctaattttctgtagagacaaggtctcctatgttgcccaggctggtcttgaactcctggcctcaagggatccgtctgcctcggcctcccaaagtgctggaattacaggcgtgagctaccgtgctgcctctgtgcacttgacatgagatcttcaccagagcaaaccaagtcacccaaataagctggctcccactggggaacaggagccccagctgagccgcaggagccacatggcacaccctgggcgggacatcgggggcctgggttcaaatcccggcactgctgagtctcctcactgcgtggcctgggcacgtccctgctcctcgccgatgtctgggtccccatctggacagtggtgtccatgatgaaaagggcgtcgtgtaggccctgtcactgttttagcttgtgaaagtttcctctgtcctttgaggggcatgattgggacagtggagtctgtgacgtggggggcttctctctgctcttgcctcctccatgcttacctctgacgcctgtcctcccaggtctgtagagttccgtgacttcctgaagatagccctggataagaacccagaaacccgacccagtgccgcgcagctgctggaggtgagtggattcccctcccactctgctccctgaagggtggagcctaatgaactcaccagtgacctggacgctgggcatgttctcaccccgcccagggaacagcatggacagctgtttgtccatcagcgggtattccccaggcacctcctgaatgccagctctgtgttgggagtgccttggggaacgaagccacccagaccttgtcctcatggagcgtgtgttccagtggggatacaggtggcaaataagcaagtatgtgtgcatggcagggggtggccagtgccacagaaggagatccacagtgcaggggtggggcgcctgggatcggctgttgtcttgtaagggaggataaggaagggttctctgggtgagcagatgtccataggaagggaaggagcaaggccagtggcccagagggagaggaggcaaatgcctgggacagcagcatgttccacacatgctgggaagagccagggggtgggggtgggaggtgggggagcaggagcacaggggccaggggaggggagacgagagcggagaggcactggggcgtctgtcccaaggctcgatggttccctaggagaacacctggcctcagcatattctctccccacaggagacttaggacagcaaaagcacagagagaactcagcccaaggaggaggtgcgtgggaaaaggtcttgggagccaggtgcaagcttccagggccctctcccagtacagtcaccaggacagcttaattctctgtgctgtccaccacggaagccccttagggtttttagtgggtagtggtcacataagcaccccctgcctggcacagaccagagttccagactctagaaggaaaggaggtattccacctaagccatattgtttgcagaacagtttaggcagagcgggccactcttattagttaatggtgggagccgtctcctagtttgcagagaccagctgaggatccaaccttgttagcggccctttctgaagcttgctgtgctattttctgcacacagggtcctgcagggccttgcaagccagagccaggtcctgggctttatctgtgcattaggggagacacagcatcgacatccatttacaagggtcttcctgccttctggctgctgtatgcgggatcaggagactctgagcatctcattagctggctgtactgccttagaatgggcaggtggataatggtttcccttgaagctttttgaactattggagggagctgtgagccactctttgcctgggcccatgcctcgagttagggcgtcatggctggaggctgggtgaggtcggtgtgtccacagcagtgttctgagggctgtgcacagcacttgcccggtcatttgcaaatctgccgaccagtgtccccatgtcactgccactgatggaagagggggaggaatgggcctgggtgatgcaacagggctgccctttcactgccgtgtcggctccggtcctgccctcagcatgacagccttagaggtgcagtggcaggaaggggaggaaggcgccacaccaggcacttgagtctttgtattcacccagcttttcccagcttcctactgtgtgccatgcacctgggcctgtggtcggcattggtgagcctctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttaccaggtgccttggttctagagtctacagccagcactcttaactgcatgctactttgcctcctatgattagtaaacccttaacgccccactcaagacctcttaaaagtacagagcagccagaatgacatctctaaagggtagtagtgaatatcactgctgcactgcagcctgttggtggcttgtgaggacagtctctgtggctcacctgcacacacggcccatccttcctctgcatcctgtgtgtcccaccatcctgcccgtctcatggctcctgccgcccaacaagctcagtccagtctcagggccttctttgtaccagctgctccctctgcctggaattctctgtgcccagatctttcccttgggtctcagcttgaatttgaccttgaatgaggcccctctgcctgcagactttagtctccaccaccctcagctatacaagatctggaattctcttgtttatcatttgagccaccgcgcccggccaaatgaactgttttaaatgaacaaacagataagaatgatttgtgatgaacatatacgttctgaatgtgttttccaggtgctagaaatttgttttttagtcgtttaaatacttccccagcaatcttgttgacacttcctccccggataaattgtctgagagtaaaaacagtgaatttcatcagagccttcctgtatattgtaaatgagcaaattctagcttcatgatgcctcccaccccaccccatcattcctttcccagtggccttcggtgagcgtggtgggttgaggaatcccacatccctggctatacccgggtgccctcactcaggatacctcacactgacttaatatcgctgagaccttttgctttggcgttttgcaaggtccgtaaaagaacattcacttttaaataagactctgacatttgtataaaaacctagaatagaacatacaccactctgcctcaagatcttgtatttcctttcttaaaaccaaacacatatgtccacccaaagacatatacgagaatgtctcttgcagctttattcatagttgccaaaaatgggaaacagcccagatgtccagcagcagcaggatgaataaacaaactgtgccgtagtcatacagtgagaccctgcacagaaataaaacaggaacagtttactgaaataggcgacaatgtaggtgaatctcacagtcatgacgctgagtaaaggaagccaacgcgaaagactgcacacacgatgctctgtttctaggaagctgaggagcaggctcccgaggctggcggcgtgggagtggggttgcctgccaagggagacgggagccttccccggtgatggaaatgttctgtatcttgagctgggtggcagttacggtgcgtgcatatatatgtaaaaagtcattgaggctgggcacagtggctcacgcctgtaatcccagcactttgggaggctgaggcgggtggatcacttaaggtcaggagtttgagaccagcctggccaacatggtgaaaccccgtctctactaaaaatataaaaaattagcctggcgtggtggcacatgcctgtaatcccagctacttgggaggctgaggcaggagaatcccttgaacctggtaggtggaggttgcagtgagccaagattgcgcaactgccttccagcctgggcaacaagagtgaaactctgtctcaaaaaagtcattgagctttacaacctgtgaactttgctgtaggaatgttattcctcaacaaaatgtatgtagcatattttataaaactatatattaaaaccttttaaaaaggaaaatagacaccctcccttgcaaacacggcttgagcccctactttgggctaagcattttcaagtgcatgatctcatttaatccgcatgacctccctgtgggttcattgttaacgtgtccacttgagagatgaggagcctgtggctcagagaggttaagtgacatgctcaaggtcacacagccgctgagagacacagctgggatctgccctctttccaacacacttgggactttccaggctgtctctgggtctccaagttcatgtgcacattttgctcaggaatgaggctggccttttctgccccgggggtgagctcccccagcctcttccaccccaccgtgaccccagagtggttctaatctgggtgcatcttgccccctcagcatcccttcgtcagcagcatcaccagtaacaaggctctgcgggagctggtggctgaggccaaggccgaggtgatggaagagatcgaagacggccgggatgagggggaagaggaggacgccgtggatgccgcctccgtaaggccagggagagtggggcttagcgggggctgggaggacaggatctcagctggccctgctggtgtgggaggggcagggaaggccaggactctggctcaggcaatttattgccagctcagaggttgcagactcccacgctgcaggtaacgtaagatggcatgtgggccggggtgaggcagcagggggtgttggccagatcccgatcctgtgagttttcaggagataccagagatctagattttcacatgaaatcttccaatttttaaaagttggtaactgattcatggcttcccatcctttgttcctgtcacagctcacataccaaatgagactgtttttagctcattttgggataaatatgggaggctgcatatggccacaggcaacaccctggcccccctctagctgccctcagtgccaaggggacccatgtctgggcacatttggaactcttttgcagcttcagtgcttgctggatttagattgaaattaaagctaatttaaatttgtaaaaaccctgtgagccaaggaaaacatgtctgtgggctggattctggcccaagctgttgctccgtaatccctggccttacttggggaggcctcttcccagggatagggtggccatcccggtggctccctgtgcctagagaagcaggggctggacttacccatcaggggatggagctggcccacatccttgtgctgtggacggcactgcagcttcctcaaatttaattcagtcctgggtggagcctgaggctggcgcagaccctcaccagggtgaagaaggaaagcccgaagggcagggcaagcggaatcatcacaaccacccccgccatgcatggagcccctggtggctgccgggccctctacagctctgacacagggtaaccaagctccagcttacagacaggaaaactgagatcgatacagtgaagtggctggctgagccgatagatggcagggccaggggtggatttggagtaggagaacctcagtggggcctggctccaggaggaggtagaaagcgctcacacctggcctcattgtctgcatgcaggaggctgatctttgtcctgtgggtattgggagccccgaagggtttcaggcagggactgggtattggggtggaggtgacagaatcagatctgcgtttttgagccatcactctgggtgttgactagaaggtagattggagttgcttccaccagctgccatagctgaggttaaaaaccggtggctggcaagacccaaaggaatacttatagtataaatccattcataccacgtttataagcaggcacagctcatctgtagcacttagagaccataggacagtgactatgtcaagaggtgggagagcattgccactgagaaggacggggcggcaggggatggccctctggggcaaagcaatgtcccctcctgacctggaaagtggctacatggatactcactctattcaccaagttggatgtttatgttttatacacaggaagaatgttctgtttcaccttagcatagcaacatttccagtactttccacccaacaaagactctaaaaaacaaaaatgaagctgaaaacttagtggccacaagggctgaatccagtccccagacaggcttggcttggcctttatatgattttttaaaaaatatgagttagttgccacctaaaaattaagagatgtccattaaaaacctagatttcaaacttgtcttaaaaaattggaaggtttggctgggtgcggtggcacacacctctaatcccagcactttgggaggccgaggcgggcagatcacttgagtccaggagtttgagaccagcctgggtgacatactgaaaccctgtccctactaaaaaatgcaaaaattagctgggtgtggtggcatgcacctgtagtcccagctactcgggaggctcctcgggaggctgaggtgggaggaccactcccaggtgggaacccaggaggtggaggttgcattgagccaagatggcaccactacactccagcctgggtgacagagcaagaccctgtctcaaaaaaatagataaataaataaaataaaaaattaaaattaaaaaactgggaaggtttggccacaggggagccattttcccacattgtcacaattggctggaatggagcggccactgacccctccctgtgggccatgagctggccagctggccacagctgcctcctagcaggaataacagctattacattcagctgagattagagatagtgaggagattgccatgcctcaaaataagtagtaattgtattacggttaggcaatagggagtgctgaagactggctagggagatatctgctctcctttcttggcgctggcccacttcatcttgagggtgtctgactttctccactgcatctctgactcttgccttgaacatacagcagcatggcctttaatatatatatatatatttttctagaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcacctgccaccatgcctggctactttttgtatttttagtagagacagggtttcactgtgttggccaggctggtctcgaactcctgaccttgtgatccgcctgcctcggcctcccaaagtgctgggattacaagcgtaagccaccgtgcctggcaagaacgcagctctttctgacaccatgtcctggatgcatgagaggtgctggcagcaaggtaggggaggcctcagcacagtttctgaaggctgagatcagggaagagcaagggaataagctcagaacccccagctcctaggttaagttgaggcaagagggacgatggatggccacatctctctgggggtggttctgaagctgtgggcccagcagagctgtggcctcacctgctgcgacagccatgggtccttagctgaaatgctgagacttgtctaatggttttccctggccaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcaagcctgggaagggccaccaatggtggtaacagggtggggctatggtaagaggagtgggcattggtcctttggtgagagggctgtctgtctacagcatgaagtgggggaatcaaggaggcaaaaggaaactcattttgcctgcgatcctgcactcccccatctacccaaccgttcacctatctatccactcatccattcatttattcacccatctatccacctactcacctatctacctattcatctatccacccatccgtctacccatccttccacccactcacccctccacccatccacctatctacccactcaactttccatccatccatccaactgtccacccattcatctacctatctacttaatcatccatccttccattcatttatccacgcatcaatccacctactcacctgtctgcctatccatctatccacccagtcattcacccatccattcatccatccattcatccactcatccactgattcatctacccactcactcaccttccatctatccacctaacaatccacccatccttctactcactcaccattccatccttcccttcatctgccgaattatccatctgtttatctatccatccacccaatcacccatccgtccattttatccttctatccatttatctacccatctatctatttacctactccctatctacctttccgtctgtccacccaatcatccatccagtcatccatccacccacccactcatctacccattcagccttccacctatctacctaaccatccatccatccatccatccatccatccatccatccatccatccatccatgtatccaccaacccaccaggttggagacaaggtggtgacccaaatagataaggccattgcccttgtagaacttacacctaatgggccaacatacagtacacaagataatccctgattgtggtacatgccatgaaacaagtaacaggtgacatgatagtgagtgcttggagtaggggaggctgctccaagggaagcccctgagccaggcctaaaggataaggggaggagagctgggggagcccaggggaaattgcagttgctgaggccctgagggataactactcagcttgtttaagggactggtggagggagagagggagatcttgactaggatgggcaggctctgggctcaggctggggcagtggccggggaagagggaaaaacatggtcagatttgacctacattttggaggcaaaaccagtgagttggtaaaggactggaacagggaggaaggtgtgaggcaaagctgtttgctaggatcagctttatacttttcagttgttcatcccccacttacagccctccttcgggagaccctatttccacattttttaaacaaatgaggaaacactatttctgggcaagtaagtcacttgccctgggtcttccagttaggcaggggtaaagctgagattctaactgggtctgtgtgtgtgagaattccttcaggtttcactggaccatgtagctggcaggggttgggggagcttaacacttagggaggccatggagccacggagtcccctgggggccaggcctttgcagggtaaattcatggttagtgtagagaaaatttctagaacattaatcacatatttttatacatgtgaattaaaatttttttaattttatgtatttatttattttttgagatggagtctcgctctgtcgctcaggctggagtgcagtggtgctatcttggttcagtgcaacttctgcctcccgggttcaagcgattctcttgcctcagcctcctgagtagctgggactacaggtgcccgccaccatgcccggctaatttttgtatttttagtacacacggggtttcaccgtattggccaggctggtctcaaactcctgaccttgtgatccgcccacctcggcctcccaaagtgctggaattacagatgtgagccaccgcgcccggcctaatactcatatttttttaaacgtttaaccatgcagctgggcacagcagcacacacctgtaatttcagcactttgggaggctgaagtgagaggatcacttgagcccaggagttcgagaccatctgggcaacctagtgtctctacaaaaaaattttaaaattagctgggcacatacctgtagtcccagctactcgggaggctgaagtgggaggatcacttgagcataggaggtcaaggctgcagtgagctgcgttcatgccaccgcactccagcctgggtaacagagcaagactctatctctcaaaaataaatttaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagaactccgtctcaaaaaaaaaaaaaaaataaataagtaaataaatttaaaaaataaattgtaaaaaatgaaagcataggccaggtgtagtggctcacacctgtaatcccagcactttgggaggcctaggcgagtggatcacctgaggtcaggagttcgagaaaagcctggccaacatggcaaaacctggtctctactaaaactacaaaaattagccagctgtggtggccggcgtctgtaatcccagctactcgggaggctgagacaggagaatcacttgaacccaggaggcggaggttgcagtgagccgagattgtgtcactacactccagcctgggcgacagggtgagattctgtctcaaaagtaaataaataaataaataaataaataaataagccaaaaccaaataaaagtagttttagatgttgtggatctcttctccctctaggagacagaggnnnnnnnnnnnnnnnnnnnncacacacacacacacacacacacactggtgtcatctgtgtgggtcgggaggctagggcacaggttgctttggcagatgaaaccaccttctgttctaatggtcacctgagaggcaccctggactctgagtttcaacctcaagagctgggtttccatcacctcccctctgggcaattgaagttctcagggataaattctagattggccacaccccatggagaagcagtgctctctggccctggctgtggttccccaccctcctcctgagcagagcagctgtgtgctactcagggtcaaaaggggagacctcgaggaggtgaagaggtgctcggcaggaaccgggattttctcgcttgcctgccgtggtctggaggtctgagcgcctgtaaactaggccaggccaccagaccacaggggtgtggaaggccctgatcatcccctgctggcccaggcccctggtcatacctgacccctggcgtttttggagaattgggtcacacctaggcatctgaaccatgtggctgagcatttatcacattctcagactgatgaggcttccgggcagagttcctcctgtccttccctaaaacggcttctgccgttccctcgctcttgagcctcagccttctctttgcttgcctttccttctgagagcacaggtggaccagggagtgctagagctggctgcctgccttctttctgtactccttttaggctttttgtcagttcttctctaaaccttagtttctcttgagtcaggatttccatttcctcgttaacactctcaaaacctgcctcctctcttcccactttccagaaaagcagaggctcagacagtcttccctctgtggctgtagaaagcgcctctggcttttcccagaggcagggcagccattgcctcttcttccttggtagaattcgaccagttgccatttacagagtgctggtcatgtgccacgtgggcactttacctgtgtcatctcatttatccttcaaaggacccaacaggtaaagattgttagcctcattttgcagaggagggagtgagtcccacaaggataagtgactccccgagcgggcacccagctggaaagctgactgagcctagattcacacaggggcgctgcgaccccagagaatgctcttggcctcgctgcactgcccaacccctccttgtgctgctcttggggggcagttctgtgagcagttatggcccctccgagtcatgaggaaggccactggggtcagagcgtggcctcatgggaatcagcatggtgccgcactggactaggacacaggcctcacggaccccaaccctgagaggccgccaggagcctccagttcagtcaggaggcctaggttctttctgtagtagtttggttttttctttttttccgattatatgaatgatatgtagcaattttctctctcttttttttttttttgaaatggagtctcactctgtcgcccaggctggagtgcagtggtgtgatctcggctcactacaacctctgcctcccaggttcacgccattctcctgcctcagcctcccaagtagctgggattacagacgtgcaccaccatacctggctaatttttgtatttttagtagagatggggtttcaccatgttggccaggctggttttgaactcctgacctcaagtgatccgccagcctcagccccccaaagtgctgggattacaggtgtgagccaccgcgcccggcctacatagcaatttttaatggatttgctcattaagaaacgtggttaacacttggggcttatccctccgatattttttctgtgagtacacacatacactgacaacataaatatatatatataattagggcatgttgcttaggtcaatttttttttctttttttaacacaggatcttgctctgttgcccaggctggagtgcaagcggcatagtcacggctcactgcagcctggacctcctgggctcaagcaatcttccggcctcagccttttaagtagctgggaccacacacatgcaccaccatgcccggctaatttttgtatttttggcagagatgaggtctcgctatgtggcccaggctggtcttgaactcctgagctcaagtgatcctcccaactcggcctcccaaagtactgggattataggcatgggccaccacgcatggcctaggtcaaatttttattatatattttttagcagataataaaggttaaacatcccaaatcaaaaaatccaaaatccaaaatgctccaaaatctgcaactttttgagcactgacatcaaattctcactggaacatttcggacttcagattttcagattagggatgctcgttcagtaagtataatattctacaatctaaaaaaatctgacacccaaaacacttctggtcccaagctttttcagtaaaggatactctacctgtataaggtccatggttcgaaattaaaaaaaaaaagaaagaagataaacagtgaaaaatttccctcttcattttcctaccagaaatccagttccctttcctgtgttagtgttttatggtttaatccttccagagatactagaaaagtaaacaatacatatatgtgtgtacagagacattgttgtcctttttctcccagataaggtggcataacagacctattctttaatatcttgcttttttttacctagagattactccatatctgttcataaatattattattattattattattattattttgagacagaattttgcccttgttgcccaggcgggagtgcagtggcgctatctcggctcactgcaacctccgcctcccggattcaagcgattctcttgcctcagcctcttaagtagctgggattacaggcatgcaccaccacacccagctaattttgtatttttagtagagatggggttctccatgttggtcaggctggtcttgaacccccgacctcaggtgatccaccctcctcggcctcccaaagtgctgggattacaggtatgagccactgtgcccagctgaattattatttttaatatgtttccttatgtaattaaacattttctaaaacttgatttttttaaggttgtatagaattccatcatatcaatatactttatttacatagacctatattgatggacatttgcttccaattttttactaaataacattcattttaaatgactgattattctttttttttttttttttcttttttttgtgttgttgagacggagtttcgctcttgtagtccaggctggagtgcaatggcgtcatctcggcccactggaacctccacctcccaggttcaagcgattctcctgcctcagcctcctgagtagctgggagtacaggcgtgtgccaccatgtccagctaatttttgtatttttagtagagatggggttttgccatgttggccaggctggtctcaaactcctgacctcaggtgattcttctgctttggcctcccaaagtgctggaattacaggtgtgagccaccacacccagctgaatattcttattcagtggttttgtgcatctataaatatttctttaaaatcagtatccagaagtggaaactactatgtcaaaaaacataagcttattaccaaattgtcctccagaaatgtaccagtttctaccatcaaattttctacatcatgaaaatgtagtttctacatcaaattttctgcattatgttttctacatcaagaaattatagtttctttttcatttgtattttatatctatataggtgattctaaaatttctttttatcttttgcttcatgtctgttcatgttctttgccactttttttggttaggataatcttcctttttattgatttgtaagcactctttatttattaagattattaaggttttgtctgtcaataaatatcaaatgaagcctgagttctagtcatgcctgtgccccagacttgtgtgattttgctccatgatccaaccttcagtgttccaagttgcaaatattgtgatctctgaagccagtttcttactgtgaaatatctgtatcctttaacctttcaggcgccaggaactccgagagcttcggctgctccagaaagaagagcatcggaaccagacccagctgagtaacaagcatgagctgcagctggagcaaatgcataaacgttttgaacaggaaatcaacgtgagtgcgagaaaagatgggaccctgcagggcttcttgcctccaggtgttctctcagtggaagctacatagtgggaatgattgggtagtggagagtaattcacaacaattgcccaattcctgggggcttcccgatcttgttaggcagtgacttgttaacacagaaccccgtgaaggtcacagcgatcctgagtcccacaggaggatctccagaggggaaataacctgtattgagcaccgtgcaacaacacatggtctggtctcccttttgcagatgaggaaatggagactcaggctaagtaacttgccccaggtcacacagcaacggggtagtagagctgggattcaagcttaggtctgatcacaagctctgagttctccccattccacttcccatgtccctcccaggtataaagtgacttcgctaagtttctcagaatttctgctcctttcaggccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgagtatgtgctcagtgggggcaggggcatctcggagtattaggggccttcttggttgcaagtgatcgtggcctcaacctcaccttggcagcagaggggtacggctgaagagctcgggagcaggtgagcctggatctgtgtgcccaagctgcgccatgaggagccacttctccatcttctgaactctgctttcctctgtgttgctatggctcagggcaggcctcaccctgtggcctcaggcagcttcctttacatcctcccagcttagcaacccctgccgagaaagagcggggaagaaggaagggctggtggtccgggggaatttgagatgctgttcccagaagggcgagtgggtgctgggtgggtaggcacatacaacatgccctctatgctccaccctctctgcctcctcctcctccccatgttggaaggggaaggggaggatggaaggaggtatgtggtcctgaggcacatctctcgagctgctctggagagaggcatctgagtgtcaaagaacagcccatgcctccctctgtggaggaaggagacaagcaggctggaagcccccagggcaggaacgccagtccaggctgttcccagtctcccaactggtagcagtggatgagnnnnnnnnnnnnnnnnnnnnnnnnnnnnnnnnnnnnnnnnnnnnnnnnnnnnnnnnnnnnnnnnnnnncatcccagaggccttgggaagctgcctctgggagccagggttcctggccagctgagcagttgaggcagtcaccttaggcacagatatacctcggagatactgtgggtttggttccataccaccgcaataaagcgaatactgcaataaagccagtcaatattcagtaaaccatgctgtacacagatgtgctgtcacctgggctttgtggcttcatttttagagcacaagcagagtagatttagcctgattttttttttttttttttttttggagatggagtctcagtctgtcacccaggctggagtgcagtggcacaatctcggctcactgcaacctctgcctcccgagttcaagcgattcttctgcctcagcctcccgagtagctgggactacaggcacgcaccaccacgcttggctaatttttgtatttttggtagagatggggtttcaccatattggccaggctggtctcaaactcctaacctcatgatctgcccgcctaggcctctcaaagtactgaggttataggcatgagccaccatgcccagcttagcatgattcttaagggccctaggattttcaaaatggtaaatgagcattggcttcaacttcaagtcaccatcagcatgaaaccctaacaagagagtcagcctgtcctttgaagctttgaagccaggcattgacttctctgtagttatgagagtcctagatggcattttctaccaacagaaagctgtttcatctacattgaaaatccattgtttagtgcagccactttcatcaatgatcttagctaggtcttcaggattactcactgcagcttctccgtcagcacttgctgctgcaccttgcactttcacgttatggagatggcatcttttcttgaacatcatgaaccaacctctgctagcttccagcctttcttcctcagcttcctcacctctctcagccttcacagaattgaagagatttagggccttgccctggatcaggctttggcataagggagtgttatagctggtttgatcttctacccagaccactcaaagtttatctcagcataggctgttttgctttctcatcattcgtgttcattggagtagcacttttatctttcaagaactttttctttgcattcacaacttggctaaccgtctggtgtaggaggccttccttttgacccagtaggttttctccatgccttcctcactaagcttcatcatttctagcttttgatttaaagtgagagacacgcaactcctgctttcacgtgaacacttagaggccattgtagggatattaattggcctaatatcaatatcgttgtgtctcagagaatagggaggcctgaggagaggggaagagacaggggaaaggccagtctgtggagcagtcagatcacattcaacacttattgattaagtttgctgtcttatatgggctcgtggcaccctataacaattacaggagtaacatcagagctcactcatcacagatcgtcataatagagataataataatgaaaaaatgtgaaatattgcgagaattaccaaaatgtgaacagacaggaagtgagcacatgcttttggaaaaatgacactgatagacttgctcgacacagagttgccacaaaccttcaatttgtaaaaatgacagtatctgcaaagtgtaataaagtgaagcatgaaaaaatgaggtatacctgcacatttcagaggacccaaaaactcagtcatcaagataaaaaaaattttaatgcagccgggtgccatggctcacacttgtaatcccagcactttgggaggcccaggcgggcggatcacttgaggtcaggagttcgaaaccagcctggccaacatggtgaaaccccatctctgctaaaaacacaaaaaaattagtcaggcatgatcacaggtgccttaatcccagctactcgggaggctgagcaggagaactgctcgaacccaggagacggaggttgcagtgagccgagatcatgccattgcagtccagcctgggcaacaagagcaaaactccatctcaaaaataaataaataaataaataaataaatatatgtatatattctattaatttccggatctgttaatttccagagaagccagacaaacaaacaaaaagtccaatattgaacaaataaaacagttgccaacatgctagggaagcatatagactggctgactagagatctggagagatctgctttagatgggtctgggaaagcctctcagtgtatgacatgtaagctgagtacagaaggatgctgggaggcctaagaaccttccaggagggtgggacagcacctgcagaggtcctgaggtatgagaaagagcttggagtgttcaaagagctggaaaaccatccatgtagcaggagcttaggaagcaaaggggagattggcacaaggtagaatcagacaggtaggcagagaccacgtagggcagtgggccacaggcaggagtgtgctattttaataatcctgttaacatcctgtccttacatagatgttttagcattaaatgagaagtacattcagggttagacccagtatctgcttggaataagagctgggtagatgcccattccctccttggctctgcgccctgtcacatgtgcacaccgtgtgtgtgtgtgtgtgtgtgtgtgtgtgtgtggacttataagagtgggagagagaggaggcgacagaggaagttgcctagtttaggaggggatgggggaagccacagatctcctcaccctttcccagaacttgcccttaacaaagttggacttcctcaccagcagggttccaggaaggctctcgagcctgcctctgaacgaggcagagcgtgggatctggcacctggggttccgctcacattcagttttttcaaatatctttttctatgggtgtttttcttcaagaagttttcatggaaagaaagagcttaacttctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggagagcagtggtgcaatctcagctcactgcaacctctgcctcccaggttcaagcgattctcctgctcagcctcctgagtagctgggattacaggtgcgtgccaccacacccggctaatgtttttgtatttttagtagacatgggctctcaccatgttagccaggctggtcttaaacttctgatttcaggtgatctgcccgcctcagcctcccaaagtgctgggatacaccaccgcccctggcctgtttcttcttaagtaaactttagtagcttctgtctttcaaggaatttgtagatttcattttaatactcaaatttattggcattaaatatttcctgactatccttttaatgcctgtagcatctatagtgatgttctttctttcatccctcatattggtattttgtattgtcatcttctcatcctccttctcctcctcctctcctcctccttccctgtcagtctaattattaattttattgaccttatcaaagaaccagcttttggtttcattgatttttctcttttcaatgttattgatttctgctgttatattagtcttgggtttaaattgctcttctttttatggtttcttaatgtagaagctcatttagaacattgatttgagactattctttaagcacttaatgctataaatttcacttaatgctataaatggagcactgttttagcttcattccacaaatctttatatgttgtattttcatttttattcaataccaattactttttaatttcctttgcaacttcctctttgacccaggttatttaaaagcttgttgtttaattttaaaatgttttggggctctcatatctttctcttattgttttttagtttgatttcattatgatcaaatcaaataacatatatatatagatatatagatatatatatatatatttttttgaggtggaattttgctcttgtcgcccaggctggagtgcaatggcatgatctcggctcactgcaacctctgcctcccgggttcaagtgattctcctgcctcagccccccaagtagctgggattacaggcacatgccaccacacccagctaatttttgtatttttagtagagacagggtttcaccatgttggccaggctggtcttgaactcttgacctcaggtgatccacatgcctcagcctcccaaagtgctgggattacaggcatgagccaccacgcccggcccatatattttttaagatttcagtttttaaaaatgtattatggcttgttttatggtccgggatgtggtctgtgttgctgagtgttccgtgtgcacttgaaaaggatgtgtattctgctgttgttgagtggagtattctataaatgtcaagtaggtcaacttaattgatagtattgttcaggtcttctctattcttactgattttctgaccacttgttctactggctactgagaaaggaatgttaacatctccaactgtaattgtggatttatctatttctcattcagttctgtcagcttttgtttcacatttttgaaattattttgttattttaaatagtcacattttcttttatttatttatttgtttattttctttgcaatggaagtctaactatgttgcccagagtgccctcaaactcctgggctcaagtgatcctcctcagcctcctagactttagctaagactaaaatagtcatattttcttagtgaactgagtcttccttttataattatataatgcccatcattattcctgataatattccttgttctgaagtctaccttgtctaataaatagccaatcctactttcttttgataagtgtttgcatacagtatcttttcccatcctttcaatttaacctgtctaaatctttatatttaacatgggtttcttgttgacagcatatagttgtgctttcattttttttaatcccatctgaaaatctttgttttttagtagaggtgtttatggcatttatatttaattaaattattacctgttttgtctcctttggtttttgttcctctcttccctgtttttctacctccttttgaagtatttgaatatttttagtattattttttaattcatgaattagtttatattttatgtgtgtgtgtgtgtttgtgtttaatggttgctctggggcattataatatacatacctatctcagcatctatttagagttgatattgtaattctttaagtaaaatgtacctttacaaccatgtaaatttcttgatactttctcaattttgttataattgtcacgtttttggttttgttttttttttttgaggcagagtcttgctctgtcgcccaggctgaagtgcaatggtatgatcttggctcactgcaacctctgcctcctgggttcaagcagttctcatgcctagagacagggtttcaccatgttggccaggctggtcttgcctggcctcaagcaatccgcccacctcagcctcccaaagtgctggcattacaggtgtgagccaccacacctggcctatcacatgtattatatctacatatattaaaaaccataccagacaatgtgacaacttttgctttaaatggtcattgagattttaaagatcttaagggaaaaagtgttgattatgtttatccagatatttaccatttctgtcactctttcttttttactgaagatacaagttttcttctcagctcacttcttttcaacctgaagaacttccaatgtagcctttcttcctgaccacaaagtttcctactttccttcatctgaaaatgtctttattttactttcatttctgaaggatagtttcactagacatacctatctcagcactttttttttttgagacagagtctcgctctgtcgcccagactggagtgcagtggtgtgatctcggctcactgcaacctgtgcctcccgggttcaagcagttctctgcttcagcctcctgagtagctgggattacaggcgcctgtcaccatacccagctaatttttttgtatttttagtagagacagggtttcaccatcttggccaggcttgtcttgaattcctgacctcgtgatccacccgccttagcctccccaagtgctgggattacaggcgtgagccaccgcgcccggcccttctttcagcactttaaggatgatactccggtggcttttggcctccctagtgtctgttggggaatccatggtcactggagtcattattttcctgtgttaatatgtcacatttctcttaactactctcctgaatttttttagtgtttggttttcaagttttattatgatatgtatgagggtggttttcttttaatttaacctgtttgggtttcattgagcttttgataattttcccataagttcctgaaaccttcctctttttcatctttttttctctctatcattcatattatataatctttattaatcagtcttcaaatgaatgaccctcctctgtgatcaccattccactattgttttattttaatttcagacattgtattgtttagttttaaattttctaattttttaaaaaatagtttttctgggctgtgaactttcatctttccatacttgaaatattaaagggctttacctcatggagtacagttataatagctgctttaaagtttctttctgccagtcccaacatctgtgtcatcccggagctgacatctattgattgcctttttctttgaaaattggttctatttcctgattctttgtatgtagagtaattttttattgtttccttggcattttattctatttatttatttatttatttatttatttatttatttattctatttatttatttagagacagggtcttgctctgttgcccaggatggagtgcagtggtgcagtcacagctcactgcagcctcaacctcctgggctaaagtgatcctcccacttcagcctcctgagtagctgagactacaggtgcactggcaccacacccagctagttttttgtattaatattttctgtagagacgggtttttgccatgttgcccaggttggtctcgaactcctgagctcaggtgatccacccagcctcccaaagtgctgggattacaggtgtgagccaccgtgcctggctatccctgacatttcagtgttatgttctgtagactgtgggtccgtattataatcttttgaagaatgtagatgttttttgtttaacaggaaaccctgcagaccacaggttctgtctgatcttctgtgggtagtggtttcagtgttagtttagttgggtctttgctttttttgttttttgctatactgcttggcacctgtctcactcatactcagctcaggggtgaatctctgtgttcacacacacagttaggaatttcccttttcctgcgctcttctctttgtttttgagacggagtctcgctctgtccctcaggctggaagttcaatggtatgatctcggctcactgcaacctacgccgcctgagttcaagtgattctcatgcctccttcccaaggagctgggataactggcatgtgccaccacacccggctgatttttgtatttttagtagagacagggtttcaccatgttgcccaaggctggtcttgaactcctgacctcaagtgatccacctttctcggcctcccaaagtgctgggattacaggcgtgagccactccgcctggccttctgtgcccttctctttgggattcatcccatactcactggactgcacaggcctcttttcctggttctctggccagaaacacaaggtttcttacagagttttagccagcttttctactgcactactgggcaggtctggaattggtgcaaagccaggagagcaaaagggtgaaaaaaaaaataggaaacttatcccctgtaccagtcttgtctgcaagttttgactccccttcgtgccacctgcttttgtttggttttcagagtcctcaagtagctgctttcatatttgatgcagagttttcactgtaattatcaggagacacagcctgtcttggcttacctcaccatgccagaactccctggaatgctctctttttgatcacaggcgggcctttccccccatcagatgctcttaagagccctctgtcaatgcaggttttgggttattaggcacctgtgaaggtgtgggtttcttgggaaggaactgtctgaggaactctaaggtccttagagagaagtgtcatggatctcttctccctcctgttataaaagacagaaacccaatcccagctggcttaagaaggaaagaacacttgctggcgtctgaccaggagggcaggagtgttgccagggattcttcttctcatctctggacattgcttccctgtgctgagttcatctcaggcagtcccctccaggggctgacaaggtgactcaccttggccttcatccctccagtttaacaaccccagaggacagcaggtagcttttcttcagtagttccagcaaacgtcccaaagctcacactggaccagtgagggtcacgtgcttatctctgaatcagttcctgaggctaagggcatggaatatgctgcttggccagcctggatcagatgctcagcccagggccagcgggggtagggatgtcagttcacctggacctcaggggctgacaagggggatactaaagtatgcattctcggccaggcgcggtggcacatgcctgtaatccctgcactttgggaggcccaggcaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgactgttgtgaataatgctgctgtgaacttgggtgcacacatatctctttgagccctttttaataatttttgtaacacagcaataacaatagctatagatacacttgtatagacatacctaccgcagctgccaactctgggggataagatgagtggagagttttactaattccgtggtttctaaatttttttattttaattttttttaccctttattatggaaaattaaaaacacaggaataggggaggccgaggcgggtggatcacttgaggccaggagttgaagaccagcctggccaacatggtgaaaccccgtctctactaaaaatacaaaagttagccaggtgtggtggtgtgcacctgtagtcccagctactcaggaagctgagatgggagaatcacttgaacctgggaggctgaggttgcagcgagctgagatcacgccattgcactccagcctgggtgacagagcgagactctctctcaaaaaaaaaaaaagaaaaaagaaaagtaacatgggaataggtataatgaactaccatatacctgtcacctaatctcagtaatatcacctcatgtccactcattcactccctgaccccaaggtattctttttaatcaaatcccagacatcatattattttacctgtcaaacatcacagaaataactaccataccataaacacacctagcaaattcaacaataattgctgaacaacgtcatgttgtcagtattccagtttccaatcactcctgtaatcccagcactttgggggagggacgaggcaggcagatcacaaggtcaggagtttgagaccagcctgaccaacatggtgaaaccccgtctctactaaaaatacaaaaattagtcaggagtggtggtgctcacctataatcccagctactcaggaggctgaggcaggagaatcacttgaacgcgggaggcagaggttgcagtgagccgagatcatgccactgcactccagctctggtgacagaccgagactgttctttgatccaggatccagatgaagcccacatgttgaaattggttgatgcgtctctaagtctcccttaaatttctcctccaccaatttcttttctgttcctgcattttcttctctgatcacgcgggcttttctcccataataggaagagacatggaggtgcccaagccggctctggataaaggcctgtcctcctctctccccacaggaccgggactttgtagccaagcagaaggaggacctggagctggccatgaagaggctcaccaccgacaacaggcgggagatctgtgacaaggagcgcgagtgcctcatgaagaagcaggagctccttcgaggtgggggtgtgcaagtggcagcgctgtcttggcccagagtcgctgtggacatcccagccctgggaagtggggtgggcaacaagaacctcccaggccttctccatccccaaaactaaacatcattcttcatggggaaacctggggaaaagccccacttgaagtaaggaacgaggtaaggacaccagttgtcaccaagactatttgagattattccagaagtcaagagaagaaaagaaagaaacaggcagagtatgttaataagtgagctggatttacgggaggtggagagagcttggcgtggactgagcaaccactctgccaggccatgtgccagtccatttttctacctttatctcatcaaatcctcacctaacactgtgaggcagggcctaggttatccccatttctgtagatgaggaaactgaggcttggagagttactattctttggccaagtatcttagttcattcaggctgctgtaacaaaataccactgactgggtggcttatcaacaacagacattcatttcccacacttctggaggctgggaaatccacagtcagggtgccagcacatttgtggtctggagaggacttactctctgcttcatagatggcaccttctcactgtatcctcacatagtggaagggagactagctctggggtctctgggtttttggggttttgtggttttttgggttttggggatttttgtttatttatttatttattgagacagggtctagctctgtagccaaggctggagtgcagtggcacagtcatggctcattgtgacctctgcctctgaggctcaagcagtcctctgacttcagcctcccaagtagctgggactacaggcacgtgctaccacgcttggctaatttttgtgttttttgtgtaaatggggtcttctgtgttgtccaggctggtctcaaagtcttgggctcaagtggtctgcctgtctcagcctcccaaagtgctgggattagaggcataagccaacgtgcccagcctggggtctcttttattaataaaaaggcactaattccattcacgagggctccaccctcatgacctaatcacctcccaaaaagccccatctcctaataccctcacctcaggggttaagattccaacatacacatttggggaggggacacaaacgtttagatcatagcactgaggttgcacagttaatgggtgatagagctgggccttggatgacaatatcaggaagccgggcctaccctggtgctgttgggagttcaagggatttctgggctgattgaggaaaaataaatgaccacaagatggcagtagcataccagcagctttgcttggggggcattttgacaagttgacacgctgagggggtcccttacagaatgaggctttctggagatgatggtgcgggccaccatccagcaggggaagagggcaaaggaactcttgggcaagaaggggactgagagggggctcacatgtctagatgatgtcgtccagcgtggggagctcagacggggcgtctctgggtcagagaactgcaaagggcaacggtggcttggggtctttatggagcccttgggtcttccatctctatggctggcagatgttaggtgcagtttcatggggtatgcaaagtaggcaggctccaaatggctaaatatctgcttggtttgagcttttttttttttttttttttttgagatggagagtctcgctgtctcactgtgtcatccaggctggagtgcagtggcacaatcttagctcactgcaacctccacctcccaggttcaagcagttcttctgccttagcctccttcatagctgggatgattacagctttgcgccaccatgtccagctaattttttatatttttaggagagatgggatttcaccatgttggccaggccggtcttgaactcctgaccttaagcaatccacctgccttggcctcccaaagtgctgggattacaggtgtgagccactgcgccattctcctgcctcagcctcctgagtagctgggactacaggcgcccgccaccatgcccagctaatttttttttttttgtatttttagtagagacggggtctcaccgtgttagccaggatggtctcaatctcctgaccttgtgatctgcctgcgtcggcctcccaaagtgctaggattacaggcatgagccaccgcgcctggccctgtttgagcttttttatgtaactatatacattttttttgtttttgttttttgagaccaagtcttactctgtcactcaggctggagtgcagtggcacgatattggctcactgcagcctctgcctcccctgttcaagcaattctcatgccttaggcccctgagcagctgtgattacaggtgcacaccaccacacccagctgatttttatatttttagtagagactgggtttcgccattttgcccaggctggtctcaggtttctaggctcaagcgatctgcccacctcagcctcccaaaatgctgggactacggtgtgagccactgtgcctggccgtacatattatgttttaaaaataacaagaggatgggtacaaatttgagtttggtgcctgtggacttttgacggtccaagcctgctgtgaggaagtaaacaacacgaggccaatatcccagggcaatttttggctcatttataaaacaggcctcatccaggcctttgatgaccagtgcagttaagcaagataaacctcttattatttgatgtggatcagcaaaacagggttcttgagttttcaatattctgaatagagcacagttgttttgagaaaagccctcacttccttttcctatcccatgatgttggtaagaaccgtcctatttacagaactgtggttctgattttggggtggaagccagaatcactattctgatataccaaaagcagataccattttgcacggaacaggaatgcagtgaaataaacaacattcgcactgagccaagcataatctcctgtctcgaagggcgtgagattctccctttgaccccaggtccccacccgggtgctgtgcacaggggtggattaatagacctccagtgttaagatgccagtatcttcattgtcttcataacgcatgcctgggacgtgcaggagacaaggaggatctcacccatttttcaaaggaggaaatagtgacaagaggccattctgtcttcttcatggggtctccatctgagctcttcccaggtgcccatcaggaaggtagagatgcagtgtggaaactttgcacttcaaagtttctcccaaggacgtcccctccctccatggtatagctgtgtccatctggcagacatggcagctgatgcctagagaacctctccattcctaatcccaccgatggagctgggttccagcctatagctgcagtttctgtggctcctgactttgaatacttcctgctataccatgctcctgggagctctcattccttaggcttaaaggaagtttctaggcctcagctcagatcagccaacgtggtctaatgaggtagaacatgtggcaattcctgagcccagcaggttggttatcatctccagcatgaggaggccaggcagaggtggggggcagggggcctgtcgagtctctggttgtcagcacctcaccagctcggtggcatgtcctctgcagaccgggaagcagccctgtgggagatggaagagcaccagctgcaggagaggcaccagctggtgaagcagcagctcaaagaccagtacttcctccagcggcacgagctgctgcgcaagcatgagaaggtgaggctgccggtggcacggggctcggatctgctgccgggccgacctgggagagccatgaggctgtatgtgatggggcacctcttgggtgcacactttggatgacaagtgcccccaagaggagccagggctggctgcagtgaggccccaggaggttctccaggggcgtcctgcttcagctcaaggggctaggaataggggaaacgatgcagggaagccaatggcccaagtggctccctcactgactgttacttgctgtgtatgtctctttcttttcttttttttccctttcttcttttctttctttctttctttctttctttctttctttctttctttctttctctttctttctttctttctttctttctttctttctttccttccttccttccttctttctttctttcttttctttccttccttccttctttctttctttctttctcttctttcttttctttctttctttctttcgagatggagtcgctctctcactcaggctggagtgcagtggcgccatctaggctcactgcaacctccacctcctgggttcaagtgattctcctgcctcagcctcccgagtagctgggattacaggtgcttgccaccatgcctggctaatttttgtatttttttttttagcagagttgggctttcaccctgttggccaggctggtctcaaacccctgacctcaagtgatctgcccgccttggcctcccaaagtgccaggattacaggcgtgagccactgtgcctgcccggtgtgtgtctttcttttgctcttttttctcttttccctctttttgtcctccctttccattttgtctttatttctctctttcttgtgcattccctcaatacttttaggtctccacttaaacaccacctctgctgggaagccttccctgaactccccagagctggtgagggcccctactctgtgtggccaaagcaccctctcctgcgggaattgtctgtctcagttcagcctccatagtgggacagtgacagacagaccaaggtctggatgcacagcagctgtgtataattccagtttcttatctaaatgcagtgatggaagtcagtatagggccatgggagttcagaataaggctacccaaccaagtgaagaaatcggggaaggcttcttggaggaggtgatgcccatgctgagctttgaaatacaaataggtgttaggggaaggaaaaaattcaaatctatcaggattttttaaaatataagttcatatctgccatcactaatggtaaaccatcccctttcgtgtacattttgctttgagatattagctaatgatggcatgccatcattgattagatgaaaaggcatttagaaggtaagaatccaagatattattaacaagaatttttaaagtgagaacaaataatgttattagtgtagaagcaaaataacaccagccttgatctgctgaacattgtgggctgcgttggtcctgggcccctgagtggagtgtggggacctttagcctgtgaccacgctctgagtccagagtgcagctgccctcagcccctctggatattcctctccaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcaggtgggggccgggcctgcggggtctgcaagtgtgctggggtgtaggcagggccaggtttggcgggacctgggccttatacagttttggagaatatgaaacaagatgcaggctggctcacgtctgtaatcccaacactttgagaggccgaggcgggcgggtcacttgagcccaggagtttgagaccagcctgggcaacacagcaaaaccccatctctacaaaaaaataattttttaaaaatattagccaggtgtggtggctatttggaaggccgaggtgggaggatcgcttgagcccgggaggcagaggttgcggtgagccaagattgaaccactgcactccagcctgggcaacagagcgagactccatcttaaaaaaacaaaaaagaaagatgcactccgacccacccgcctataaggtcttgggagggggtgtgcgagtcaccatgcgtgccctggaagcttcatcagcctcatggtgaattcacctctgtgtgtggacagaggtagagcttggtgctatgttgccaattctcctgcacccttcccttccgcactcccacacttttatttggccagcttccccacatcctgtgttgcccttgtggctcgggcacacgggcccttgtgattcctgcctgctacacacactttcctggcgtgtgtcacattgcagtgtcatgtccccaccagcctgggggctcctcgagggctggggctgggtctcagctcagggtgaggacttaacacgggcacagcctgaggtggtgctgggtactggggctgtgcacagaccagtccccctgaggggtctccctgggccagggctgagtggggctccctacccaaccagccaggccctggtcccctgaggcacccaccctctctctggtgcagttctcccagcaggaggagaagaggcagaagtcggagcggctgcagcaacagcagaaacacgagaaccagatgcgggacatgctggcgcagtgtgagagcaacatgagcgagctgcagcagctgcaggtaccgccctgcctgcccctgcccctgcccccaggctgcctcagtttccccaaggccatcagatctcagggggccagaaactccacagcagggaaggatcttcatcagacacgcccgggatggatggtttccagccctgccatgctgctctagggctctgtgaggttgggcaaatcatatcaccctcctaagccatagctctcacacccctaaaatgggcatggggatgaccattcctgctgtgcaggattggggcaaggacttgtgaatgaagtggcggagctggcagtgggctgctgcagggtttctgagtcatcactgtgttttgggcaaaggtggttggggtgtggccgagccccttgtgggctgcttttgctgtggtaattcctgacctcttcaagcttcctggcccctgggtttgccccatgcctgagggtcctggccccaggagctggtacttgaagcccccttgtggggacggggctgattcgaacctcaggaactgctcaggctgttggacccatcgggcaatttctggagaggtggggaggcatggaggaaacattccaggtgttgaggcctgcccggcagggctctgctgattgccactgtgtgacttttggccaagccattcaccttccgcatccgttttcctatccctgcctcgggtgatccctgcctcagtgtgagcactgagagagcccgtatgaagtgccgagcacagctcctggcaggccacaggcatgcagcgctgctgcgagtattacttctcactcagccaagttctaaactcccagaagcctctagcatgaaacccaaaatgaaaatctcccaaaggattctacttttccaacccagtagggtcgtggtatctggataaaggcacttccccctgctttataagctcctcatgacaagactgattccctgcaagaaatcaacagggacttgtcactgctgcctatgagagagatttacattttgtaaagcagataacttacctcagagaaagaacagcgaggttagaagagtctcacccatgtcagtgaccctcattccttgccacagatctccctgaggaaattatatgtgagacatacagagtatcttagctcgggctgccataacaaaccatgatgctttaattaacagaaacttctttctcacagttctgaaggctggaagtctgagatcagggtgccagcagggtggggttctggtgagggctcccttcctggcttgcggacagctgccttcttgctgtatcctcacagaaagttgcaaatttactatacctccccaccacagagttaataagaactattaacatattctggactattcctccaggcacttcttggtgcatgtgatttacgtatagagtttgaataaatgggatttatagtcaagaagaaataataaatgaacgatgctggtgccctcgtagccacagcgtgaggtgtgtctcagtcttcagggcctgcgtcttctgatttctcacctgttctgcctggaatctgttccagaatgaaaagtgccacctcctggtagagcacgaaacccagaaactgaaggccctggatgagagccataaccagaacctgaaggaatggcgggacaagcttcggccgcgcaagaaggtaactttatccgagctggtgggctcagtctcgggctctgctctgtgccatgcacaggcctctggccaggacatgttaggtctccttattttggtggactcttgctttgtggcaccatcaaatggatctccagcctgagagagagaggaactttctaaccctttgtggctgaacgccctgcagcttccacctctggaagggcagcctcttgtttagctccctctcatggaccgaaggactcctgccatgtgtccacagaggacgctgcagtgagtcaaaccagccacgctgctgggccagaagcccagcctgtggggattttctcttagaggaagttattctgaggagtcagaacgcagcacaagataaactgcttgccaatttagttttctgttgctgtgtgatgaactgccacacacttagcagcttaaaccaacgcccgtttactctctcctagtgatggagttcaagagtctgggtgggctctctgggttctctgctcagggtctcaccaggctgcaatcaacgttgtcagcgtggctgggctcttagctgaagtttctggggaagaatcacttccaaacccattcagctttcgacagaatccagttccttatggctgtaggtctgaggtccctgtttccttgctgacctcagacgggttattttctagaagccaccggcactccttatcacgtggcctcctccacctcaaatagccagcatgcattcagacctcctcgtgctttgaatgtctctgatatccctttctgccaccagctagagaaaacccttttgtgctcatgtgattaaatcagggtcacgggatagcctccctgcttgcaggaatgataccacattcagaggttccacccacacgcagaggagcggggagagttatatgagagagagtcacaggggtcatttttgaatggtgcctgccatactttcaccttcaaaccccatgccctcgctcagtcccacatctttctttactgccctgtctctctctttctctgcgaagccctgtcacaatttcttcctccacccactgagaaattcctttctcagcccactgcagccgctgctggcatggtcaataccaacatcctggtggctgactcgcatggatacggctggctggacttgacctcctggtggcagccagtgctgccagtcactctcttcctcgcctgccttgtcctcctaggcccaccttctgctgggtttcttctctgtcactagcccctttgcaacgtccctcgtgacccatctgttgatttctttattttattttttattttagagacagtttcactctttcgcccaaggctggagtgcggtggtgccatctcagctcactgcaacctctgcctcctgggttcaaatgattttcctgcctcaacctcctgaatagctgggattacaggcacatgccactatgcctggctagtttttctatttttagtagagacggggtttcaccatgttgtccaggctggtcttgaactcctgacctcaagtgatccgcccccctcggcctcccaaagtgctgggattacaggcgtgggaacgtggctctctgcaacctctgcctcctgggttcaagtgattctcctgccttagcttcccgactagctgggactacaggtgtgcaccactgtgcctggtggagatataattttttttaaatattgtataatgaaatgtgtcaacttttggaagatctgcataactcagtaaaccaatattttttaagtgaccaatgcatgatgttacaggatcatggctggagcaaagttacatccaagtgcgagaaagaccagcggatttttttttttttcctgagacggagtggcgctatctcggttcactgcaacctccacctcccaggttcaagcgattctcctgcctcaaccttcctgagcagctgggattacaggcacccgccaccactcctaaagtgctgggattataggtgtgaacccaggagttcgagaccagcctgggcaacacagtgaaacctcatctctacaaaaaatacaaaaattagccgggcacagtggcacatgcctgtagtcccagatactctggagcctgagatgggaggatcgcttgaggccaggaagtcaaggctgcagtgagccatgattgcactactgcactcccgcctgggtgacagattgagaccctcgcaaaaagaaaaaaaaaaaaaattgagaagctgtcaagttcaggctggtggacacaggttttccaaagttctcatttttgcttgaatgctcaaattttgtcattggcagtaaatatccttagtttgtttcccttgacgtgatcagctcagtttgttcattttcaagagagtgtttgctaaatacccatatttgtcagtaatttttttttgaaatggggtcttgctatgttgcccaggctcatttcgactacctgggctcaagcagttctcctgtctcagcctcccaagtagctggaactataacacatgccaccatgcccagttgtgagttgttttttaatcaaaatgatattctgcagaatcaagtggcgagttcagcccacaactcaagatgattgcacaagaacaataccaggcacaagaacaggatctctagacagccatcatgctttgaccggcagcaggcgggccttatgcatagttctcatttcctcacacaggacgttaaagggctgtgaccttgaaggtcaggatttaataaaatgaaccatttgtgttgcaccatcaaggtgatcttaagtgcaattggctttattgttttaattgaaaaactttctaaaatactatgagtgggcctggcatggtggctcacacctgtaatcccagcactttgggaggccaaggcgggtggatcacctgaggttaagagttcgagaccagcctggccaacatggcgaaacccagtctctactaaaaatacaaaaattagccagacatggtggtgcatgcctgtaatcccagatacttgggcggctgaggcaggagaatcacttgaacccggcgggcagagtttgcagtgagccaagatctcaccacttcactccagcctgggcgaaagagtgaaactccatctcaaaaaataaaaataaaaataaacacatgtgagtgcacggtggtgaagaatacccattcagttaggaggggccattgtcttaatcctccagaagctccagaagttttacccatcattgcttttgtaccattagcaccaatatcaaaacaatgaaaaagcaaactgtgtcttagcaggaaactagagcttgctgcccctcccccacccccagaaagcgttttgggccccctaggggttcgtggaccacacttcgagaactactgttcttgccttatctcccgtgagtctcatccccgacttgtgctctgagcagatttcagtacccaaatagatctccatgccatatgcgcttccctcgttccctgctgggcttttgcccagcctgttccccttgccaggaattctctacccaccagcctttgcttggccaacttctgtttgtctgcattattcaggcctcccccacggaggctgtatggtgtcttctgggctccccgtccttgcccctgtcatggtgtttatcacatgggattgcatttgtgtgtcatcgttagcttgatggttcattcgtttgtgtattaatgcaacacatatttcttgaacacctgctaagtgccccacgctgtttcagactctagagacactgcattgaacaaaagggacaagtccatgccctccggaagaaccgaccttctagtaaggggccaagaagcagggagggaaacagcatgggggggtcacaaagtgaggctgcttcagacggtgtggcaggaagatgtcgtctaagaagatgacatctgagccaagatctgaaggacctgagggagggaggcgtgcagccgtgggggttttcagggggacattcccagcacagggaagagcaactgcaaaggcccggacaccttgctcgtgaaacaaggagacccctgcggccggagagagtggtggtgacggtgggaggtgataggaggtaaagtcagaggggtggggggcctgcgtaaagtctggcttttactctgtgtgagatggaagccactggagggttctgagcagaggacaaggtggtctgactcatgttttgaaaaggatcccgctggctgccctcaggggtcaagagtggaggcagagagaccagtcaggaaaccattgtgatagccttggtgactaatgatggcagcttggactagggtggtatcagaggttgggggaatttgtccatttcctctctagctggcactctagacgttcttgctggtcaccagctttgggatcttgggcaagccatcttccccgctctgggccgtattagtctggattctctagagaaacagaaccaagatagagagaggatgtgtgtgtgtgtgtgtgtgtgtgtgtgtgtgtgtgtgtagggagagggagagggaaattgatttagttattttaaggaattggcttacacgattgtgggggctggtaagtctgaaatctgcaggacaggtcagcaggctggagacccagttgttgttgctgtctagaggcagaattccttctctcttgttttctctgaaggccttcaactgattgaggcccacccacatgatgaagggtaatttgcattactcagagtttactgattgaaatgctaatcacatctagaaaataccttcatagtgacatctagctggtgtttgaccaaacaggtggataccgtggccttgccaagctgacacataaaattaaccatcacagaaatcagtcgggcacagtggcgcatgcctgtaatcccagctacatggggggctgaggcaggagaatggcttgaacccgggaggcggaggttgcagtgagccaagatcgcatcactgcaccccagcctgggtgacagagcaagactccgtctcaaaaaaaaaaaaaaaaaaaaacccaaaaaacatgggacctcagtgtggttatttgtacagtgaagctatcaatactgcaaggttatgtcagaagttgccagcacatagtacaggccaaggacatactcattcccctaaactctctgaggagagaactgcccaagttactcttaatctcatgcccacgggtcctgaagtcctgaggtttgttctgccatcgtacatcagttctgcttactgtaactgtggtctggacaggaggcaactgcccatctcagctgtgtgatggccttgggagtccttgaattgaggcctccctccctgcgctcatggagctttctggctggaagctggccaagatcccagacttcctgttaggcccacgctcatcagtttctgtaaccatggtctgctgggactttccatacttgacagtcaagtcaataatgttcctgctgacataggttggttctgcaatcaggaaatgaacgtccacctggttctcttacctgggggttctatacccttggcctatcctgagagagtttgaaaatgaatgatcgcgtttcctctagctattgccttatgtctcagatcgcttcaaagaggggcctgggctcaggggaggcaccacgagtgtgcagttgggaagccagcattggactttgcctgtgggggctgcctctttgcagaattctttatagaattcttctgtcattagctgcttgggtttctgctggaacaatgacccggaggtgatgattttcattcgagaataaatggtcttttacattcttgcattacagtcagcagcctgtgaaccccctgccttgtatggaggcagggagatgattgtacattgtggagtatttttagaaaaattcagatgtatttcgagtaagtacggaatatctggtagagtcaatgaagtgttgcttgggtcagtgttcacacagaatgtggcctcaaacaagtcaaatcttccctcctgaaccctggcttttcgggctgtaaaatgtagataatatttatttccttaaagtaggtgttagcaaaccactgccaatgtcctaatctggcccaccacctatatttgtaaataaagttttattggaacacagccatgctcgttcatttacagattgtctgtggctgattttgtactacagtggcagttgagtagtcacaatagagaccaaatatgtcctgcaaagccaaaaatgtttactatctgtcacataacagaaaaaagatcgctgactctggcgtaagaaggttgtattgagaaatatatgtggtgggtagaacagaataatgcttaaacagcccaggctttggagtcacacaggtgggatgaagtcctaactcctccattactagttgtgaaaccttgggcaagttactaaaccattctgtgctcaaaaagtagtagctattattattaaattgttggtattcctagagcagaggtcccaaactgatagcctatgtgctggaattggcttacaggcatggtatgtttggccaacatagtgatgtaaaaaaaatttttttttttttttttgagacagagtcttgctctgtcacccaggctagagtgcagtggcacgatctcggctcactgcaacttccacctcgcctcaagtgattctcctgcctcagcctcccaagtagctgggattacaggcacacactaccagacctggctaatttttgtgtttttagtagagatggggtttcgccttgttggccaggctggtcttgaactcctgacctcaggtgatccgcccgccttggcctcccaaagtgctgggattacaaggctgagacaccgcacctggcctgtaaattgtttaaaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctttgctgctcagtctctctccatcttctccctcgggtttttctccagtcatttggctgttttcctgccaggggatttgcatctgcttttttttcctccctgccccgtctagattgacatttcccccaactgtacccttcagtccacagggagcttctgagtggcggtggcaggaggtggtacttacctcctgtgggaggagctctagggtaggaaatagggaagccgtagtttctcaagcactgaggcctggaagggaatgttccagagaaggccatgtcagtgggggtcctgtgagtgggagacccacgtgtggcctgcagatctcaccaagtgccatccatcctctctcttccctaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagct

SEQ ID NO: 12552 - DNA, 14524 bp, Human
ttttttaaagtatgcttcttcaggaattatcttgtttcactcactataactccaattctagagaaagaaaaaaattcaagttaaaattcaagttatttttgttctcaataataatcacctccattgcctccctgcccttcagtgccctgggcaagcctttttagtcattgtttctttatctgtagaaagggacatgataatagtacctatctcagtgaattgctgtgaggataaaatgagaccctaaatggaaaatagttggcactgaaaatggcctgtaaatggtagctgctattttttttttttttttactaattcatctgctaatttaaggaaataaattgcagtggtcgtgggaccagtgacccaaactacttaaatctctaatacattaattgatcacagtaataaacccgaatttgttaaaaaacaaaacaaaaggttgttatgctccaggtactttgctaactgtggcggagaactgtttgatttggcagtggtggctcaagctatcagtatagcattcccccaaatacagattataaataaggaccacctgaagcgcaatatgggcccccccccacccccgctcccaccccggaacaaccaaaaccatatccaggggagatgcgtaggaatctttaatcaccccaggtgattttttttctgattaccaactttgagaaacactgaagggacctcttctccattctatatgtggctaatataaaccctaaacatcatttctatgtattcgttagaccgttgtttactagaaaatttcagaagtcctttccgacttagtaattttgttattttgagttgaactgaaattcacttggagcggtcagttgaaaatgttttttgtttgtgctctgaaaaggttcccagtgttccgggtaaagtcatcctttcacccatgggggacctgtgcctcgtgcctgaactgcccgcctagtacctccccccttgaacttcctctcgcaagcctcctcctcccgcttcatctgggcctcgggtctagcttgttttgtcccttcgcggcttttgagtagaacatttggtgctttcccagttcacgacgctttgctggaatcgtcaatttccagggatttcacaggctggccaaaacagtttgttcagaacagcgccgccggggcattggcagccctgggcggccgcgcgtttcctcactccgcacaaccacccgtgaccttgggcgagcgaacgcacgccgccagctgcgtcagggccacgctcgggctggacttcggagctcaaaatgggtgtggggagtgaggaggtttcataaacagaaaagacctcgaagccataaggcaattcttttccttttctgggggtgaatccttacgattcttgggggagggaatgtctgcccagggctggagacaaagcgtgagaactaggatggcgaaaaacgggtttgaatgagaaaatccgaaggagggaggctgagggcggacaattgggttaaaaatagaaacgcatcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcctcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggtgagtgatacggggctgcgggtgggagccgggctccttgttgccgggccgggggcgggagtgaagggaccggggcgccgcgggccaatggcgaagccggagcaggccgcggatggcggcgtccgggggaggggagcccgcccgccagcccaggaagcacaaagacggaggcgtcatcctgtcgtcgtggcccgagacctggctcccggcgtccctggctcgctccacagcacggtcgggaaacaatgcacggcgtgccgcctctgcggggccggcctctaggccgctcgcctccgcggcggcgcccggcgtgggcaccacgacccagagaaacaaagaggccgaggcggcggccgcgccccctgcccgttgcagccccccctagctctcccctaagaggagccgttcggggtcgggggtcgggggtcggggatccgcgtggggcctgcaggcgaagggctggccgggcctgctgagctgctgttctgcatgactcagtggttttcggagagggccctgttgggctttattgagtgaggcctttgcttagagggggatggggtatcagtgggacccgaacttgttccaaaatccattggaacatggggccgggggttctcggcgtcgtcttttgggcttctcgacgtcgctgcgtttttatcctgagatccgttttcatggaggaaatggaacacctcctttgtttggtgcatttaggctgatgaatgtgaaattttttgctcgctttccacgcactccgtggaggtgtgttttcggggaagggtcggattatctttattgattgaatgtctcctaagggatagcatctaaggagataccaagataaaggaacatataggtcacacatccccgttcttaaacctgggatttagatacagacttctaaaaacataaacgaatgtattttattccttatttttaggattttttttaaagagtaggctttcagaactcagttggtgaaaatactgcaattttatctttgaagttttttgttaaaatgtttccccacacccccctaaaaaattaaggattctttgtagttgtctcctgttttctatctcccaggccctgaaaaggagcctttaaaagtcaattctactccatttggcaaagagggaactgaaatctggaaagtaaggacttgcccaaggtcactgacttagtggcagactagagacttgaactcaggtctccattcccaggtgagtgggaattcatgccatctcatcacatcatgtgcacctgaaagaactgtattccataggtgtaaaagctctttgttcagaattggaattggagaattgttcagttacactcgggtgtttttttaagctgtaagttagaggaagccataaactttataaaatctgcattctagctatacctgatagagctgacacgtgcatgctcaagttgctaattactttaaaggcaataaatagtaatggtatttttttctaaaatacaaggggaatgcaatacctaatgggaacacacatcccccacttcatcccctaaatcctcactaaatgaggattcttttttacactgtctccactgtgcttagttttttatcaacaaccttgaccattttagctttgactatgctttcatcttctagattgagattgttctgtagtttttcctacattaggaaaaaactagcagccctttttttgttttcttatgttagatatatgaacgctgcatccttagttcttggggttgtgtaggagttggcaggctttgagatataaatagaagctgatttcagaggcccctgttgactaggctttatgtgagagcctccatccagctcagcttgtcacattgcagccttgtgacaggctgaagcgccctcccatgtgatctgagcttctgagaaatattaaagcaagctgtgcacatgtgatggcatttaaaagctggctttctaggggaaaaaaatctaaaagatgggaacccatgtagaagactcatgtcctggtacctcttgtgtgtctcgcagttgaaagttatttataatgaaatgaaggtagacatgttctctgaagcaaagttggaatactttgttatctctgagtgtgtgaaatctttagatggagtatcctccattttatctaaaacaaatattttaagaatcagattaactaaaattacttaggtaggttgatcgcttggccttaaactttaaagccaatgtcacatgagactgggcctcagtgtagaaaatgtaagctagcatacttaaactggttttaaggagtgacccaactttcatgcatagggcaaacattcacacatattttgtgcgtggtgggcatgcaaatacatacatatttatcatttgaaagcattttttgctcctattatgctcatttaaaaacccagctgaaagtgtttattaataaacttcctaagtgatgttgaaatgtttacactaccctgctccaaaatgagtcagctaaattccagttaatatttaaagagacagtgtcaactaaattaatactgttgttaaaagtaagttgtggatcttggtcactccacacaagctagattgtcttaatatttgtatggtgcacttttacttacaaaagggaagataaaatgttttggggaataattaccaggggtctggccaggtcaaaattggttagtccccttctcccatcttctaattttggtagttaatacttgttaaaacatcgttttttaataactcactaaaaagtgtattctagtatgtagttggaaaaaatgactgaccacaagttacagcacacgaattttcctttaagcaaatgctctcaaatatgctttttgtacatatgcttatacatgtttaagatgacatgaaaaccctccacaactttattttaaaataatttttctttaatatgtattttctcatccagaggaaaacttattaataatttagcacagcgttttaacaagacttttagaaaagcaaatcttccttggaaacaaatgcttgctatgtaaagctttttctggtaacccagcattgaatattaaccattactaaaggttatgtgtatatattgactttaatacattgaatttgagcttggaacggttttattattttctggtatgaggaagacaagcacttgttaaaattaatagtgcctttggctgagaaatctggttcataatttgtgtattgcaggttcctaggcactggctttgacatactctgaaacttcaaatggagaatgtaaaaggagtttcgtaaaccagctgaccctaaattcttagagatttacttgttggtgccagggtagcaggaaggggctaccagttctcttttcagccttatatgaagatgtttcagcattaaaaagtacagatgctctgcctcagcagatttgtcaaattactgatgaagcccagatatgtacaggtgttttaagaaaactttattcatccagtttaaagaactacctataaatatcaagactcagtgataattgtgattagccaattaagtaaaaacatttgaaatggtctgcctgtagtgcagcagagtgaaaagttaaagataccagtttcccaaattgattaaaacataaccctgagagctaacagaccttttcataaattgaaaccaagaatagtgataggtaaaaataccctaataattgataaaatttctttttgggtttttttttggtcctaaaacagtttgcttttataaaggcaacaaaatattgataattatctctgcccaccctttttaatgattaacggaatttgggcttttgttaaaacttgcgtagcaattacaacggtataccgatgattatattagactatattttggtgataacactaatttctgaaatttcgtttcgtctatagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggtaagttatttccaaggaaaaacacatttgaaagaactggtggacagaaatacagaaccaagaattggggctgagaatgctgaaagcacatggagagaacacctgataagagcttgaaattcaagcaacagcccaagtgcttgacatgactgatcaggaatgaatgactatctacaagcatcttatagcttttcagttttcttttttggggttattttgtttcacacttgtgttcattggattgactttttaatattttttgtttggatactcaagtataggattacagcacagtgaatgcttatatcactaacctaattaaatgcaagtatttattactacgtcttgatactaagtgagtttttgtagtgttcattggttccttacaaatcctttttttaaatagggacagctagtggttccaacagtcctacctcagattctgcatctgtacagagagcagacactagcttaaacaactgtgaaggtgctgctggcagcacatctgaaaaatcaaggtaagattgaacgtttcagagtttttatgatattacaaagaagaaatcaagatgtctgtactggtccaataataagttaatagatacccttggctttgcaatcgaggatttcagtgtcttttaatacatgactcttaagtcattgagtaaagatgtgtgttacttacacctgactccctaaccccctcaaggatactgtgttggaaatgctgtgcttttttatttctttgtaattgaggtttagggattgtcgagtgagactgtagaatattattgggccagacaaggtgttttggcagagctgcccttttgcccttaaacaagttacaggcacagctaaaaatccctagctggttgtaaaatatggtaacctatacaaaatgcagcctcgagttcatgagccatttatcaaacttttttctcaaccatttgtgctgggcatccaatttttttttaaactttagattatctagctccatttgctcattttggaaatattctataatttaaagttgaactgacaacttattcattgtctcaagaagtacccttaacacctttaaaaattgtttgcttgaactcaaatagaaatgtgcctgtggctgccttgcctgtaactcagcaaatgacagaaatgagcatttcaagagaggacaaaataactaccccgaaaacagaggtgtcagagccaggtatgtttttcatttaatacttgttcagttctgaatttgatagtgcaagaaatggctggtggggggattctttccttcccattgaaggaccaaagaggagggagagccataaaatataggccaagcaaagaactactatctttaaaagtatcttgaagagtatgagtatcttgaagtgtaaaatagtcatatttattctcagtttcttctctgctcatcccctgcactacccttgtgcataatgggcaaagtctgtaatctggagattggatgtgttaaaaacttgatgaagttaaatttcaagggtataaggaataattttataaccaaaagcagtaactttagttttgatattgtcaatgttgtggaaaacttttaagtagaacaacatatttgaacactagaacttatttgaagtacaatattcctatcatatattttgtgggagtttgaaactcagtgtggaaaggcattttggttttcatgagatatggtgactttggaaactttgcttatatagcacaaccagaagtgccctgatggtggaagaagactgacttgaattacctgtactaggccctagaacaaaaagatttctgtgctttatatagtgcacgtagcttattttatcaatttgttcttttttggcagagtgctgattaaatgcaatataaaacttctgttgtgaaaaaatactgtcagtggttatacagtctgctttggaggctggcttttgctaacagcagtcaagtttgtttattgtattaatcttacaaagttaaggccaaattctcaagtttggcaggtgaatctatatttggcattttgaaatgagctccatccttaaactgaccacattagtttgcccgtgatgcctttgtttgggtttttgtttttggttttggtttttaaatacaaaattactctgaccttggaagaatagtcttgggttagagctagtctgcatttattattacttagtaggcattctgtgattcactgctatttgccttttctgtgtcattttcttattcccccttcttcccttgtctcaggagccgtagttcatttttcagatgtggccaaagaaatggctgacaccctccctctaccccatacaactattcccctagattattctttatcctcatgacatcaggataaacattaatgttgtcacagtagcagtaggtagaatattgttcgtttagtctaatattaggctatttctcccagtagattcattgctaatgcaattgaattataaatttgggcagagttttagagaaaattgccattaaatcaatcagcttgttgtaggagcttgtctatatgctaatagcattggtgctggcatatttgggcagtaatttcagcattgcatacataaatttgctattgttacatttggattaatattaaaacctgagtttatagtgtttcaggtgtagttgaattatatgtaagtagatataaattttgttatttttgtgttaaagaactagtggcagtgtgggctttagtacagtaatgtattttttgttcattgtgagaaattttattgatgccatgtgtacactgaaacttaaagcctttttaggtggagaaacggtgggactgtttgtagatgctatctctgtcgatagtggatgcccattttagataagattcttgttctgcctgtggaatccttaatagtttaaaatcaatacttctcgagtagtttctaaagactgtttgccgatctgtttttaaaaccaaggtttaaaaaaatctttcaagtcttcctatgatgtttagtgcacctgtgaaaatggtaaaatgattgttttggaatttttggatctgacgttgatttagggatgaatggtttgagttttatttgtcaaaatttgctgtttttatatctacaggattttttttcctataagcataaaatcaaagttggctactgttatttactgtgatgtaatgaatttgaactgccctgattgaaaagtttgcatttaggaaattataacgtggaaaaactgagcatatgattaacatctcccagctctttaaaacagaattaggattttgtttttagtactggctgttaccagtgttttaaaggaatttcttgagtgaagcgatcattttacaaaattagagaagcaagtagtatggtgattggcaggaatttctcagatttgaatcaagttctgatgttaaaatggaagattctgtttaaagcttgtattttcaaggaatacttataaacatttttatcaggcatcttcctgtttctcttaaatacttccttttttgacttaaaaatgttagccagtgaatgcttgacaaatttgtgtttttgtccttttcagttgtcactcagcccagtccatcagtttctcagcccagtacttctcagagtgaagaaaaagctcctgaattgcccaaaccaaagaaaaacagatgtttcatgtgcagaaagaaagttggtcttacaggtattacaaaacacaagacaatgtatgttttacttctgcagttaacaaggagcttttggtcactccctaagagactagttggtcttacacataaaaaaaaaaaaaagcctgactagctgtagtctaggaaaggtggaggaggtggtattggggtggaaagaagttgggttttacttccatttgtctcctaatcatataaaactattaactcaggccctcttattttattagattgataaaaagtttttgtatacctagggaaaatgttactgaactaacagtaagcgccacctactttgagctatgcagggaatgttcttggtgctttttttcttgtctccttcaaatctcagaccttgatggttgttttcacttgaggaagcattacttaagatatggtaggactgtgttttgaatccagcttagcctaactccagagcctgtgtaaattttatcctgcgttgcatctacaggagtcgatagagggagagcatctggtagaaattagctggcagatagcccattttgttttctccacgtggtttggcttaccaaacacttcgctattgcccttgcaaggaaagactgaacatagttatttgaatttctcaccatgtcaaaggaagttaaaagttccttttccaggttaacgtgatagactctgtaagagttgactgtgtcttatcaccaggaagtggaagaaaagagttcactgtcttttatgttacaaagcaatgaaaatctggttccttttctatagtgactaaggcttttttttcttttaattgcctcaagttctcaaatgactctacttcttcgtttgtacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaacttcacttgttcattgggtttttaagccatagttggagtcctaaagggggaaaattagaaaatgttactttacatggctatataattttttttcctttgccatcgctgaacttgttcaagtgataatcaagagatattagaagcatttgcaggtatgatacctgataggcagtttatttttgaagaattcaataggcacctttgggattaaaacaattttaaaatttgagaaagatgaaatttgaacaattatggcctacctcgcttctccatgttgtaaaagatgatgttttatgacaattctgaagaagaaagtaggtatgacttagtttacaaaaagagttctgttttatttctgttttgggtttggctctaatacagagattcacccatggacttggtctctgtagcgtttatgccagatcataaagaacaaggggtgacaggtacatgttgactttacctggggtaaatgattaccagagtgcaactgttgcttctctgtgatggagtttggggtggaaataccctagttttatctgtcagttctttgcatgctgctacttttgcttcaagttagggaggtacatatgtatgtcaaagttcctatactgacatagggtagtatttctctgaatatgaaaagtcacaattgagttgaaaatttagaagttgaagatttagaagggcaacttaatttttcaagttaaaaatgaagtaagagtggtatagagaaggtaagatgagccctcggactccatcactctgaaggtctgagtagtagcaagagatagatagttttttgtttggccaggctgcagtgcaatggcgtaatcttggctcactgcaacctctgcctcctgggttcaagtgattctcctgcctctgcctcctaagtagctgggatcacaggcaccagccaccacgcccagctaatttttgtatttttaatagagacagtttctccatgttggtcaggctggtcttgaactcctgacctcaggtgagctgcccgcctcggcctcccaaagtgctgggattacaggcgtgaggcaccgcacccggccaatcagttttttttgttttttttttgtttgtttgttttacaagaaacattaaaccagatcagaacaaagatttgtcagggttgtccattgactggggagaaagggaatcagtgtgtaaggcacctgagaggactcagttctacccaaattcttgcattcaaacctgaatgcaaggccatgaagtcctttgaaatgtacagatattaagcaatttaataatataccatgtttcccttacataagcagacaaatatttacacccccatgacctgaagttttgttaggctgtgaccacatgaattcgcagtataaatgggtgagtcctttttgaaaacctcatcttcagtgtgcctgatctgtaaaactagagcctcaggtttgatcctaggtaggcttcccacaacgtggggaaaattagtttgtgagggaaagctgtttctgagcattatggcatagtgattaagatgagggaccctggaaccagcccgtgattttgggcaagttattttaggtccactttggactgcttcatctcttaaatgaagacagcaaccaccttcaggagtgtgaaggtgacaacacttaaaactgtgcctggcacattgtatttgctattgtcttaatgttctggaataatggtttccataacttgggaagaaaactttgagaacaggattggttacatcaagttgtatagtgaaaagataaagatctgttatttaaacttgcagtttaaagtcattagaatcattcttttccgtaaggctttctttgcaagagatctgcattaaataaagttgctaggaaataactaaaattggggaaataatctaataatagcaagatgttaagcatactattattgtattttgggggttggtaataacattcacatggatttatcaatacacactgagaagcaaagcctctcaa

SEQ ID NO: 12553 - DNA, 19945 bp, Human
ggttttctagtcttaaaacaagagcgtgaaatgtccctttatcaggactgaggaatatctgaggactagagttaaacatccaggtgacaaattgttaaacaatggtctgcacagaggagtgtgtttatcctagggtggaaagaagataacacaccaagctctgagaacagagcttctatttacatttttttttttttttttttgagacgagtctggctctgttccccaatctggagtgcagtggtgtgatctcggctcactgcaacctccgcctcccggatacaagcgatcctcctgcctcagccctgctagtagctgggattacaggcacgtgccaccatgcccggctaatttttgtatttttaggagagacggggtttacaccatgttggccaagctggtctcaaactccggacctcaggtgatccacccgccttggcctcccaaagtgctggcattacaggcgtgagccaccgcgtccggcccctatttacattcttaaccttaaaaaaaaattaaagttgccttgcgctttcatttggtctgggtgccagatagtcaagtgttaaatatagagagaggcctcctgagagaagagcagacacttctctgaagggcttatggtgggagctcacttccctgacagcattctcatgcttctgggctggatcagtcaaaactatcagctttttgtttacatccaagcaacactactccaactagcgtagtcattggaacaaatgttcatagtcctgagggtacagaaggacgacactgaaaagatcccaaggggaaataaaatctttctatttgagcaaaaaggtaaaagcactatgtagtcatcttttttggcacatcaaaaaagtcatcgtggcacatcaagacagacctcacgaaagcaattaatattcctatattattaggataactttgcataattaaaattacataagtgtacaacagctgaaaacacagcattaaatacaacttttaaagtctaatttttaccatgtgataaccgtatcaaattttgcgaatattttgtgagacttggcagtagatggcgctcacctttactaaaagtctgagcagcgccttaacactaacaggaacttaagaatccagctctgatgtcaggcaatcccgtgtccaggtcaggtcacttttttaagtctcagtttcctcactggtaatgtgggggtgggggccgccccaatggcctcgcaactcagaccgcttttgattctctgactacagtggtggagttgagacaggtcggctgctgcaaccgccgtctgaaatagcaatccggaaaagtcaggttgggaaagtgacagagtagacgccctgcggctctgatccgggcggcgcctcagctgcccacactatgtgggcggcaacgcacaaactccttaaccacgtggtgcctccattcccctagggagtcccatcacaggataacttctagcaaaatcaatcttcaagaaaaaaagaaggggtcctgccgaagatataaggaagctccctggggatcccgcagcacagcacaaacttagttcttgagagccgcacaaaaccaacttccgccccagtggagttgcgtccggaaggcgcggccccggaggtcacgtgggcccgcggaattacagcctggcggggcgctcaggtggaagcagtaggccacattatgtcgactgttccatgcaagtcagggtgggggccgtccctatcgcaggcatgagacaagtccagctgcgtcgtgtctggtaatctgagggcaagaagaacgatttgcagaagctcccagttttcttggctgtggcacagtcgctttgagggccaggttccttcggcttcctcccgactcccctgcttccccccgtaggattcccgttggtatcgtccgagccccacctccctcctcttcgcccccgcacgccgaaaacaggggcctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccaggtgggcgcgggccctatgggcttcccgccctcccctgcccagccgagccgcactgcctcctcgccgtgcgggcggggcccgggttcgggccacggtcgggcgggcgggccgcgctcggggtgcggcggcgactccggcaacatggcggccagcctggagtccactcgtggccgggccgggtggggagcgcgctggggggaagcggacgcgcggttcccagtggctgcggggctggggcccccctcgaagtgttgcaagtcgaggtgccttttaaaaggcatcgtaattcctagcctcacttggggtcggaaatggggacgtggcttccttccgcgggggcagcggtggggttgaggatggggccgggcgtcgcgcctctgaggttggcggtggggccgagctgcctctccctgccactggttgttcaccctcccggcgcctctctccggaggtagccttctccggaagtccgggaaagagaaacttaaagacggtaatgctcgttcgtgtctcagacttgagtctgagaaggtcgcttgagatttaattacattggttttgcagataggaatagaatgtagctgacgtttgagcacgtagttagtgaaaacttcacacttcaaagtatgcgaaaaggaagaaaagtacccatgtatgtaccgggtgttttgcgtacgtatcctaaggctaaactggaaggtaggtagtgaaacctaggaggtagatgcagagacggagatgagtaaactctcctgacattgtatgtttattcttttttcaattgtttttaaaattttcttaactatgtcctgtgctcagatagcgtatgtttagtaggtcgtggaacgggggtttgtgcccaggtctgtgggttttctaaaacccgatcaggagcgtgtcttttgttatgtgcagtcgcatagggctggttaaggcatacatacattttaaagcagaaattgccatataccgtgacaacacaaaagagagaaggaagataagtttgaggtaataagcgggagaaacactagaggtttaaaacctgcagtctcgtatgattggttattctagttaacattagttaaggagtaatgtttacgtagttaacattggcttcttgaccgaagaatgccgaagtgtaatgatttttatcacggcattcatattctacaaattctcctctagttttagtattttataaaagtttaataaagtatatagtaaacttaatgttttgtttttagtttaaggaagatgtaatggtaacatttcaaaacgagggaagtaaattgcagtataatactgggaattctaaccgcactattttaagatgatagagcagaatatgtttgtctcagtcttaatttgacagtttcctttcagaattgtagtgtgtgtgtaagagaaggttggaagtatcaaattaatttgtctttgtgtaattgaagtgcgtgcaaaggaggtatgtattttctggaaatcataagtggatgtagtgtggtctgaaaggtagcaagtttagttcattgtaaagaacatttcagacatttcactttgctacacccgtcaagcacaaaggtttttaaacagcatgttttatctatacaaacttcagaaaatttatttttactttatgaacccttccccaccccaccgtacatgtcccagtctttaataagtactaatgatgaagtattgaaagcagtgcctctgcagaactattttttaggcaggagcaaagcaaaggagaatgtttggaggcatctagtttctaggaaaatgaatggagcccaattcttttttttcttttattttgctgctttttctcactggaaaatagagcccaattttatagtccgttcttctccagaaattgaattatggtgatgagtacttgtttctggattgtttggcctaggatgaactattgacaaataccttgttaacctgaattgtatgcacttgaatatgggcttttagatgttgtctccagttgtggaggatcctgtcgagagtggatcatttatgaatcgagaatccctgggaaattatctttgtttgcagcagaatgggcatcatcagtgcttgggttcaacctgttaaactactactgttactactaaaaatctcagggttttatctgatgtttgggggtagtggttttcctatgtgtagtgttggtattatatcaaagcctttttctcgatatttttatgtattaaggatgctttgaaatgcctaaatccttagtggctgtgggtgtcttccaatagttgtcctgtgaaaaaggattggttagacagataccatcaggcactgtactgagagtgaccactagcttgtttttctaatgcgtttacttacagctttgtaatgattggaatttcttagtaaaccagtataaagttttatcatttatctgaattagtaattttgatgctgtatgtaatgcttattgttcaaaaagataagtaatacagattcaaataagatactaataaaatcattgatttcatgcatctctccccccaactccccagaaacctgtgaaggtcgaaacagctgcgtttcctgttttaatgttagcgttgttaatactacctgcttttggatagaatgtaaaggtaagaaactttggggatgcaaaactgttttgttatagcattttaaaatacagtaattcttgaacacttgaaagttatgtaggacatttaggatattgtgcactatttattttgcaaatccagtactcctttaaagtgccagttgcctcgcactccccctgaaaatctctttttgtctcccatcctccctttagattccttaagacttgataattaaagctcagtcgtttgttttttatgagatggagtctcctgtgttacccaggttggtcttgaaatcctaggctcaagcaatcctccaaccttggcctccctagtagccaagactacagatgcgtgcttcctcacctggctttttttaaagcctgttctaaggattgagagtactttaatacactggaattagctgtgagtgaaggttgtgttgaaaactgtgtcctgcaacatgaaatataaagagaccttatgaaactgttggatgcttaggtgtagagaagaaagaggtagggagagttgacttcctgtgcttttgttaatacaagaggtagagcgctaaagggacgtacattgaaattcaataagattcttattagaaccatattactgcatacattattttaattgttttttaatgtaaagtggttgcacttatcagtaaaacaatctagttgttttggcggttttttttttaagtaaaaacaaaccataagtttttttatttggtaaaaattttaatagttctagaaattatatcactacataaatttcaaaaagctctttaaggtattaactaaattgggccaaattaacttttttgttatagaagtgtctcttttttttaggtcataaaatgggatttaagggcgtactctttcccctttatatgggagtatgtaagagttggtgaattttggagatggaatgctctactttaagatttgttgggaaaggttctccccttactcttgttccaagtctacctatccaggaaagttgttttagaaagtatagaagactaaagcagtgagatttggaatagagtttctacagtgttatggggtgcctcatctgtttactaacctcttaatacagaccctgaccacttcaacttactgtctccgcctttttttttttccctgagacagagttctgtatttttggtagaggcagggtctcaccatattggtcaggctgatctcgaactcctgacctcaggtgatcttcccaccctggcctcccaaagtgctgagattataggcgtgagccacctgcccactttttagatgatggctgcctttcttgattgtacagtagtcttcccacaattctgagatctaagtgttgcagatttattttttcagtatattaatgtggatttttaatggataaaagttagaaggatcctgcgtaatctctaagtcagtgggaaaaggagaatgacagggtttggtctgtgggtttaactttaggtcaaaacacctaaagtggttccccctgcccacttctaaagtgtttgggtttgatttcatagagcttagtagcagagtcaaagataatacaaatgggtggttgatgctgtttgtctcttttcccctgccccccaacagatgagagctattgttcacataactcaacagttagtgattgtcaagtggggaacacgacagacttctgttccggtaagtattcatattggctgcttggaagctgaccgcagagaggtgaggaagatcattgcctcagaaagccttgtttcagtgctttgtttgaagcattgccataattctcatcttgttagaattggaatatgaatagtatattcatattgattgattaaaggatgatatttgaagcttggtttagtgatttagctatagtgtggatgctgtaagtgtggatgcgttgtctgcccccacacttttttttttttttttaaacttttctaggaattcatcacagtttagccgctatgtttgcatcttgcaggtctgggaaacctcattctggcacttttggtgttgcgatactggggattgttgattgataaatttattctgcagcatagttggtgctgtggttaaatgagcttttctatacccatccattttctgtattttaatctgagtaacttgattaatttttaacctttactattcgtccagcaaaacgttaaaattctacttgaagctgctgatttttccaatgagattgtaaatcagtgggaaaggcatattcctaatttgatgcatagataataattgaataggaaaaagatttttgtgcagtgtgtctaaccttgaaagactacctttgactctttaattttggtaggggttgccccatcccaatgtgaattttgtaactgaacatttcattagtattagatcagttttacttcacacagggtgcataatatagttaggtggtacacgaacaaactttttttgagacagtctctttgttgcccaggctggagtgcagtggcacaatcataactcattgccacctcatattcctgggcttaagcaatccttctgcctcagcctccccagaagctgggattacaggtgcatgccaccatagctggctaatttaaaaatttttttgtagagatggtgtctcactatgttgcccaggctggtcttgaactcctgggcttaagcagtcttcccactttggcttcccagagtgctggaattacatgcttgagctactggacctggctgaaacattttaagtaattactttaatatgtgttagataaactaataactgtcagacctgtggttttgtaatattgcttagagacaagattaatgaagatttcattagtattagaacgtttttgaaaactgatttaaaggaaaactgtatttgtactgctgcatatttgatgatgtaccagttagaattagtttcagctatgaaggacataaacccccaaattacaatggcttaagcagtggactgatttacttttctctcatgtaaaggaagtctggactagagttcagctctgcaaccattagggactgaggcttctttaggtttttactctttcacctctcaaaaatggctttgaccctactgtccaaggtgggtccttatgttccagccatcacattgattattttcctgccagcaggatgaagaagggaatgaaagaggcttgtatcttactttaaggatgcttcctagaggttatgcgtgatggcctggaagcactggagactaggaaatgtcttttcaggaggaagggaggtgttgataaaaattggtgattctatttctaaagaagagactggtatttgggggcaactgtcagtctcttccacaggtagtatttaagtgttgtaaaaattgtgaaaagtactcaaatgattgcaggtcaggaactagcgttatagattgtgatattttaaatagctttgatgtatatggtttttcttttttctttttttaatagtttccacggccactccagtgccaacagccaattctacaggtaattcaagatgactgttttcttccttttccttcagtatttttaagctttcttgatggattagttttaaataattatgtaaaagttgttagtataattttaaagatgagtaaaaacttaaaagtcttggaccacagcaattaacgttaatctctaccttttgtgacagtgacacatagctccagtgttttatagtcggtgaatgtgagcagatttgctgaggctgtgtacattgagtctataaagtactttttatagatttagtggaaatcttgggaaatatagaagcctaaagcaaattataattctcatcatccagagcaaccaaaatgttttcagtgattaatttcttctagtcttttttatgtgtatctaaataaatacactttttatgaaattgtacgataacgttcatgcacctttgtatttctttttttcttttctttttttttttttggaagcgaagtcttgctctgccgctcaggctggagtgcagtggtacgatctcggttcactgcaaccttcccctcccaagttcaagcgattctcctgcctcagcctcctgagtcgctgggattacaggcacctgccatcatgcccaactaatttttgtttttttagtagagtcacggtttcaccacattggccaggctggtcttgaaatcctgacttaaagtgatccgcctacctcagactcccaaagagccgggattacaggtgtgagccaccgagcccagcctgtattttctctcttaatgtaagcattatggtatacactttacccatcctgctcttgattagagaattaggccgtctctcattctccatgcagtgaacatcttacatggaattgcatttgtatttatctctgataggtttgagtcaaacagaatttctaggtcagagggtatgattattttaaggctctccagaaagatttattattttcattcccatcaacctggaaagtttttaccgtgccctcaacagcatggataagaactccttaaaatttactaacttgagaggaagagtaaatattaaatacttaacattttaccaatattaaatgcgtctattccaagacaagtactagggtaaatggtagggttaagccagcattttgtctactgtaggaacaatgaaagatctcagtgagcacagcgtattgggaaatttgtaagaaggaatgtgtattgggtgggatgcagatgtggtgatagcttggtagtgaaactgcactggaaaacttggagagagcctctgaagtggagcagcgggtcagcacatgcggaggagatgtgaagtagtacggtgagttcaaagagtgtcccatcctgtacaaggtgagaaggagttaagctggtccatcaccagttgctcaccaggtgagcagaattgggaaacacctttgtatgccttgctggtagacttagatgttatcctgaaagattttaaagtttataggtcatatgatcagacttgcattttaataaaacaacttattctggcattgtggagagtagattggaacgatgccagaaggaactcaggagattagatagcctgttacaataattctagagaacagatagaggtgggctgcagatgtttgcaaataagtttaggaagtagaaggggtaggacttcatgactgagaggaggagaggtagagtgatagggagaaggggaggaattttcaccaaagtaagcaagaaagaggaagagcagtctattgatggttgggcctgtcatttgggattttagtttaagatacctagaatccatttaagtgggatctgttcagtattcaggaaactgcaagtcaggcaagagctcttggctaaaaatataaataggcataggcagtagtagaggcactggaggagcatatagaaagaagggatggggcttgaagaccagactctaggaaacagtaatgtctaagggctaggaagaagacgggaggaaatagggatgggggtagggtagtaaaaaagcccagagaagtatgtgcaagaaactaacagtatgtggttgtgggcgtagtttttcaaaggaagaagtagtcaaatgctgtaacaaggacaactcatcttgaaacacttacgcagtggtgtgtggagctggcttggaccagcttttgctagccagttattgtgtagtagctcttcccagcccatgttcagtgataccatgttggtaacttgaaactggttaccatggaaatagtcatgccatggaagtctgcaaatgatacaaaacttattttgagctgatgattatatggtgatgtggtcgtaaatatttaacactcattagaagacattgactaagtaggatgttgaaggttgctgaaaccagaggtgtttggagaaaagtaattttcagaaggttggttatgaaaagaaaatggggtgcagggagtgggggaacaatttattcagaactgttgttcatttcttgagaactgggttcactcttgatgtagttctctgcagctttctccaccctgggtcctcctgtgaattgccatgagtcttttgtgctatagctctctttggtgctgtaaagggggaaagcagcaagggcttatctgcagaaaatgcatcagttgactgacactagttgaagaacaaacctttaggcggtttcttttccgggcatgtgtaccgtctgccgaagagagcaagtgagaagtgaaggggtagttaaacaatgcaaagagaatctaatttatatagaagggtgtataatgaggttaattataatggccctccttcagtacaaataatagaatagccaaaatatgtcagatacagtggaaaatgttcatatgaagtggaagatgaactgtattaagcaattgtaatacaattttagctcttgttatatacatgcctagaaaaatggcaagaagtaacctgttactctgatgggactaattcagtattttttttggcattttctagattttcttaccactaatagcaacttttataacttatgattattattatttttttttaacctttcctaatgaatctttttttttcagtaaaagaaacagtaggtcaacagaggtatattccctaagtggtgcttttattttgaaaatattgtcaatgcaatacttttttcaaaatcgaaaataaaatattttgcctacttattaaaaagaaatagtttttaccttgttctgaggctgggtaatgagaaccaaattgcaaatttgcagaatttttttcctaacattgtcaaacaattggtaatagtgttttgagattgaacagaatttgatgtgtttaatttgtaaagtgtatttttttgtggttacacagaagcagtaaaaaccttgacagaaataatgagctttaacataaccacagcctctaatctaagaattctgtgtaaggaccagtcttaccagagataaggtcaaatattttcctgtaagattttctcagcatggagagttgagagaactgtttaatcaagagcaggatggatggaagtatgtacaacaatgcttgaagtaagagggaaaaaagaaagcaaatgggtctgaacatatccatcagtattatttgtatatcacctattagcttctaagtagtatcaatattaataaaagaagtcttaagctctctgtgactcatggtcatgtgaaaattagaataccttagtttcctaggattcagtcaaccttgggattatgggtagtcagcctgttacgagagtcctggtctttaaagatctacttttagcaacaattcaggtatttagcaatatctgaaaactgtcaagccctgctcttttagtgtatatttactgttaaagcacagaacttcctcttttatattagtagaatttgggaggatgctgattcctattgaggtttttgttcgattgtttgaaagtctaatgcagtgaaaagattactcatttctgtgcttcatcaacagttatttggcaccctttccctgtctctcgtgggttaagcatatcactttgaagtctgttcagttatgtactttaaacagaagtaacatttgttttccaaattctctttagccttcaaacccttttttctgaaatagtacaaaaatgaatgtttgcatagcaccttacatttttataaaaatataaatctcatatgattaatcttcctcatctttccccagatcatccctagcggcccaccagcataagcatatcctcatattgaagcccttgcactctgaagcctgacttacctaatgatttcctgagacaaaataagctctcttagctagtgactcctatagtgcactttccaaaaatttgaaccctacccttaggacaacctcttaatgaaacctttctcaaatgctccagcaaactttgaatttatttggtagccatttggatgttagaaaaaatgttaatttgtagaaactatattcacatccttcctttctgaaagccttggtcagacttctattagtattcatactaccaatagaaacttaataggtgatatactggctggacgaggtgagtcatgcttataatcccagcactttgggaggccaaggcggcagatcacttgaggtcaggagttcaagatgagcctggtcaacatggtgaaaccctgtctctcctaaaaataaaaaattagctgggtgtggtggcacatgcctgtaatcccagctacacaggaggctgagggaggagaatcgtttgaacctgggaggcggaggttgcagtgagctgagaatgcaccattgcactccagtctgggtgacagagcgagactccatctcaaaaaaaaaaaaagagtgctttagtccctaaaatgattttacattcaaactaatccttctcagagtgtacatttctttagcagtatcatcagctattaggttggtgcaaaagtaattgcagttcttgcctttagtaatggcaactcaaatagtattttggcctcatgcagtgtggtggactagagcttacttaaccttgggctcttagaatcttacgttggggaactgtgggcccagggcccctgttcttataaagctttattggaacataccatgcccattcgtctgcatgttgactttggctgcttttgcatcacacagtgcccaaagagtaaaatatttgctttcaacccatttaagaaaagtttgccaactcctgaagtgaagaagataggcaaatctcaatacccttgtaagagagaacttacgactttaatagtttttgtcttaggagaaagattatgaagaacctatagtttcctcacctaaatgttcttgcccttggcagtgagcaagataagagtttttgcaaattttatccagatgtatacatagattttatacaagatagatacatagatattaacaattttatgattgcttattgttttaaaatacacttaaatcctagtattcttgggtgcatagctatgttagtgaaccattaactgaaatttggcttttggtctctaaaaaattgaaagcatgttgaagttggcaggattattttttaaagctgttagataactgggaagctagaaatttaaggttttttaaaaagacattttgttttcattccagctaaacccacagttcagccctccccttctacaacttccaagacagttactacatcaggtaattgaggctttttagattagcaatgatgcaggatgtgtgcacgatgttgccctttacaatttctgccatcattttccagctttcttcgttaatggttatggaactgaaattcttctcttactcttaggggggatcaaggtagtgctttgttaacacaataatgatagctttgctgagattcctcttctcatttttaaatgtgtaatcacatttgacgtgacactttagaattaagtaataatgtttttccaaacatttcagtacaacttgtatgtaaaatctaatttgtaacttctgattaccgttagggattggttgtgtgctgtatgagagagcatggcgatttgagggaagataatatatccgtccttttcactgagaaaggtctaaaaagccagaatcactaccagatgtgcacctcactttcttaaccatttcttaacattgctcagtaatgtgaaaattagcttgttattaaatgatgatttgacataatctaatttaattcatagttaggttacgccacaggatactgtaggtacacaggttaggaatcctttcctccctccatatttttaaaaaactgatgctaatgaatcttctacctgctttttgtgatttctttttcttcatgcttatgccacctttttctcagtttcagtgaagccattctgtcttcacgagaaggaatacaaaacagttgtcattaaagttaccaacttgtacagccaccagaaccagtgttctttgataactgttacttttttcttagattattttaaatggaaatcgctttttctgtttcctcttgaaacattttactgcctgaaaagaattcagatatttgttttttccttattacttgataatactttctcatgtgaaatttgttggcaggatatgcctttaaaaacagttattttacttgttgaaattataaattgcatattattaagattatttttgtaacatgaaaaattgcaaccaaatattttaccttatactagtaaattcaaaagtcatgtgaattctcagcactattgacgtttacactcacaattaactaaaagtacatagtctgaagaaattgttgcatattttagaagtgtttgatacattcccagggcacaatttatgtactaggagaatttttcccattgtttttatatttgtactagtacagtagcattgaccactttgtatccttgggtggaatgaaaaatgggatatggttgtcttcctcaattagggataaattctagctgtaaagacttgaggaaatactttatagaatttaacacatggcaaaatagaggctcaggtgcatctttaaattacaatagaggaccatgaaacttaggattgttgtttcttttgtcttatctaacaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaatagtgtgttactgcgttttgcttataaaatttaatgcttagtggatttatcttagtccgcttggggtgggctttctactcattttattgcacctctagaccagccgatagtaactaaggcacatgttcatatcaatagaaagcagagccttggaagtaataggtggagggaggacttggtacacttgtgggagtgatttgcaagttgatcttccacaaatcaatagaaattatgctgtagttttccaataatttttgagaggaatactatcttggttttataatctgaaagctagtttgtgactttctgcctttttagttcatattgcatataaagtaaaaaccaagaactatttggtataaattactatcaagccacatgctgtgactttgaagtgtggttcttgttattttgtgggcaaaattatgttctattttatatcagtggacttgaactaagaatttactcctctgtaagccttaaaacctgtaagggtggactgaataattcactttagaaatcatgaattttgggttttgtattagccttaaatatagtcacatttggtttaagtaatacaaaacttgatgctaagcttagtgactctggtaaacattagaaacaattttttttttgagatggagtctcactctgtcgcccaggctggagtgcagtggcgcgatctcagctcactgcagcctccacctcccaggttcaagcgattctcttgcctcagcctcctgggtggctgggattacaggcacccgccaccatggccagctaatttttgtaatttttaatagagatggggtttcgccatgttggccaggctggtctcgaactcctggcctcaggtgatccacatgtcttggcctcccaaagtgctgggattacaggcatgagccactgtgcctggccttgtccagtgttttttagtcattcaagaatccagcctcatttcatcccagctggaagaaaaagttcaacatagtgtttataatgtattatttttaaaattttcaattagtacatagattttcttaaatatacttcttagaaaagaaattgcatttaaatattatagatgtggtgtcagtctgctttgaccatccccagcccttttctcctcttgccttcctccgcttaccagagtggtgatacagaggtaatcactgtaactggtttacaattaatggatttataatcacataattgtatgtacctttggaaaataatgtcatgtaggttttttttttaatcctgtaatgttcattcactttttggagatctttcaaaggtagtgtatgtggctataccaagttgtttttttttattttttaagttctagggtacatgtgtacaacatgcaggtttgttacataggtatatgtgtgctgtgttggtttgctgcacccatcaacttgtcatttacattaggtgtttctcctaatgctatccctcccccagcccccaatagaccccagtgtgtgatgttcccctccctgtgtccatgtgttctcattgttcaacttatgagaacatggggtgtttggttttattttcttgttttctgttttgctgagaatgatggtttccaacttcgtgtccctgcaaaggacatgaactcatccttttttaatggctgcgtagtattccatggtgtatatgtgccacattttctttatccagtctgttattgatggacatttgggttggttccaagtctttgctattgtgaatagtgccacaataaacatacgtgtgcatgttctttatagtagcatgatttataatcctttgggtatatacccagtgatagggtggctgggtcaaatggtatttctagttctagatccttgatgaatcgccacactgacttccacaacggttgaactagtttacagtcccaccaacagtgtgaaagtgttcctatttctccacatcctctccagcacctgttgtttcctgactttttaatgattgccattctaactggtgtgag

SEQ ID NO: 12554 - DNA, 44870 bp, Human
cagatccagtgacactggaatggacacctttttgattttggggttccttcctaagacccccatgtgtgatatattcatggttggattctaggtactgaagcagttactacagctggatagtccaatgagtgtaagaaggcttctctacaaacacatgctgcccacatcgaagttcctctttaatctactgcagtttgaaattgtcccccactttctccaagagtccactccaagctagtttagggttaggtctaccatagcctttggaagagggagggaagataacttttctcatctctcctagtcccagctctaaagaccagaaccagggagaaagcaacacagcttttccaaacacattccccaaatgtggcaccttttcaacaattttagtaacaaatttaaggcatcatagatgcctttaaaattggcatgatagatgttagagtgatcataaaaagactttaaaagaggaaaagatgtaaagaaggtaatcaaatggggagcatgtttaacaatgtgctcacttcttccccttcaattccttgaattgagtctgcattatcattcctattgatctttgagcccagaacattactttgtggtctggcctaaggtttcttccaattttttaaattacaatatccctaagaggacagcgacgaggtctggggtgttatgaggattggaaacctagccacaagtgaccatgaaagtccaaaatgcctctaaagtctttgtctctaaggcccattttcaaggtcttgttatatagctaatttttccccgacttatgtcaaaaataaacgaagctgggttctaggtaaaatggtaggggcagattttaatcactactactactgcaatggggaaaagaacccagcgtgaactgaattcaatttcgatttgtagaggcaaccgggcgttttaaagagaatgaaggaattaggatgggactgatgacgccgagggggactgagcaactttttcaggtttgaaaagcctcaacatcaacgcgcgacggcgctctttcaacatcagcctccagaactggggctgcagccaggagggaactacaacgcccagcagccccggcgggtgtaaacactcccaacttccgaggcggtgctcaccatcggccatcagcgccagtgccactcgcgccctcaagaagccgcacggagttcgggccggcagcagcggctgcagtcgtatggcagtgagccgctgtctacccagcgagacggagagctcaggacgcaaccctacgagttggaagccgcaggaggcggaaccgggttgcgggatacgcgttgacgtcacatcctctgggcggggccgcaaggaacccgcgcaaattgaaaggtcagcctttcgcgcgctgtgtaggcaagttgcccgtgttctgcgttgccggccgtgggtgctctggccacagtgagttaggggcgtcggagcgggtttctccaaccgcaatcggctccgctcaaggggaaggaggagagtcccttctggcaaggtggaaggagcgggctgtgcggaggctaatgggtgggttcccttgggggtcgacctgcgcgtcacctccgaccctcctctcgggattcgggtcttccaggaagggaaggagagggtctggcgtgatcttcccaacccaacagcggagcccttagcctgagtggagtatgtgttttgttccgaggggacgtctggcaaccagaggtctgcagttcagtgaacggagggagataagagagcagacgattccgggctggagcaggcgccagggttgccagacttacctcatttttccgcagaagctggcagtccaggttttacatgcaatctctccacctttaaatgttgacaagtacattttcccataatattttgcaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtaagagactgtttttctgaaactgtggcttgaggaccacctgcatccagattaactgctttgtttaaaattcattcacagcagaactagtgaatcccagtcactgagtggagttgagagtctaagaacctctgaaatttgagaactgctggaccagagcctttagagctctgataaggtgtcaacagggtaaagctgcctcctgatcctgtactttctttcttcctttccttccaaacttaacgtttgataggagagatttgtattatgaaatgctaagcaactgctcagtgcccattactgactttttattgtagagtggggggaggtcgtttcatcagaaagggttgtgacagttccagaatctctgtatagaaagggcttagggggctgcaaccggaatggaagggggtggaaagttaaagcatttgtcttgaagctgtatttgcatagcagacgcagtttcacagttctttagggtagctttcagagaggctgatggagttgcccctgggcgccaccactgtttattaccagaatgttcgtgcttagaataatgcgttctaatagcagtgaatttcagtcctaaaaaagtacaggatcatttctgtaattctttttgaatttttcctttgttttttaattgaaatacttaccttcctacaaactgttttgagtttctactcctatttgaatttgcacgttgacccttatgattaatgccctttgtagaggcaatgcgatgccatcgcatgcatggttttgtttgtgcctggctccttgaagcatgtgtcaggagtgaaagtgcaaaagcactttggaaagactaaacaaacaataagcaacagtcaagtggcattagaggtagtattagtgattaatgtaaattctaccctatggaaattgtttgatagggaggagcccagctaaaatattaaagagcagtgattcttgaatatctgaacaatttctggccgggcgcggtggctcacgcctgtaatcccagcactttgggaggccgaggcgggcggatcacgagttcaggagatcgagaccatcctggctaacatggtgaaaccccgtctctactaaaaatacaaaaaattagccgggcgcggtggcgggcgcctgtagtcccagctactgggaaggctgaggcaggagaatggcgtgaacccgggaggcggagcttgcagtgagccgatataggccactgcagtccctcctgggcgaaagagcgagactccgtctcaaaaaaaaaaaaaaacaacaaaccaatttctgcattggactccaagctttctcttcatttgtctaagatgttttaataaatgtatttttctttaaatattactgttctccctgtctcttttcatatcaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtaagtctggaccttatgttaattctttgacaattaagaatgagacctacagtgcctttttttctcccccagaaacggattgttttcactcaatgccagaacttatcaggaagtaaaagttgtatgttttagaatattcccaaatcagggatgacttccttctgtgataataggcctagttttctttctttataataagccagagtatcaagacactgatggacaaagactattaatatctcctttattctttttttttttttttttttttttagatggaatctctagctcaggctggagtgcagtggcacaatcttggctcactgcaacctccgcctcccaggttcaagcaattctcctgtctcagcctcccaagtagctgggattacaggtgcacaccaccatacccggctaatttttgtatatttattagagacagggtttcaccatgttggccaggcaggtctcaaactcctcaagtgatccgcctgctttggcctcccaaagtgctgagattacaggcgtgagccaccatgcctggcccaattcttaacctaagataaattttttaacaaatgctttgaaaatccgtgatgatttctgactcccacattcttgggtacagaaaacatactgctaatcctggttagcaaaaaaacaaatgtgttgtaaaattcattataatttcatatttgctttctcctgaattttgctttatgatcagcaggtcccaatcattgttccataccaatgcaagttcactgtcactgatctacaacacatagaaaaaataaggataacaatgtagtgagtctttcatcaagatgacatatttaaaaggtcatcttttttttctttattttagctgctaagtttgcgttatgcaaaaagattaaagattgttttcccattcctgtttttgagctaaaatgtccttttctttataaaatgatagaagttgtaaatgcagttgtttttgtcacaatacctaatgtaatacctgacccttgattggatcctggatttggaaaaaatagtagcagtggtgtcctggagccaattcatatgagctctttatacaccatgtcttctcagctcagcattcatttgagttcaagtaggtagctcatctgccattgagaaatatttatctcagggaaatcaggcacctcttcccgcagaactggttgttaaacatttaccaggacaccactgaatataagaaacattgttgagacaagtgtaccaattataatataaactgagtattagataatattatgttactattaaattacttagctgtgatatggtgtcgttggaagaatccagtgtttattgtactattctttcaacttttcaatagatttgaaattttttaacataaaatgggggggaaagaccagatttgaaaccaaagatgtcagaattagaagggatatcaaagctctttaattcacagataaggaaaccaaggcttggagggtcaagtagttcaccagacatcacatggctcgtaagtatccaaggcaggatttgaatccaagtctagtaagttagagttccaattcctatgaaaacatctgcttaaaataacaaaataaaaaaccttctctttccatagttttctcatctggcctaaaatagagcagaagtattaccttaagaaaggtgaagcactgaatgtttttctttttttccataggtatgtaggattttgtatgaaatttgtaaatatgttactatctcatgggatcaagcctattctcgtatttgatggatgtactttaccttctaaaaaggaagtagagagatctagaagagagtaagttaattctctacttaatctctaacttcattgcactaaggtcagacactgtagtctatatgataccaatttttaaaattttaagccaggctcagtggcttgcgcctgttgtcctaggtactcgggaggttgaggcaagaggatcacttgagcccaggagttcagcaccttagtaccctatgatcatcgctgtgaagagccactgtactccagcctgggcaacatagtgagaccccgtcactaacaattttatctttattttttgacagtctcactctgtcgcccagtctagagtgcagtggtataatcttggctcgctggaaactccacctcccggattcaagcaattcttgtgcctcagcctcccgagtagctgggactacaggcacgtgccaccacacccggctaatttttgtgtttttagtagagatggggttttgccctgttggccaggctggtctcaaactcctggcctcaagtgatctgcccgcctcagcctcctaaagtgctggaattacaggcatgagccactgtgcctggcctaaaaaaaaattaataaataaaattttaatttgttgaggcttattttatagcctagtatgtgaacagatttccttaaatgttatgtatctgctacattatcacttttgtttaaaagtatcttcgttactacattttctttgacaaaaagaattgctgtggaaaagcctaatggtaatcttgtgtgtgtgtgtgtgcatataatcattctaagtcacttgttctttttgccttagaagcctaaagcatctgggttaatgttctcaagggcctggtgtgtactttctaatgagtcaaaaacttttttcagttctaggaaagcttcttgaattacagttctgttacagtttcttgagtcagcctcttaaatgttttatatttaaaaaatgttcttcccttgcagaagacgacaagccaatcttcttaagggaaagcaacttcttcgtgaggggaaagtctcggaagctcgagagtgtttcacccggtctatcaatatcacacatgccatggcccacaaagtaattaaagtaagacaaaggggcagatgggcaagttcaccaaagctagttacaacttgtttattgatgggagaggaagaaaatcaagggtggaaaattgttctaggcctaacctcaagtaaagggcagatgtcagaaggagaagggaacagcatcactagatagagaagacttcagcaatttccaaggagaaatcctaaggcataagtaaggctctctcttttaagtcatgttgttccatagcaatggaaggaacagggccaggcacggtggctcacaccagtaatcccagcagtttgggacgctgaggcaggagggtcatttgagctcaggaatttgagaccatcccgggtaacataatgagaccctgtctctattaaaacttaaaaaaatgaagagatggaaggaacaaattcctggaggcatcggtctcacccaactctcctacagtcttcaacacttactgtaaccggcactcttgaatgacagatctgtgatgtagcttcgttgccccaggcaccctacagacttctgttccctttcacctcctccttgcagcagcttctttccttattcctgtaaatcttagtgtcaaggtgcccacattcccagccctcactttcccctttttagagcctgcttggttaaggtgttgtggtttttttgttcgtttgtttgttttgaggcggagtttcactcttgttgcccaggctggagtgcaatggcacgatgtgggctcactgcaacctctgcctcccgggttaaagcgattctcctgcctcagcctcccaagtagctgggattacaggcatgtgccaccacgcccggctacttttgtatttttagtagagatggggtttctccatattggtcacgctgggctcgaactcccaatctcaggtgatctgcccaccttggcctcccaaagtgctcggattacaggtgtgagccaccgtgcctggcctgttaaaggtatgatggtaaaggtgaagtcagctttttctagcttacagttctgtcatccagttcctgagctaaaataggcgctacagttctgattttggctttgtcatttgagtctctggctcttttctgtatgggtcaagctagaaggaaacgatgcgatgcaggacagagcgtgaagtataaagaaatgtgtgctctgtgtagtcaggagaagagaggctgcattgtgtgcggaagtagagaagaaaccctgattggacacaaatagtggtgtaaaagtgtgtccagaattggtgggatcttggcctcactgacttcaagaatgaagccgcagaccctcgcggtgagtgttacagctcttaaggtggcgtgtctggagtttattccttctgatgttaggatgtgttcggagtttcttccttctggtgggttcatggtctcgctggctcagaagtgaagctgcagacctttgcggtgagtgttacagctcttaaggcagcgcgtctggagttgttcgttcctccctgggggctcgcggtcttgctggctttaggagtgaagctgcagacctttgcggtgagtgttacagctcataaaagcagcgtggacccaaagagtgagcagtagcaagatgtattgcaaagagcgaaagaacaaagcttccatggtgtggaaggggacctaagcgggttgccactgctggctggggcagccagcttttattctcttatctggccccacccacatcctgctgattggtagaaccgagtggtctgttttgacagggtgctgattggtgcgtttacaatccctgagctggacacaaagattctccactgtccgcatcagattagttagatacagtgtctacacaaaggttctccaaggccccaccagagcagctagatacagagtgtctattggtgcattcacaaaccctgagctagacacagggtgctgattggtgtgtttacaaaccttgagctagatacagagtgccgattggtgtatttacaatccctgagctagacgtaaagattctccaaggccccaccagactcaggagcccagctggcttcacccagtggatcccgcacggggctgcaggtgaagctgcctgtcagtcctgcgccgtctgcccgcactcctcagcccttgggtggtggatgagactgggcgccgtggagcagggggtggtgctcgttggggaggctcgggcggcacaggagcccacggagcgggtgggaggctcaggcatggcgggctgcagtcccgagtcctgccccgcaggaaggcagctaaggccccgcgagaaatagagcgcagcgccggtgggccggcactgctgggggacccagtacatcctccgcagccgctggcccgggtgctaagccctcattgcctggggccgacagggccggccggctgctctgagtgcggggccgccaagcccacgcccacccggaactccagctggcccgcaagcgccgggcgcagccccggttcccactggcgcctctccctccacacctccctgtaagctgagggagtgggctccggccttggccagcccagaaaggggctcccacagagcagcggtgggctgaagggctcaagtgccgccaaagtgggagcccaggcagaggaggcgccgagagcgagggagggctatgagtactgccagcacgctgtcacttctcaaaaggatgagagtaggactattgctggaccaaaaaaggaaaaaaaatgagaaaaatagcaaattgttaccaaaattgatagcagcaggatcttgatacctctttcctctttttttctttttttcttttttttttttagcttcccaaagcctgtcttcaggccttgggaaccattttcccatagtttagaacatggaagttccagttccagctgcctagattttgacacagcggctatgataggggctgtttttcttggcaagtttattttaaaagtattttctcataatgcattggtttaaatatagtgctatagcctataatatatatgtaagatacattattagaggagagttatgtatgtgtgtatatatacgtgtgtgtgtatacgtatacacacatatacctacgtatatattttccccccaagacattgctggatatggtctataattttatcaatactgtgtcagtacactgactttcgtagcttgacaggacaacctgttatttttatggggaagatatattcaaaactccaaacaaatgtatattttaggaacatagccattcttaagatggaagttttctataatttaaaataagtgggccaggcacaatggctgaacgcttacaatgccaacactttgggaagctgaagcgagtggatcacttgagtccaggagtttgagaccagcctagacaacatggcaaaaccttgtctctacaaaaaatacaaaaaaattagttgggcatggtggcatgcacctgtagtcccacctactcgggaggctgaggtgggaagatcacctgagcccagagcccaggaggtcgaagctgcagtgtgccctgccggctggcaccactgccactccagcctgggtgacagagccagaccctgtctccaaaaaataaaatgattacttttgtaacttgtaggattctttttatctctggctgtgtagcagtatttcttttctccaaattttataagttgattttttaaaaatgtcttaatggctatataattagttcaacatatactaaaacttatagtagaaaaactctacttcaaaggaaatgatttctcaaagtaatattagcatgtgcctgctgaggctagtaataaagtgggtttgaaacaggaagttgtttagtactttccagatgccgtgctagagattcactgtgattctctcttctaggctgcccggtctcagggggtagattgcctcgtggctccctatgaagctgatgcgcagttggcctatcttaacaaagcgggaattgtgcaagccataattacagaggactcggatctcctagcttttggctgtaaaaaggtactcacctctgactactatatattacttttctatgtagatagtagtgtaaatcaaggagctgaaatttttcctgtccaggaaattatgataatttataatatttataaaatttataatatttataaaatattacaaggtaaattattgtatttaatagatatttgcaactgacatctatttttataatgttaataattatttaaaatgaaaagaagggttttgctgcttgatgtttgtgtaatgtggatactttttcaaagtaagcccttaaggttggaggggtttgttattgttttatgcagattctttagtagaatgtggacgtaccagttttattttttaataatgacaacatatgctttatatttcttgattaggttaggtatactaacttatgtactaaagggttgccatgcagttatttagaattatgtataaaactatttcatggaaaactttatttaggggagaattaagatacaaaactacaggatgttctcatttttgttaatgcctatatttatgactagaagggtctctatcaaaaggttaatactaggttacagtgataaatgagggaatagggatgacttgttttcttcctgaatttctatattttccaaattttctacaataaacatgaattgcttcaataataaggaaaaagattacttaaaaggtacaagtgacagagaaagagaaaatgtttttcgtatgcattactgtttgattatcatgacaaccctgtaacacaagtaggaaataaagagatgcaaaaagagcttgctttataccagaattgtgacagttgagtcctagctgtatagccttgtctagtcatatcctatgcttcagcatactttatttgtaaacttagtaatcatcagcctgtctatctatgtctcctgtctttcagtgttatggtgaagaacaagaaagatttcttaaaattattgcagtggattagataatgacaaaagtggcccttctaggtattaacaatttcccttccttttgaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggtaagagtgatttgctaagtgtcatattcaatttctgaagcatttccttaataaaataataaatcataatatggatttaaatattctgttatgcgaataacctatattacattattaaaaggagcaaatgactgaggcactagaactttgccttagcaactaacatatattgggaaaatcatgttttctgcaattggcaaaaaagtagtgatttttaaaacaaagactagtataaagaggctcaaggagaaaatattctagggtaaaattaaactcggagtcttttgacttctgtgctataactctatagtagtggttctcaaactgtttggtcgcaggatccctttacactcctcaagctcctttatggtaatattttttgtttatgtaggcgatagctattgatatttactgaattaaaaattaaaacaaaaatttaaatgtttatcaattcacttaaactttataataaactcattacatgttagcataaatagcatgcttttatgaaaaataatcattttttaaaacaaaaattatgagagagaggaatcatacatttatgcaaatctctttaatgtggcctaatagaagacagctgtgttcgtatacaagttgaacatccctaatccaaaaatctgaaatgttcaaaaatccaaaactttttgagtcccggcaggcaagtgaaaaattccacacctgatctcatgtgaagagtacacaaaataattaaaaatactgtataaaattaccttcagtctatgtgtgtaaggcttatatgaaacataaattgagttttttttcttcttcaccctcttgctgtcagtgtgtggaaacgtaaatggattttatgtttagacttgggccccatccctaagttatctcataacgtgtatatgcaaatattccaaaatctgaaaaaattcaaaatctgaaacacttctggtgccaagcattttggataatgtgtacccaacctgtatctgctgccttattaagcctcatttgataccatgtatcatatatcatctggaaaattctgagactctggacattgctactttgtagtttgtcttaaaaaataaacatcaaagaagctcattttcccccttggatattctctaaacccttaacagtttgcagagcagaaatttcatttttctatttccaggagtataaggcctgagtcctcaggactaagagtgatgtcatgtaatggaaagatctctaggttggaagatagtgtcccaggtgggaataggaccacgtgccttaactagcctgtgactccaggatccgtttggttctctgggccttccctttttcatctatgaatttactgtgcaatgtttaggatcctttccagctttaagcatccatgactctcacagaaatcagaatgtcaacttggtttaaaaatatgatctagaaatatttgcatttttttaattctcagattttggatgttctttttttttcctttcttgataaaaaggactttgaagatgaatggataatgtatctcaaagttacacctagaagcacaaacttgatgtactatataactgtattttttttatccttcaaattagtaatagaaaaaccaaagaaaatactagttatgagacttagaattttaagtgatgtaacatggttgtgttagctggtagaattttttaatgtagatgaaagcagttaatgtttcaatccctctttatgaatgtaaatcaatcagccttgaggataatatgttccctgttctttagttgcagataaaatatttttgcatgcattgttaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcagtatcctttctgaaacagaatggtagaatttgtgcatttttcttcaatatttttatggtgatttttttgtgaggcatttagtaaaaagcttgcacattattttttgctctcttttttatagtgaaatctgtatattgttcatttaaattaccatgctagtgaaaattgagaacaactttttgtttataaacccgaggctcatccactatgcatcctgattacttagattgactgacagtagcatgcacagggtccgtcacttacggtacacattccaaaggtggctcttgagaggacctcctcgtggcaagcaagctcgacttatcaggaagagcattctgggcatttgagtgcatcaggagaggatgcccttcccatagccactggccatgtacatgcaggctgatgcagagccctgagtcacttaggtggtggctaggactttcccctctgtttcccttaaagggagggagtcagtgatggcctgggcccttgtcagaagacaccaactcctgcagagacagatagagactagcaaactgtgtctgctttcagtaatgctgatgtataaagtaaggagactccatttaagtcataaacctatggattttcgtgacaatagaaaacatttttccatcttagtataatatcatttggttggttgttaataaatacatttttccttaatcttgctaatctagatatgttgatgattccatagctcttcaaatagcacttggaaataaagatataaatacttttgaacagatcgatgactacaatccagacactgctatggtaacgttttgatgaccaccctatgaaaacacgttttagttatgtcccgagctgtgattaaaggcaaatcttcatacactaagcttcttttaagcgtttctatatccaggctctgtgcagaatgtacattaaaaacaacttgatcctagagaaattacatgtattagagcataggtatattggttaattttttaaaattaagaagtgactgttatttattatcaaacccttatccttgagcatttcatttgaatataccaagcatttgatgcctttttttctcatctcactccattcggcttctgtggcatttggcatcattgaagacccaagcctaggaatgctacgggagttaaagctgttttttcactcatgcacaatttaacaaatatttaatgcacgcccctgctgtttctttaaacaatttgctgttttcttttatttttcttttttgagacagagtttcattcttgttgcccaggctggagtgcaatggtgcgatctcagctcaccacaacctccgcctcccaggttcgagcaattctcctgcctcagcctcctgggtagctaggattacaggcatgcaccaccacgcccggctaattttgtatttttagtagagacaggatttctgcatgttggccaggctggtctggaactcccaacctcgggtgatccgcccacctcggcctcccaaagcgctgggattacaggcgtgagccaccgctcctagccgcgatttgctgttttcttctgcttcttcagtattgtatgtattccttaagatactgtctcccatcattgtctttctctttgtatttctgtttatcctctgttctcttttctgtttacatttcttccttaggtaagtccttagggctttaatcccatttacgtaaagaactcacatctccatctttactccagtctctcgcctgtgcaccaaccacagaattctcactgtctcttgcgtctctgatttcctgtagcctccaagtctatttataggcaaaactaaactcttcatgtttttaatcaacttttaatcacatttctcttttatttcctacttagcacttattactgtataacatgcttctattcttttctgattctttccaatagaatgtggtcttcataaaggcagaacttggtgatcctcactgctgtatgatatttactatgtttatatgttgagtgaatgagtgttagccacaggtctcttttgttctcacactggaaaacttggaaataaactttggcttccatttcgttgctacatcctcttgcctctttgagttgtccttctggttaacattttcttcttttcccaagcttccagtttaattcttgctcactaatttatttctttactaaacatttatcaagcactgaaacaatgtaattaggttagctagggttctggaatataaagaaaaataagaaatacaggaaaagtaagatccttgcctgtcaaatgcccattgcctaaataggaaggagaagggattctatagaaagaaatgcggtaagtgctacgctaaagaggtattccaggctctgtggaaataaaaagcatgtccctcactccacctaagagaatgcttcctaataataatggcaaacattttctgagcatttgctactttccaggtgctcttttaagcaccttagacatagtaagtcatttactcttcagaaagcctctgaagtcagcaccattctcattttacagatgaggaaacaattagaggacacttaagtaacttttccagctgaccattttcgtaaataggggagctgtgattccaagccaagttctctactgtctgctgaaagagaaactgatgtgtatcctcagtttgcaaggattagtagagtttttcaagatgggtgattccaggctaaaaaaaaaaaaaacaaaaaaagcgtatgtagaaaaaagtgatatattaagggaactcttagattgttcattatggatgggctaagaatatcttagtgtttaccatgtaaaggaaccagatcttgagaaaaaaagaagtgagcctggaaaagatgaccactaacaaactggtgatccattcagcatggaaaagtaaccattactgtaagctgaaataagccaagcctaccaagagagcacaaatctataacgaccctaaaaatgaactttatcagcttcagtgatgtaaaccttacactcaggttgctattcccctattttctaaccttgctccatgtaatacggtagccactagccatgtgtggctatttaaatttgttaaaattaaatacaattgctattttacttccttagttatagtagccagctttcaagtgcttagtggttagtggctaacatagtggacagcacagagcttttctatcagtgcaggaaattctgctgaattctttacttctactatcatatttttatatctagggactctttaattgtacttttttttgaagatttagatgtcatctcttatctttctcagaatatgataattttttgaacgttttcttccgctctctgtaactgctgtgtacctttttcctgtgttgatattttctccctcatggtggtaacttctggccagtcatatttgaaggggccccgaaaagctcatggggaacattgtgtgaatgagtggggcttatgatgttggacttcattcttggatgatgtggttggtaacacattggatttgatttgtgaattctccaatgttggaatgttctctgcacagttacatttttccaaaaagagatgtctgcttagggtatctaaactttggctgtctgtattttgaaagcaggatagggaaagtgagttggggcaggccaggaaagggtagcatggttccttgccattcaatatttagccttttgtttcatctctgttttcagacaaatgaatctatcttcagaaatgcctgctatgtctgttactctttgtgggtttcaaaagttcaattgttctggttctgaaggcaggtagatgtttgttgactgtatagtcaggttggagatggggacacagggtcaaataattctctctttcgttagtcattcccccaccaggggcttctgtaattccaagactttaattcttgagcctttctccaggtttctgtaggtggaattggcttctctttgatattctcttctgcagacaaagtcttttaatttcttccatctatgttctatcttcactgtggtttagaagtcacagattatctcctaatttttttgcaggttaattttgtgtttcttattgttttgaggaatgattatggaaagaaggagactgaaaagtgctatctttacacagctgaactattgacagtatttatcatttctttctttctttttttttttttttaaatttgagacagggtctctttctctgtcctccaggctggagtgcagtggcaccatcagagctcctgggctcaagcgatcttcagtaactggcatcaagcctcttgagtagctggaactacaggcacatgccaccatgcctggctaattttgtgtgtgtgtgtggggggtctcactatgttgcccaggctagtcttgaactcctggcctgaagcagtcattctgccttggcctccaaaacttctgaggttacacatgtggagccaccacacctggccacagcattatatatatatatatattttttgacttgaatatctctttttttttttttttgaacagaatctctctctcttgcccaggctggcacgcggtggcatgattttagctcactgcaacgtctgcctccgagtttcaagtggttctcctgcctcaggctcccaactagctggaattacatgcatgtgccaccacgcccggctgatttttgtattttagtagagatggggtttcatcatattggtcaggctggtctcaaactcctgacctcaggtgatccacctgcctcagcctcccaaagtgctgggattacaggtgtgagccaccatgcctggcctataatttcattaagaatgattcttaagcttttcctttgtctcagaaactcaaaaatagttgacagtgttgagtatgtcccattaccaattgtaatgttatggaatgctaagatggccatccttcatcagctcaaattcctgtcagaattttgtccttctcatagagaaatttctataggaaccataattgtacaccaaatgagttatttttatgtatctaaaatttatttagtctggttttctacttgtctatttctctttcttatttagtaaaaccatcagtgggacctaatgccatgagccatactgataaagctatctttttatattcgttccctcaattaaattaccttccttattaattctcaaagggtattctgaataatgtcacctgttttatttatttttatttttgtcctttctttaagtgaaagggtttgattagattctgagttcatgtgggatttttgtcaggtgggattgtaatgattttttttgtgtctttgctaattttttccctttggctgtccttctctgttagaatatcattgacatcctcttagcagatcattgtcttccaaaatttgtagtaattgtgaataacttatattagcattaaaagtgattgctttccttttttgtttgtttgtttttgagacggagtctccctcggctcactgcaacctctgcctcctgggttcaagtgattctcctgcctcaacctcccaagtagctgggattacaggcacacgccaccacacctggctaatttttgtacttttagtagtggcagggtttcaccatgttggcaaggctggtctcgagctcctgacctcaagtgatccgcctgcctcagcctcccaaattgctgggattataggcgtgagccaccgtgcctggctgctttccatttaaaagacaccgttttcctgaccacatttcttcagttgtggtcttatttcttgcaccatttgtattacgaagatttttatttatttatttatttatttacttttaatcttttttttctacagctgctagcaactcttgattttttttttttttttttttagaaatgagctaacaaagttgcttgactctcatcagaagaaaaacaggcctaggaatataagacacatttaatggaaaagtataggaccagcaaagtaggaaatgttattcaaggacagctgtttcatcaacagctattgtttttaagggtaacttaagatgtttatttataatttatgttgatacagaaggaaataaattgattattttctttctgcaaataatctttttccttttccttttctagcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtggtacgtatttcagttttgcaaaatgctggtgaatattggtcatatttaaagaaatcattgcccaacgcaaagtcgcgaagattttctcctgttttctcctagaagttttatagttgtattagtccattttcaccctgctgataaacacatacctgagactgggcaatttacaaaagaaagaggtttaatggacgcacagttccatgtagctggggaggcctcacaattatggtggaaggtgaaaggcacttctcacatggtagcaaacgagaagaatgagagccaagtgaaagggttttcccttataaaaccatcagatctcatgagacttattcactactataagaacagtatgggggaaacggccaccatgattcagttatctcccaccaggtccctcccacaacacataggaattatgggagatacaattcaagatgagatttgggtggggacacagccaaacattatcattagttttagctcttacattttacagttttagcctgtgagccattttgagttagtttttttaatacgatgtgatgtaaggattatggcttttttttttaatcttgtatatatggctgtccaattgttccagcaccctttgttaaaaagttttcctttccccatttaattgccttggcacagctgtttaaaatcagctgaccacatatatgtggatctttttctgaactctgttattctataccattgctctccttacttatctttacatcagacacattcttgattactgtggctttatagaaaatcttgaagcggggcagtgtaagtctcaagttagttttcttttgaaaagttgttttggctattctgtgtttttcacgtttccatgtacattttagaatttagctttttaatttctaaaaaaaaaaaggtcaggcatggtggtttgcacctacaactgcaacgttttgggaggccaaggcaggtggattgcttgagcctaggagttcaagaccaggcttggcaacacactgagaccctgtctccacaaaaaaaatttttaaggccgggtgcggtggctcacacctataatcccagcactttgggaggccgaggcaggcagatcacttgaggtcaggtgctccagaccagcctggccaacatggcaaaaccccatctctattaaaaatacaaaaaattagccaggcatggtggcacacatttgtaatcccagctacttgtgaggctgagacaggggaatcacttgaacctggaaggcagaggttgcagtgagcggagatcacgcagtgcactccagcctgggcgccagagaaagaatccatctcaaaaaaaaaaaaaaattaagaaagctgtcagctggttattctccaaagctgcagcttctctgctcaaagggtcttactagttcagaatacattatcgtaaaacaaaaaataaatacaaaagaaattttttaaacattagtcaaatgtggtgacttgtgtctgtagtcccatctattcaggaggctgaggtgggaggatcgctcgagcctcagagttggaggctgcagtgagccatggccacatcactgcgccccagcctgagtgacagaacaataccctgtctcaaataaaaagtaaaaagtctattgagagttagttaaatccatacatcaatttggagaaagtggacattttaacaatactgagttttctgattcattcatttaagtctttaatgctttgtagctttcattgtacagatcttaacatatctgttgtcaaattatctttatatttcgatttttgatgctgctgtaaatagtattttcagttttgttttctagttgttcattgatggtatatagaaataccattgatttttgtacattaatcatatatttgcaaccttgctcacgtcacgtattagttctagtatctcttttgtggactatgtaggattttctatataaatgactgtgtcacctatgaataaagacaatcttgcttctccttttccagtttaaataccttttatttctttttcttagtataagaatctaagcttgttttcttttgaactgcctgatttcaagattatactgcctgacttcaagatttcctatgagccacagtgtgtgatgtaacagtgtatctgatgtaaagataggtaaggagagcaatggtgcagaataatagagttcagaaaaagatccacatatatgtggtcagctgattttgaacagatgtgccaagacaattaaatggggaaggaaactagaatctgtagtacaatattgaacagaagtgctgagaggaatatactaggtattggggaaacgtgggaattttttcaccatagaggatgtttaaaatgaaaagaatgattataattgcttccttctctcttaacttccttccctcagacatctacatcggtgaatgaaatagcaacaataaaaataaaacaaagacttgcaaattttagttcatgcttttatttttcaaatttaagcatagattatacatattcggccgaaatatcctgattccttatgaacctaaatgattttcatgataattatctctgaacctttgtttcttcatatgaaataaaaggtttttgtgtatgttatataagataatatatacttgttatataagaagtacagtgtacattcatcttccttccttccctccctccctccctccttccttccttccttccctccctccctccttccttccttccttttttgagactgtgtcactgtgtcacccaggctggagggcagtggcgtgttcttggctcactgcagcctccatctcctgggtttgaggaattctctgcctcagcctcccgagtagctgggatacaggcgtccactaccacacctggctaatttttgtatttttagtagagacggggtttcaccatgttggccaggctggtcttgaactcctgacctcgtgatccacccgtctgggcctcccaaagtgctgggaatacaggtgtgagccactgcgcctggcctgtacatgttctttcattttcttctgctacaatcaagacacgctgtccattttatgtagctagctcactgtcagcaagtttgcgagttctttatgtcagactaagtctacttttctataactacaacttatcaataggttttgtcccctttctatacacacaaacacaaaaacaaaacaaaagaactagagtaagtttaattcctatttcatgtaccagcccttcagatgatttaaagatagccattgtgacactcctaaatttctcttccaggctattatgttccttggccattcaggttgtgctctggatgtaatataggtttttaagaattgtctagttgttacagtgagtatgattattgaaatgtgatctgcttaccacagaagaaatatttagaattgtggcactgtttcagtcctgtgcttttattattgcaaactaagattgcattcacattcttgcaatctggcattttgctggaatttgctgagttgataattgatatttgccagttgctgttaagccaggtatagttacattttaaacttaaatgtgggttaactcattcctcttacaataatcttaattcattttagttcattgttctgcctgttaatttttttgttcgaatctttgtattttctaataaatgcatattatgtatgtcatctggaaattgatgagtcttaaagttttggttacagtacgtttgcttatataatgtttaactgaatcagagcaagtacagaaatctggagtatatgagacagacttccttttgactaacagttgccagtagtagtcttttaggcctgcgcaattgctgcaaatccccataactaatatacagtagatatggctttgcattgttggctaggatgatatgagagacactcaaatgtcttgccaaattctagatatgcttaatttatggagtccccaaataactatgctaataaccttattgagaaaaaaaaaatgaggttaatctggtgtggcttctgaaagccttgttggggaccctggaacacttgtttttcttcttctgcaaggactcacaattccctgcataataaacagatttaacttttgctggggatcaacatctaatttgctgatacagctttttaaaaatctgtgccttttaaaaatttgagacatctcgtttctggtattttggtaaccccaacctatcttaccaacttcacaaagattatagtagtgtgcacttacacctctgtggagaaggagctgttcagactcagaattagtcaaagtaattcaaagaaccttagtgctgtctctatgtacttacctgtctcagattttaaacttttgttattatttagtcttatgatttattttaataccacagaatacatttgacacacagcaatcttcttgggcctcatagtgaagtaataacgatcagagctacagcacaaattacttatgactatatgacattcacaatatacatcaaaacccagaacacataaaccatgtgtatcaatagctgctggttttattggaacattttaacgattgatcattaaccatatatttacatataaattttcctggagatttttttatattcaaaattagacccttagtataatgaatacatcgccacacaggattgattgtgctctgaaattttgatttgggtaattttaacatgaaattgtataaacaactgatattaaatcttaaactaatgtgtgaaattataaaatagacctaagggagtttttttgaatcatccttatccttatgttttcttttctgaggcatagtttttttttttttttttttaaagtccttatttttaggacaatgggatataaactgaagttaaggccaaatctctaagtacaggtgaaacaaagatttacagataattttgtttttatttagcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtatagttatgtctccagaatgttgattgtctgttgtattatgtactctgttggtatttattttgtctttttttagaattaatttatttattatactttaagttctggggtacatgtgcagaacgtgcagttttgttacatgggtatacatgtgccatggtgatttgctgcacccatcaacccgtcacctccattaggtatttctcctaatgttatccctcccctagccccctaccctgccacaggccggggtgtgtgatgttcccctccttgtgtccatgtactctcattgttcaactcccatttatgagcgagaacatgtggtgtttggttttctgttcgtgtattagtttgctgagaatgatggtttccagcctcatccatgtccctgcaaaggacatgaactcatcgttttttatgactgcatagtattacatggtgtatatgtgccacattttctatacccagcctatcattgatgggcatttgggttggttccaagtctttgctattgtgaatagtgctgcaataaacatacgtatgcatgtgtctttatagtagaatgatttataatcctttgggtatatacccagtaatgggattgctgggtcaaatggtatttctggttctagatccttgaggagttgccacactgtcttccacaatggttgaattaattcacactcccaccaacagtgtaaaagcattcctatttctccacatcctctccagcatctgttgtttcctgactttttaatgattgccattctaactgacgtgagatggtaactcattgtgggtttttttttttatactttaagttctagggtacatgtgtacaacgtgcaggtttgtcacatatgtatacatgtgccatgttggtgtgctgcacccattaactcatcatttaacattaggtatatctcctaatgctatccctcctccctccccccaattgtggttttgatttgcatttctctaatggccagtgatgatgagccttgaataaacattgagtctagagggaagcaggtgtagaacctgccttaatctgattactgtcttatcatgtattgtcttagttctgacataaacccctttaacttctagtactttcgtaatctctccgtacagaatcagaataaaagaggattgtagcccctattattaattttgctttacagaaattgtttttttggggagttcccttccccctcttttttttctacttttttgttttctttgagggcttcatacaattttgcaaagtattttcagaaatatattctaatgtagatgactgtggagctgtaatattaattgagaacctgatgccatgctaggtgctatagttcaaaaatgagaaagacagtttttgtttttcagaagcttgtagtccagttggaaaaataaatacataaaaatctttccatacagtatggtgagtacagagataaaggcatgaatacggtgttttgagggcgttcaaggggcatctaatgctggggcaatggttggaaagggtaagagggaagggatgagtgttgggtgtccctgcctaggtttaaatgacaggtgaagcaggcaaagaccggcaccaagtaccttcccagtacagtcagacagcttgaggaaaggtgtaaagatggggggcagcatggggctcaggacaactccttgctgtctgtcagtgctgtgatgacctctgtcagaattcaagctggggaaagatgggtggtgaggggagcagaaataggcaggagaccattcactgaaggcttgtatgccaacgtgggaacttttagtcttctttagaggcgatagaaacattgagagggtcgccgggcacgatggctcatgcctataatcccagcactttgggaggccaagtgggtggatcacctgaggtcaggagtttgagactagcctggatgaaatggggaaaccccgtccttcctaaaagtacaaaacctagctggacatggtggtgtgcacctgtagtcccagctacttgggaggctgagacacgagaattgcttgaacccgggaggaggttgcagtgaaccatcatgccactgcagtccagccagggtgagacagtgcaagactccgcctccaggaaaaatagaaaagaaaagaaactttgagagggttttaatcaggggaggtggtgtatgatttgatctctgttttagatcaaccattctgagcgccctgtgaagagtgggctgaagagggccacagatggggcacaaggaccagttgggctgttgccatagtccctgggagcaatcatgagattgtgaagagtcagtttaatttgtggattaggaatttagaacctggagtcaggcttcctggaatcttgttgtgttcattgtgagatgtgtgacttgacaagttaacttctggatacttcagttttctccttttaaaaattgggactaacaattataacagccttagggccgatgaaaggattaaatgagttactatcagtaatgcacctaaagcagtgccttatagatagatgataaacatacagtaagtaactcgtattatgttgactttagatggtggtgccacaacatgaaaaaggaaatgtaagtgtcagaagtgatctaggcatgatagagtaacactaagagagaaaagttaccagctcctgtattccactagaagacttcgaatgaatagtctttgtttttcaagttttttatttttttatttttatttttacttgagacagaattccactcttgttgcccaggctggagtacagtggcgccatctcggctcactgccacctccgcctcccgggttcaagtgattctcctgcctcagcctcccgagtagctgggactacaggcacccgccaccatgcccagctaatttttatgtttttagaagaaatggggtttcaccattttggccaggctggtgtcgaactcctgacctcaagtggtccatacaccttgtcctcccaaagtgctgggattacaggcgtgagtcaccacactctgccctgtttttcaagtttaataaatcaggcagcagtcagctttgtctaaccatgatgatgggagaagagcatgaaagaatgaaccactggtagtttcttagtctcacctcaggtgatgtttcaaacccttctcccatggagtcttctcaaggaaacagttgcaatacaatatgattaaatgatagttttgattcgtcttttgctagtcacccttgttaaaggtgcttgttaacagtggaatgatgaaaaattggccacaaaactggaacagtgttctagataatatacactgattgggccggccgtggtggttcatgcctttaatcccagcactttgggaggccaaggcggtcggatcatgaggtcaggagatcgagaccatcctggctaacatggtgaaaccccatctctactaaaagtacaaaaaattagctgggcgtggtggcgggcgctagtagtcccagctgtttgggaggctgaggcaggagaatcgcttgaacccgggaggcggaggttgcagtgagccaagatcgcgccactgcactccagcctgggtgacaaagcgagacttcgtctcaaaaaaagaaaaaaatacactgattaaaaagttctagaaagttgacttctctcacttggaacagtttttctagcttggttttgtttttccgctggggtgagagtagagtgtccctgtgctgctgcttcatgttgagctcttctttggagacaacaaatgagaatgtttgtgtgtctctacagggctcgcctatttagtcattgtagaagcttaaggaagtcttcaagtttgagactgtacatcgctgctttatgtagtttagatgtttcactagtaacttgttcagagggtgcattaagagatacctagagaaataatttgttttctctgtcagctttctgtgagaaataattatcaggagtaagtcagtctttgatgtgtcattttatggcttacattatacagcaacatctgataatgactagacagggtataggctcacacctataatctcagcactctgggaggccgaggagggtggatcacctgaggtcaggagtttgagaccagcctggccaacatagtgaaaccccgtctctactaagtattcaaaaattagctgggcgtagtggcagatgcctgtaatcccagcttctcggggggccgagggaggagaatagcttgaacccaggaggaggaggttgcagagagttgagatcgcacccctgcactccagcctgggtgacagagcgagactccatctcaaaaaaaatttctttttaaattaactggatattattaaattagttttcaaagttaattttcaaggtaattttacatgtttttctatttctcacaacaatattatgagatacataggattgctgctatcttctctatttgaggttaagagattgaggctctgagaggttaagcattctcaaagttgtacagttagtactggtgataggaagattcctagtcacagttgatataatggattggaagcagcatacaatccaataggcctggatttgaattctcactctgtcatctttttagttgagtcgtctttcacacactgttcacctccctgagcctatttgtttataaaaaatggatgattatatacataaggctgttgtgaaggtaaatagaaactgcgtgtcaagcacctgccataatgcctagtcattaatatatgtgcaagcattcattaccactcctctccttttaattgaatgcaactaaaggagatactaaacatgtaaaacgttgtcaccaatttgcctgcattttggaagcctgttttaagtcttaattatttttattatgtaggtagttatcacagaaacgtgccagttttatctttcgagatctggaaatacaagtcaattaagtaacagtatgggccagttgggaggaagtagccatgaactgggaagggttctgagttatacttctgtttgttgctagccaagtaattttataaccctgggcattgtcactatctcttctcttgcctgtgaaatgatatgtaggagaatacttgggcatcataggaattgccgttgatttaaaaatgaatttgccgtcctatctaggagctcatgttttctgcttactgaaaagcctagtaagagcttttcttccatgtactgcttcctgccccctccccatacaactaatctagggatttggtgaaaggatagaaaggatttttactctctagcatttagtaaatattctgttcattatcttggatttgaactaatgcctattaaggaggtaaattctctttaagttttttatttatctgatcatgtataataggatatttgttaaacctaaaaactctctttgcctcctcaataatgatactgatctttcattttcattggaatttttttttaaagctgctatactgaataagtaatacctctttagtaatatggaatttatgattgatttgaaagaaagtcttaacctgtatatttaaaagagtatagaagtttatagggtatataacaagctggtagattagtatactactgcaagttcctagatgatataatgctaggaacaaagctaagatgaagggtaaatagctaatttctttaattttgcttcctacaaaatatgagagaatagttgtcaattgtccttttggttgcatatttctatatcttttcatgcgtttgaccatgttttagccccatcctaggtactgtggaagatacaaagacatgggaagtacctgccctcacagagtttatcttctatttgagagtttaaaagtttagggaaagaacacctatatgatgattaggtataaataaagtacagaagttccaaatacatgtgtatatagaagactgcttttagaaagtcctctctaggccgggcgctgtggctcacgcctgtaatcccaacactttgtgaggccaaggcgggcggatcacctgagatcaggagtttgagaccagcctgaccaacatggagaaaccccgtctctactaaaaatacaaaattagccagcatggtggcgcatgcctgtaatcccacctactcaggaggctgaggcaggagaattgcttgaacccggggggcggaggttgcagtgagccaagatcccgccactgcactccagcctggtgacagagagagactctgtctcaaaaaaaaaaaaaagaaggaaaatcctgtctaaaaattcatcgtataaatagaattctaaatgtgtgaatgttggcataatcaaaatttgaattttgactaaaatttaagattttttatgcctttatgaaattatgtatttatgagacttttttcaaaaagaaactgattattccattttgaatcttgacaccccttgagaaaactctaaaatactcatacttacttattgtttctattgctttttttattaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggtaagtcaaatcctgaaggctttgttttcaaatttatatgtaaggaaaaatagattgttgctcaaactgaggaaatttttcctacatgtgaatgacgagctatattattttttcattctaaactctactgtgcagaaagttcacattttattcatttgaaggacttctctgtatctttcacattttaaactgcaatacatttaaattaactctgtatatttcctgaatcactgtatgttcaattggtgagtatctcaaggggtgccacagttaaaaccgaggcagagtgataatctgtgaaatgaaaaattattatcaatttactgtttaaatccttaatatgctcttgaattcagataacatttaagaccttgtaaggggccaggtgcgatggctcatgcctgtaatcccagcactttgggaggccgaggcgagcggatcacttgaggtcaggagtttgagaccagcctggccagcatggtgaaaccctgtctctcctaaaaatacaaaaatcttaggcaggcatggtggtgggcacctgtgatcccagctattcgggaggctgaggcagggtaattatttgaacctgggaggcagaggttgcagtgagccgagattgagccactgtactccagcctgggggacagagcaagactgtctcaaaaaaaaaaaaagaaaaaaaaagagaccttataaggaaataaccctgttaatgcaatggtattcatcttaagttttagtacttcagaaatatattttcatttactcttcttattccttctaaatttctccttatgacaaaacaaaacagtaatacaggtgtgcatactggtctagaagactgtctgtttctcttcctatgaacgtctttatctcgtctttttcatttctgcttcatactgcatcttctcttactgccacttgggtaccacggcagtggctatcttgaacatctttcataaaaacatcactgtcaatttgtgaggatattaagtctgctgagctcctttggggttatcttttttatatttccagcatgcatcttactatttcatttactttggaagcgtttagccatgttttcctgagaagccttatcagttcacactgtaggctggtagaactccacattttgtcttctgggctaacctttttttatgtactaatggttatagaaatgtgaatcctcctcccctagccatgccccactgaaaataaacgaactgaacaaaactaggaataattcattaagtcctctctcttgctgccagatgtagtaaactcctactagaatagttaattctcaaagaatctgatgctgacagttgacatgaaaatcatataatctttctttgatggagaaaatgtttcagaaagctgtgaaacattggggcatcattttgaatatcagtttttatcctatagttcagaagaaaatgcttcaatatttgagccttctgtcggtagttcactgtgaaaaacaacaaccatagattctgtgttgagttcattgaccatatttgaggttgaagtcttcttaggaccttccttgtgatcttcaggaagtgatttagcccagagtcaccaatactgttagctatgagcaaagaatgttagagtttctgtaaggtataatacaagttaatggagtgcttttcactattgggttttttattgctctttttttttgttttgtttttttgttttttaagtctgctctgttgcctaggctggattgcagtggtacaatctcggctcactgcaacctccacctcccgggttcaagcgattctcccacctcagcctcccaagtagctgggacaacaggcatgtgccaccatgcccggctaatttttgtatttttagtagagacaggatttcaccatgttggccaggctggtcttgaactcctgacctcaagtgatctacccacccaccttggcctcccaaagtgctgggattacaggcatgagccaccgcccctggccttactgtcctcttttatttgactttcatgggaatgcagattataagggaactctccatctatagagaagtcttatctgatagaattgggggcagaaaggtctgaaagtcattgctaaaggtgaagtgcatttaatacaatgctactccacttgaaagtggatgcgtttttttctttttaaagttgaacgtgttacatgattaaaagaagggatggagctgcaccagttcaacttattttagctagtaagatgaaaacttaaccacacgtgcgtaacgcagcgtttttacagtaggagactcttgttttatctgactcagcattttgacatcctcttctaacagttcagaaaagactttaattttaaatagatattttatataatttacctctccagctgaaacatcttgttagcttcttcaatgaaattggcaaatatcatcctttccatattattcattttcttttattaattctatcccatgttcttatttatcttccattttgttgaatattagtttgttgtcataaaaattctacagtaaaaatctaattttattttattttttgatctggggactctaggaatctgattgcaatattaagttacttgacagtcaaagtgaccagacctccaagctatgtttatctcatttctcaaaaaaagacacacctctaaggaacaaggtaaaacatttatttaattttttttttaatttcagaagcggtgtatgcttacaactagaaaatgagaaatacaagcagaattaaaaatcaaaatacctgtagtctcatttatataaaaatgtctactttaaaactttatgcttgactgtaggtgtttaagttgtgaaacttattttctcttgcagtgtatatgaaagatcactttccaagtacttttagtcattaatgtaatgactttataatatgcagttgtataggtttggtcaatccccttatttttgtcatttatcctaaatttttttgctctagcaaataatactgcaaccaagatcttgtggataaatatttgaggacatgttcttgattagtttgtaaggatgaattgcatggagtggtattactggtcccaaggcatgtatgatttaacattgatacatactgccaaaaggccttctagaaactgtgtacccatgataaactaggtttgttaaatcaaaatatataaatatttgtgttactacatagtaaagcatgttttatatattaagcacgaattaaagcatattttatgtattaaatgttcttgttcatcagtataaaaacaccatttcctaacttaaaagatggataaaggtcataaacaggtcacaaaaggagaagtaccaatggttgattaatatatgtttaacctcatttgtttaaccatatgtttaacctcattagtaatcaagtagtgcaaattaaaataataaaatagtttcttgcctcttcatatttcaaaaaaatgtttttaattatactcattttttatgagagtatagtgagataatcacatgttttaaaaagtaagtattggtctgccatttctagaaaaaaatttgaaagagttcaaataatttaaaccagtaagtgcattctagaactttagcctaaggaaacattgagaatttaaatacaagaatacttaatactgcattggttataatagtgaaaaaatggaaataacctaaataacaataagggagtgagttattaaataatcattggttttagctcttactggtagaaatataggtgaacttttttctgttctttttcttgtgtttttctaccatgagcatatattatgtttctagtagcataaaaacttcttactttttaaaattttaataaatggccctgcctatccatttgaaagaagatgtagtctcacacaatataaatgtaaattctactgtagtcaatatgggttgctataacagaataccagaaactggatttgcttaaatgataaatatttatttctcacagttctagaggctgggaagtccaaggtctgagtgagagcccacttcctggtttgcagacagatgccttctcgctgtgtccttacatggtagagggagagaatatctcttttgtacctcttcttaagggcactaatctcattcatgagggctctactctcatgatctaatcacctctcaaaaatcccaccatcacattaggagttaaggggttaggacttcaatatgaatgtgagggagacacaacattcagtccacagcaaattccagtacattaaagatacaaatatgaaatatgtaaatatgagattattttttaaatttttgagcaagaagttttttgcaatcatatctactaacttgaaaagacattcattattagtgaaaaggaaaaatatgttattaacaatatgtatagtggtgtttttgtttaaatactttaaaatattcatgtacacatttgcatgtttgtggcatcatattaagaagtctggaaagatacatgcagaattatttacaatgatggatagaactggagatgtagaaagtacttttcctgaaggagttatgtctagatagtaaaccatcatattattattataattctcagacatttgcattgtcagggatttaactaccacttctgttttggtgacccttcaggtgagctctccctgatacccatctttaatacctaaaatcaaactcgtgtcttttacctctgtttcttctcggaacgttttttgttttatctattaaataaaattatattatctgccacttagtttcaaaatcctaaggttgtcctttttcttgataactgtcagtttgatccttctacagcagttagagaaaaacaaccaaacatcgatacctctccaaattctaacgtttatttctttgccttcttttttctccctcactttttccccatcacaacacatatttaaggatttcatctttactgtgtgaacctttattttgttttaactttttcattcttcctacacacactgccagattcatattgtaaaccttttttaatatacctcattcttactatcttaagaaacaataacaaaacttcattgtctccattctgtccacagggtaaaaatcaacccttagtagaaacagcctaaatgtcaatagaggtttgtttaagtaagttatggcatatatatacaatgcaagaacaggcaacctattcaaaataaaattctatttcctgtgaactgaaaaaaatctctaagttacatcattaagaggaatcaagatatattaagtgagaaaaatgaagtgcacaacaatgtgtactatgctgcctgtgtgtgtgtgtgtgtgtgtgtgtgcacgtgcacgtgcacgtaagtcagtggatgcacaggaagctgggagcagcaattgcctctggaaagggaggcagcgagagagattcattttgctctctgttcctttacaaaagagagaacttttaaattttatgccaggtttacatattacctgttaaaataatttatgatgacttctgtaatagacttttataaatagcacatttttaccattgctcatgggttattttgttcttatgtataaagaatagtttggccgtgtgtggtggctcatgcctgtaatcccagcgctttgggaggctgaggcgagcagatcacaaggtcaggagatcgagaccatcctggctaaaacggtgaaacgccgtctctactaaaaatataaaaaattagcgaggcgtggtggcgggtgcctgtagtcccagctactcgggaggctgaggcaggagaatggcgtcaacccgggaggtggagcttgcagtgagccgagatcgcaccactgcactccagactgggcgacagagtgagagtccatctcaaaaagtaaataaataaataaataaataagtaaagaataaagaatagcttgaaattaaagttagttgctttaacagaatggtcttaaaatgggtgtttaatcttcaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaagtgagttgccttgtttcttattctgaaacaagataaactgttattttctgtaatttccatccctttctcccaactcttcctagtttcgtatgagtttttgtttctctcactataaaataattatttttctctcttccctttagctaactctttatacttaatatcaatttctataccttcttttcataaaaagatggcaaactaaaaaccagttttcagtctggttttggagtctctctgatgtgaagcaaattgctttcctaggccttaagtctcctgccttccttttcttatctctcaggattgtaaagagaataaaattttatttggttttttgttttttgttttttgttttttgtttttttttgagagagttttgctcttgttacccaggctggaatgcaaggggcgatctccactcaccgcaacctccgccacctgggctcaagcaattcttctgcctccccctcccgagtagctgggattacaggcatgcaccaccacgcctggctaattttgtatctttaatagacacgaggtttctccatgttggtcaggctagtctcgaactcccaacctcaggtgatccacccgccacggcctcccaagtgctgggattacaggcgtaagccaccacgcccagacaagaataaaattttaaagaaggggtagaaacacagtgcaatatcgtacttctctaatttatcacatctaaaatggggagactcattgagtttatatgatgaatttgccagatttgcagtgtatgtggccagcactgttttaaaagaattcatcttctatatagttaaatttttgttaaccataatacttccttctgttagaccacaaaattagccacagagtagcattaccttatagctattttcttgttctcaataaaagaaatgtgctgtttaataaaagttttttttaattatatggaatgataggattaaaccttacctagtagaaatattgtcatagatgaggcggtatgagtgggaaacactttgtaaataagtaagtgctggacaatcatttcttattttacattgtgtaaagtctaggattaaaccatatgacagcagttttcaaactttttcttttcaggaatgctttatactcttagaaattattaaaggccccaaaatactttggtttatgtaggttatatttgtcaacacttaaccatcatagaaattgaaatagacattttaaaatatctattttaaaataatgataagcctattacatgaatgtagatagtacatttaaaaaataaatagctatattttccaaatccccccaaaagctaagaaaagtggcatggctttacatttcattttgcaaatctttactatctagtttgcaaatctttactgtctggcttaatagaactcagccggattcttgtatctgcttctacatttgatctgttatgatttggtgttttggttgagtatatgaaggaaatagacatatttgtagttagaaaatatatactttgatagcctttttagatagtggtaaattttcttctttgctgttatgtctaaatccaacaacttgtagtttccttaggtcagtgatagtgtagaatatgaaaccatatcaactgactttttgtactctgtgttttattgcagtccactggtgtcccttttttctgttgcctaggctggaatggcacaatcatggctcactgtaccctcgagctcctgagctcaggcagtcctcctgcctcagcctcttgagtagctgggactacaggcttgtgccaccagccccagttaattatttaagttgttatgtgaggtgtgagccaccttgcctggcctacactggtgcacttttaatgcatcttttacatgtaacatcatgagttggtcttttggaaaatattggttaattgagatgtacttccaaatattgatatattttattatacaatataagaaaaaagtcacaatcaacaaagcctttaatattggaaaactgttgtgtggcagatacgttttccaaaattttaattttcatttgaaagcttgaattttatcattagcaacaaatactcttagttgtttttctttaaagtaacaggctctctttgttcattttatttgtttgtttatttatttatttattttgagacagagtctctctttgtcacccaggctggagtgcagtggcacaatctcagctcactgcagcctccgcctcctgggttcaagtgattcacctgtctcagcctcctaagtaggtgggattacaggcgcctgccaccatgccttactaatttttatattttttgtagagatcgggtttcgctgtgttggccaggctggttttgaactcctgacctcaagtgatccacctgcttcaacctcccaaagtgctgggattacagacatgagccaccacgcctggcccctttttgttccaaattttagagaagtcctgaatgaccttagtgtcacacatgcttttacttgaggtaaactatcatacttccatacacaatagaagtgttttgtttgtgctttccattttgtcacagaatattaaaaagtataccaaagaattagctgagcgtggtggcatgtggccgtagtcccagcttctcaggaggctgaagtggcagaattgcttgagcccgggaggtggcggttgcagtgaactgagattgcggcactgcactccagccagagtgcaacagaacgagaccttgtctcaaaaaaatttaaaaaaaaatgtaaagtataccaaagggttgagatttaataaaattaatgatttgtactgcttccatcaagaacatttttgagacttttttttaactgcaagtgcgcagaggtggagaatacaaatagtcctggtatgactcgtacggtgtgatgccactgtcttgattcacactgagttgtcagcagtttcactctgttctgctttagcaacatccatgcaagggtcagcacagtggaaaggatgaacaaagtctgaatattgtaagaatagttttggtcttggaaaccgttgaaaggatcttgggactctccaggggttgtggaacatgctttgaaaactgttgctagacagaaattaagggtgcaacagtattcttaaatacctttgagaaaaagagatgtactggtatttaatttttgttgacaggagatagaattacctgtaatatcttcataacaggattaatttttatagatagcttccttccagaaaagaaaaaagagaaaacaactgagaggggaataaaagacagggcttaggccaggcacagtggctcacgcctgtaatcccagcactttgggaggctgaggcaggcagatcacttgaggtcaggagtttgagaccagcctggccagcatggtgaaaccccatctgtagtaaaaatacaaaaattagccaggtgtggtggtgcacgcctgtagttccagctactcgggctgaggcaagataatcgcttgaacccaggaggtggaggttgcagtgagccaagatcgtgccactgcactccagcctgggtgacagagcgagaccatctcaaaaaagaaaaaaaaaaataataagatttaaccagggcttaaccatttgttcctgcttcacttatattagttcttaaccagacttgagaagggcactaaggagaaaagaattaaagtattggaatcattctgccttagctaatatatctagtggtggcccagcacctacactgaatagtgattttgaaagcaagaagaggcactaagaagtgagactcagaatgtattgggagtgctcacaggagaacctgattgtgttatataatgaattgaaagagatcgtacagtaaagggtcttatcctcttcatgtccctctattttgtccaggtagaatatttcttctctaataatcagtaccttaaaaataccaaatgtattttattgtattttgcagagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattgactttataattgggttgtggtttttttgctcagctttttatatttttataagaagctaaatagaagaataattgtatctctgacaggtttttggaggttttagtgttaattgggaaaatcctctggagtttataaaagtctactctaaatatttctgtaatgttgtcaagtagaaagatagtaaatggagaaactacaatcctagaggaaatcactgtgtttctccaggctttaaagttttccacttgcctttcccatctgtccttcagggttgaattgaaaataaagttgttgagatgggaggggtaattggaagggttaaagatcattacacaaatgagacagtgctctcttatccctgaagggtttggttggattataggttgacactgaaggaaaattttcagcctcatatgaaaggaaatacttcttatatcattaatatttttaaacttcaaaatagcctcagttttaatatatatattttgaagtataggctaaagctttcttaacatgtatttaaaactagtcccctaaacactacataagatactaaagctgcaaggtctgtgacacgtacactctgcaaataaatgggcagatacctggaaagagaaccagctgcacaagtgaggatctgaagtgacaggaattaaaggaattataaaagtatttgtgatatagaggataaaggaaagagagccaaagtatttatatttttgagtgagacttggtagaggactctaggaaaatgagatcagaatggaataaaagctaactaaagctattacaaaattaaaacccaaaaaggcccaatctggaaaagacctaatccaaagaacaaaagcagatttgaattctccatgcatgtttcctgttataaaataaattaggaatgtgagtcaaacgttgtctacaaatatttatcccctcactcactaaaaatgctacttaaatgacagaaaaggaataagacaaatccacaaggttaatagaatggaagaagagacatcaggcaaggaaactgatggatgagtggtaagtgatttcacaaagaaatgataattgtcagtggcagaagactagaagaggtaaaaatctaataagcttgacaaatggagatatccagattcctctaaagccagaggtgcagaataaggctggaaataggattggttttggaaatctttaaaactagtgtgggagaaagggcagatggcagcagtgccatagttttcaatctccaaatcaccatataatagcaactggatagcaaaataaaaatccatgagcaacgtaagtgggtgaagatagccacaagaccacaagctggcattggcatcaattcaggtgaagcagagtgaggaaacggcatctaatggcctgagaacagaacctcagggtcatcacagaaacagcaggccaggttgaaaacagcactcaagtgggagaggctttgcccatttcaaaggtgggtgagtccaagaggcttgtattaaggtctgaaggactgaagcaagctagcccctagaaagtgttagaactgattcgctgagttcaccaaggttctcttccaggacagcgttccccacagaagagaaactgctggggtgaagccaaattgaagaagagaaagatgaagagaaggtccaaatacaagtagaataggggatagtcaaccaaaatctctcagcagaatactggttttgaacacttagaaagaaacagggaagttcccgtgaatcatgcttccttctcaaagtttaggaaatggaatttacttaagaaactaaggaaagtttttagatgaatctcatacaaagttattttaatgaaaagaaagagcaaagataagatttctgggcaatgaagatctatcagaaaggtctacagagcagagcaaaactagttcgtttaaaatgtgctaaaagatattagaaaaatgatataaaatatgacaaatttaggattacaagaatcagaaataagataaactcaggaaaac

SEQ ID NO: 12555 - DNA, 48108 bp, Human
ctagttaagagatatttgtctcattttctctcctcttccttatctcaacacagaagccaggccttgcagaggtacgttgagaagtgtctgcatgccagaaccacgctttgcaccttcccactcacactaagggatttagggtcccacttgagacatgagatcgacactttaacacggtctgatttttggtaactcaaatggaccagaaagttaaggtatcatctaaggtgtgagtgagggatggaaaagatttaaaaggatagcgattggaggctgggcgcagtggctcacccctgtagtcccagcactttgggaagccgagacgggtggatcatgaggtcaggagttcgagaccagcatggccaacatggtgaaaccccatctctactaatacaaaaattagctgggaatggtggcgcatgcctgtagtcccaactgctcgggaggctgaggcaggagaatcgcttgaacctgggaggcggaggttgcagtgaaccaagatagcaccactgcactccagcctgggcgacagagcgagactccgtctcaacaacaaaacaaaacaaaaaaaccaagtatacaatgttgatacatgtgtttcttttcctgtttctctgcagtgtctactgagattgattttttaccacttgaaaatgatgggtgagtctagcggaaagggatccacttcttgaattcaaatagactagactgtgattttcaagtccctaatgaattgttctaaaatcgctgagttttgaattgccaggaaaacattgaagacagagaccaaagccctgagggcagagaggagctgcaaaccaagacctgaatatttgaaaataccatttattaaccttcaaatgcaattgtagctgcagcaccatcactgctggcctgtaaaacattttatattcttaagagggaggcattcgtgatactaattctttttacagatagtttctgatgttatcccaaaagcaatgcactttaaaaaataatgatcagaatcaaagaatttaaacaaaaagcaaagaatttaaacaaaaagcacttttcaccgcattatttaattaaatcatttgtcaaaatgaaatttgaccttctgcttattggcaaaatcctcatttataacatttacaagagattttaactcaataaacgaagtacgttaacagtgcactgccctgccctgcagtaacgccccccacccccacaaactgtatctggggtcagctgttgctgggaataaaaataataggcagattcactccagctttcagtctttcatttgcaaccaatctccaagccccagagcctgggggccgtgcctttccacccttcacgcggggcgcacggatctgaatatttaacacccggttccaggacacgcgcctggggaacacccacaatccctcgcggcccgcggagcccggctggcgggtgacccagcgcccgcggctccgagaggagcgaggtcacccggcgcttcccgagaccttggccctaggcccagctggcgctgggacgcgaggcaaccgagccgccggccaatcagcgctttgcaggactagcacgcaggggccgcacccctgagggtgaccggaaccgctcccgcgggaagggcagggtgcggcgcctggccgcagacagacaagggggcgccggctcttcagaaccccagggagaaagcggtggagggctagagttgaggagactaaggacatttgaggagggcaggcattaccaagttaaaacctcctgaaagacaactccattgggcgaccgtctgcgccgcacagcctgacgggagcgtcatccttcctgcgcaggctgcaaccgacagacaggctcggctccgcctccagccgcggggcacgcggggagagccgttcctccctccctccgctaacccggacagcaaaggagcatttccggcgtaagactgtccctacggaaggggtggggctagcttggccccgtctttcacgcccagagggggcggggtgaaccgtgacagcgcttcggcccgcactaaggccggctcttgtgccggaaggaggaaggcgtgggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggtaagtgggggctgggggtggggatggaggtggggttgggcgggtctgcaggttccgctgtctccatcgctctgcgcacgtcccgcgtccctaggcggggcagggctgtcccgccaggtgcgtctccgccaaggtgggtgcgttcccgccaggtgcgtccccgccaggtgcttcccgcgcgaggctggctgccctgcgaggaggccccagggcaggcgccgccgccgcatctgcgggacgtgcagggcaggcgcccagctccggggctgcgcctcttcccatctggccccttgaacacccggcggtgttgggttctcaggcttgagctccctcagtgagcgctgagggcggaggagttgacgaccaaactcccctttccctctctcctaaggtgaccgcaaaggtctaatgaacgaaagctaaaacaaaccttggaagcagaaatgggtatgtctggcggcagcatatattagatggtagtcacttttaacaacatactaacatactacgaaagttactgctttttctggttttattcttcgactgacacaaaggaatggctattaaaatgcaagtataaaaaagtaaaatcttgactatgccattaacaggttttgtgacattggccagtcatttaacctccttgggcctcagtgtccttatttgcaaatgagggtgttgtaaggttcctctaactcggggaatctcaacccttactctacatcagaatcagtcatcctggagaattttaaaatatgattgcttgggttccactcccagcgataccggtgatatatgtgcagctagggttgaaatcacagccccaacactctttggaataaaattgatcgcagtggttggtcatattaatgcaaagtaatctcaaaagggacagaatttcagacaaaggtcttggatggatgctaaaacttttgggcaaaagacaactagggaagcctgctcttatttacacaagctcaaatggtcatccccttgatggttaattacaaagggaaaaatctggcccgcgcggtggctcacgcttgtattaccagcactttgggaggccgaggcgggcggatcacctgaggtcaggagttcgagaccagcctggccaacatggtgaaacctggtctctactaaaaatacaaaaattaaccgggcgtggtggcggacgcctctaatccaagctaccagggaggctgaggcagaaaaatcgctggaacccgggaggcggaggctgcagtgagacgagattgtgccactgcactccagcctgggcaacagagtgagaccccgtctcaaaaaaaaaaaaaaaaaaaaaaaaagagaaaaagctacctttataatggagaaatctggtagtcacactcctctagccaagcacaacaatgaacaccacttcaccatcacaactaatgagacgactgacattcggtaccccttggcatgatgcacagagaaggccacaactcacctatgtagtattcctgccaaaaatgtttaatccgtatcagttcataaggaaacaataaggaatatccaaattgaagggcattctgtgaaacaagtagcgtggattcttcggaaatatcagtgtcaaaaaataaaggcgagataatttttctagactataagactaaagggacatgagaaccaaatagaatgcttaatttctgataaaatataaattcgactatggactataattgttgtatattggtgttgaatttctccagtgtaatatttatattttggttatgtagaatactccacatgctgaagtatttaggatcaaagtgtcaagccgtagactgtgcacatatgtttatgcacatatgtgtataggagaaagaaagtgaatgtggcaaaatactaacaattgctgaatgaagttaaaagctacatgggtctactttgtattctttttaaaaacagctttataaagataatttaaaatacgaaatttaccctttgaaagtatacaattcagtagttttttagtgtatttgcagagttgcacacccatcaccacgatctaattctagaacattttcaccccaaaaagaaaccctgaacccattagctgtcactcctcattccccctccctcctgacccctggcagtcacaaattgactttgtctctggagttgcctattcttgacatttcatataaatggaatcgtacactatgtggcccttttgactgacaggcttcttttacttcgagtaatgttcagtgttcatgcttgtcatagcatgagtcagttcctcattcctttctgtggctgaataatattccattgtatggatagatcatattttgtttaaccactggtctcttgatggacattggagttatttctaccttttcgctattaataatgttatgaacattctagtacaagtttttatgtgagaggatgttttcatttctcttggatatatacctaggagtggattttgctgagctactttaactttttgaagagttgccaaattattttccaaaaatgtctgcaccactttacagtctaccagcactgtatgacggttccaatttttccactactttgtattctcgtaacttttctggagcttggaaatgtttcaaaataacaatgggagggcagtgacaggagactatatatgcatttaactttagtattcattatttcattaacaagttagcatgttctcttcagaaatgttactccagctgggatgctgagatattttctgtggttttaaatatgatacaagtaatgaaaagtacattagaaaagacacaagcagtggaatggtaaagttgccccagcagaagtcatacacagccaggaccacttcctgcgggtcacagagttgaagacagagtcagctctgtcccttagactacatctcctggtgctagtataaggaacagcatctgcaattgatggctgaaggcagcttctctcaaccttcagtcactttttatacttacatgcattttaaaggaaaccttatatggtgaatataaaagaaaaaccagtataacttccaaatagatggttgctatgtttttttaaaaggcgacagaaaagagaaagttattaaactaattaatcaattgacaaaaatctctgacatgtgtgcccatgactcatgtgctagactccatgatctgtaattcagggtaggtggagtaggcagccagcactgtcatggctgttttccaagcctcacgtagcaggatccttgctgtctggtccttgaggaggcctcattgactgcagacagtgcatatgtcacatctagtttgcgctgtggttgtgggagaagcggcccttctctcctatcctcctcacccttagctggctgcaatggagctgatagcatacacattttctcttttctccgtacatctcaacagtgacagtaaagattcagttaccaaagatttgacttacctatggacctgccagagcaccatgcctacaattcttatgggttgcttgaggtgactgccacctactttagcctgatcctaagcagtactatcccaggcttgaggtcattaagtgattgtctttcaagtgaaacgtgtttgtcagcgtaagcacataaggcaagcttatgttccagcagaggttctggggtagggtttgacagccaggcagtatcactctcatttttctaatgaggaaatggtggcttagacaagttgatgaatttcataacccaactagacaagttgaagaacttcacccgactaattggacagagtctggattccaactcagatcagttccagttcaaagcatgtccattgaacactctattattctgcctccctaggagtggccatttatgcaaaatggaggaatttgtaatatagaaatgttgttattcatttcgtaggagtgctgtgaataacattgtgatatttcaataaaaagagactgatatgacttctactttgaatatatgctgattctgttattgtgcttttcagtatcttagttgtggaagcatttgaaaatggcttgattctgtggacaccagagaaacctaagttatacttagatttaaaattgaccttttttttaagaaaaaatactcactgacaaaatgattttttaaaaattacagttgaagcatttaaaaaatataaacgttaaaatgtaatatcccagctgggtgcggtgactcacacctgtaatcccagcactttgggaggccgaggtaggcagatcacttgagcccaggagtttgagaccagcctggccaacgtggcgaaacctcatctctactaaaaatacaaaaattagctgggtgtggtgcacgcctgtaatcccagctacttgggaggctgaggtttgagaaccacttgaacccgggaggcagaggttgcagtaagccaagatcacaccactgcactccagcctgggcaacagagcaagactctgtctcaaaaaaaaaaaaaaaaattaacgtgctacagaagaaggtaaaatgaaaagtgaagtctccttactcttcctgactccctgttctgcccttggacgtatccactgatgatttgtgtagtgttccagacacacgtgtgcacacacacgcaacttgttctcttaataatgtacctttatcttggataccttttcatattaacattttcatcagtcccattcttttttatattatttaatcaatcagcttcattcagccaatgtatgttgatctcatgagggttacaggttagtagagataggcaaatatataaaataaaagatgattaaaaagatgatcaagtgctcaaataagagcatctgtgatgtatgaaggagcataaagtagggtatagtcatctggggggaaaagggagaagctgggggcccttctggagcttcatcaaacctagttttgaaaactgagtgttaaactaagtgcccaccatgcactgctggtttcagtcatgaggaatagacaatgtaaacctggtgaagaagagtttgcagacatttgggacgcaacctgagtcctttagactgtttcttttacttggttgaccaggtgtttatagttgctcatcctcatctaatctggcagcaacagcagttttttaatgtgacttaggttgactgtctttccaaaatatttctgttttcttagggtttattatgttctttttttttaaactttgtaagttggctgttcagcatattgaattgtagcctcctttttaaaaatgtagacatttcccactaagtactactctaagtagtacttcgtaccttaagttttatttttctttttaataggtgagtgaattattgtaaggcaaacccttgtaaccctacccacatcctgctggagaggagactggaagtaggatcactccatctagattctgggagaagaccctgctccaaaggaccttgatgaggtttcatggtttggtaacctcatgcactgtgggaatgtcagaggaccccgagataatgcttcactgccaagtctgaaaattgtgtccacaagatttgattggtagtattttctatcattgtacaacttaaaatatcttctaatttccatttttttttttgacatgagttgtatagaaatgtgtgcttcagtttctgttatagcaacaactcttgtcacccatagccttacaaaaattcctaattttaatatttaaattttagaaactttcttacaagcagaattacaaaaagagtaactaacaagaaagtgagattgtgatgggataacggaatgtcaagtctaattgtcaggaaaagacaaaataacatgggaatgacaatcaaaatggactaaggacttagaagatccgaaactatgaagctactaaaagaaacattggggaatgctccaggacattggtctgggcaaagatttcttgagcaataccttaaaaggacaggcaacccaagcaaaaatggacagatgggatcacatcaagctaaaaaacttctacacagcgaaggaaacaaagtgaacagaataacatgggaatgttttctgtaatttagtagtaactggcaatagtttacaaacacattttgtgtatactgctgtcattgcactgattaccttctgttgtagtgactttgttctattagtccactcaattaaaatatttggttttgtttatctttgtattcctgggcctggcagtactcaccacttaataggtgctcaaaaactttattaaatgatgagttgaagccctgaaacatttaaacaaaatgcagaagactgataattttataaatgcattgatcagaaaggggaaactatggtattgtaggcacattatggattttgcttcgtaattataaataatattctaggtatcaatttcagacagatgttgataagatttattcttattttgacatagccccagagctacacattgcacccaccattacttgtatttgctttaaaatagtcattcttaagatcatgattcaaataaattgggagtagagattccagaattcctataaatatggttttctctctgattcaggaatggaatataatagaaaattgtccaaggtttgattttccagggtcttcatcccagttcctgtggctcagcgtgaatatagaccctttctccaagcttgcagcattgctgttggggcaccttctccctaagcatccttccacttgggtagaaaacttctttttttaagtattttattaagatagagatgaaatcacgctatgttgcccaggtcggtctcaaactcctggcctcaagcaatcctcctgccttggcctgacaaaagtgttgggattacaggcatgagccaccacacctggcctaaaaacttgacttctgtttccaaagacccatgggtgatatgagataatcaggaattgtgttaaacattccctaattccctacttccagtgaaagattaaatttcccatggaaacacctaactaatactgttttataactaggtagactaggatagccttttccagctcacagagtgctttaatcctccatatactgttaagaggtagcgttttctccgttttgtggttcagaagactgaggcccagagaattcagggacatgccagggggactgatgatagcaaatatttgaagttgcatctttttattcctaaatccaggattctttgtgccttctctgggtcttaattctcatctgtagaatggagatgatacctactcaaaggttgtattttaaaaattaaatgagatagtgttttaagacacttatcctagcttccaacacctcgtgggggccgcagtaataggtggtggcattgtcatgttcttttccacgctccgaagtctgttcacccttagaattgccctttgtatgccacaatgctagttacgttagtacaccctccaaatggcataatgagtgcttgtcagatgcttcacagattgtcaaatatgtgcccactgtctatgtctgcttggaggaaggagagtcagtgaccaaggagaacatacggaggtgacggcgattttggccgtgagagccaagtgtgattttggtgttgctgcaactcctttgcttagtgcagcagatgtgttcttgatcaaaaagttggactcaaatgcactgtaaattactttgtgtcttggaacgctgtaggggagcttattggttagaaaaatcctgcagtaaatctttctgtagtgtaaatataattcatttgtttttataaatccagaatgttttacattcttaaattctggcacatgtactcatgaaaatgacattgttaaatattatggttgtgaaaaacataaataagagatttactccccagcatagccaggttacagtgagaagaaatttatacactgtggactgagtactgttaccttaagaacctcaatactaccttaattgggcatgcccgtaatttcttatgaaaaaaaaaggagaaaccctatacataacagttcattattatgaagaaaaattgcaaagctaaaatgctagtttttttgtttttttttttaagcttaaatattctactttaacctgctggattcttagtaaatgaatgatcagttgtaacagtgaatgcttgttgtaaggacttagggtataaaaatttaaatctctgagccagaagagatcttaaggtaattttgagaggtatgaaccttttaggaatacagtcatccaaactttaagtaggtctcttcttctgccaataacctaatactcctgaaaaagcttgtctgttaaatcataacctaaactcttatataatgcataagaagcattttcagaattatccgagattgtctgaaaactgggatgcgatcaaaagtgttcatgtagttctccacttggtgtttgttgctgcaaatcttgtaccagcctgcgcctgagcatggtaaagcctgcttgaccaccgcggcgtgtttcgatactggacaggtctcagcctgctttgcacacacttcaccccctgcaagctgcttgctagatctccctcggccacggtggtgggcttttcctctgcctcctcctaatgccgagtccccggtgcagactcgcctccgttatgtcatctaggagtctactccgtgtcgccagccatgccctctcttaggcccgaaacctgcagcctacaccttctgcctgttaacaaaggaagaaaaaaggagaaaactttattttccaggtaacaatatgtagactgaggacacgtagcttccaggaaaacgaaagcacggaagcctggggtccccaccgcgcgttcatcaggttcggggcgctgggaatgcccggcgcatgcgcagaggtaacacgtcacatcgcatgttcattttggcgccaggttttaacactgaaagaggggttgcggctgtgtcgaaaggtgaatggcagggcacggagacgctttgtgtgcgcagtctctgtgaaacggctgcaaccggcctgggaactgcagcgcggatcaggaaaggttgtttgcaaggtgcctcctgcgcaatcggtgctgctgccggacgccggggcggaggcgcccgggtcagtggcactcactgaagtcactgggcaacgttttcctagaacgggtttctgctggctgcaggcagatctcacggcagttaacctcgtagtgtgagcagtatggggttatgtgagcaacccttccccctgctgtggccgcttagtctcttcacgagggtctcatctccgccacacactggccagctggggccgcgggtaccatgtgcagcgcagcgcaggctggtgggcgctgccggctggtgggcgctgcatggtgcttcactgtcccctgcctcgtggccccgctccccgcttggtgccccacccggaggcagcagagcccatcgttctgtctggactgtttccaatccagctaacgccgactttcctttccgccggtcccttgctgcccctttgtccccgtcctcccacgcctctggtaccctcgctccccacccctttccctcccctccagtcctttcttccgcccgtgcttggggctgaccatgagcaaggcagggttgtgaaaagctggaaggggaagccagcttgccatttgctttctgctttcatttcaaccacactggagtttgtgacgccctaacactccccatttcacgcgttccttttttcatcaggtcgttgttatacagacaggcagtgcttttactgcatgtggctacacccccaccccaacccagttacttttctaggtttaagcttccgttcagaaaacaaactgacttgttagccatcggctaggtgggctgacctgcgtcccctccccgagagcacacaggccagacgcttcggaagagcgtggtccacacgtcacctgcgaacagggactcgcccacgagaagccgctacggcctcagagggaaccttgcctgtttgcctgtccagagcgcagggagaggtcagttgacctcagatcctgatccttttttactttttccagaacattttctagatcagttgtttacagacctcattttgggaaaccgcacttcctatttttacatatatttgcttttttttgtttgtttttttgtgttttgtttttttgagacagagcctcactctgtcacccaggctggagtgcagtggtacagtctcagctcactgcagcctccacctcccaggctcaagcgattctcctgcctcagcctcccgagtagctgggattacaggtgcgtgctaccacgcttggctaattttttatttgtagagacagggtttctgcatgttgcccaggctggtctcaaacccctgggctcaagcgatcttctggtctcagcctcccaaccaccatgcccaactccatatttacatttttaaattataaaatggtaaaactttattatcaggaataaaagaaaaaagtatgtcatacaaacgcaaatatgtaaagatgtaatttttgtaaagtacttcttcttgtcctctaacttagctacacagaacactttatggacatgtttacatggtgagcagccatgaaaaagactgcctgggctttttactctctgtaatagagagcttgtgccgtcacttgttggcagaaaacaaatccaggctcagagaaatagtgcctttccaaggtgatagaaaatagattttacctttcatctggtaagttacaaatggttgtttccttataaataagtcaataaaatgaacatcgtttagcataaagattttccaaaaaagcaatgaaacccttttattaaatgaagtcttatataaaattctaatgtcaattttaataatacatattaaaatactttattttataaacagataaaagcagagctgttctactttaagtgagaatatctatttcctccctcccttccctgactcttcctcacatcccaaagtggctgctgaggtgtcttcacaggcctacggccagtggttctcttgtaaagtattagttataggatgttgtgactagcaagaggcaacaaagttgaagttttttcatgccaacccatttaatttggtcctgtgtcaaaacttacaagttctgttagctttcagatataatacagtgcctagggccgggcacggtggctcatgcctgtaatcccagcactttgggaggccgaggcaggcagatcacctgaggtcaggagttcaagaccatcctgaacaacatgaagaaaccctgtctctactaaaaatacaaaaattagcctagtgtggtggcgggcacctgtaatcccagctactcaggaggctgaggcaggagaatcacttgaacctgggaggcggaggttatagtgagctgagattgcaccactgcactccagcctctatctaaaaaaaaaaaaaaaaaaaaatgcagtgcatagaatgaggctttaaatattttgcctttatttactggagcatttaagccaaaaaggtacagacccaccagtttactgactatcctttgatagtttctgccattttcctcctggagaatttactcagctggggctcttggactagcagtctcagcaaaagctggtgggctctggagaccttcactgttgtcctacttacttgtcctgggaacttgagctgggaaggacaacatgagattgtggcccttttgcttctgataggaacaagctgtcctgaccctggattactgatgctcagacagaattgacctctgggtagctgtgagggttacacctgctgtgtgtgctctgatccgttgggcaggtctctggtggccagtagcattggctcacatgctttccagtgatggtcgcggtcccttcatcctcactaccgttcccccatgacagtgtcttatttacgtttatggttttactgtcacatgccaggcatgatttcagcccaaaattagctcttcctttgttttatcagaaagaattatttaagacaatttctctaaaacccaaatcttcacctttgggaaaggagcagcaagcagtcctgtcaatggaaaattaggaaccgatgggcagaaatcccattcttcagtaatcatcaggaaaaaaactaagctttttctaatctaaaaaaaatacagtcatgatagtttgaccgtgtgtttcagattttaaaaaaccattttgtaaattgaaaatatatatttttacttgctaagaaaatgcaactaatacaaaagaatgtcttctgccccttctcctctgctgccccatgaacagtgcccagaattaaccacatgacattctctgcatctcacagtagtttcatagagcagccttaggtgatctgtccccagagcctaccctggattaacctgaagcagagaccctgttccgtactgcttaattaacacgtgatctaccctacagtgctctttttgctgagctctttttttcttttcttttatttattttttttttctagacagagttttgctcttgtcacccaggcagaatgcaatgtctcagctcactgcagcctctgcctcctggttcaagcaattctcctgccgcagcctcccaagtagctgggattacaggtgcccgccaccatgcctggctattttttgtatttttagtagagatggggtttcatcatgctggccaggctggtcttgaacttgtgaccttaggtgattcccctgccccagcctcccaaagtgctgggattacaggcgtgagccaccgcacccagcctgagctctttctttctttacttacttgttttagagatggggtcttgcactgttacgcaggctggagcacagtggcacaatcatagctcactgcagccttaaactcctggtttcaggtgatcctcccatcctagcctcccaaagtgggttgggattacagtgcgagccaccccacctaaccgtgctcttgctttctaacaagggccctttaggctgttagcctcatttgctgctagactcatctcttgtcctctactctgaagtttgcctgcatcctggcttggatttgaatgctgcactatcgtgattcatacatgatttcactctgggatttcaatctgctggctctttggttgttcatatataagtgtgggctggctctacagagcattttctttggcggactccctgtgttccacggtcattactttggcctgtaattatgccaattccaggctcctttgtaattggagccctcctaaatgtttggtttatagtctggagtctttacatgcacttatgccagtagttccaaacgaatgtcaactttgtaaacctacaagttggaatgttatttcttgaatagtccttatccgaaatgcttgggactagaggtgttttggattttggaattttttcagatttggagtatttgtagatatttaatggttgagcatccctaatccaaaaatccagaatccgaaatgctccagtgagggtcttctttgaatgtcatgtcagtgcccagaaagctttggactttggaacgtttcagatttcagattttcagactagggatgctccatcctattgaaatctgaaatcaggtagtctctattaacataattttgttaatatgtgctatctaactcctgaagccacgcaacacaccatgattagaatttaatactctgctgctaaagatcctgcatatacttacttttattaatgtttactttttatgaatagtatttttccctttcttttaaacttttgttcagtggcttcagtttcttttccaggctctcaagaaagtttcagattttgaagtttcacatcacactattggacagtatgctttttgtcagcccattttacttagtattgacgcctgtgtgtatactataccatacgtagaaggaaccagctatgttttaccatgttggttctgccccagaatgtgatactaaaacataagcccccagagcatgggcttcacctgttgtgttccctgccatgtccaagtgcctaaaacagtgtctgatacagcaagcatgccaaaaaagttgtcaaatgatggtattatttctctatattggcagcacatgtatgtaagccatgtaaattgatatcttgttattttgttacagtttcattgctagtgaactaacttttgtagattttacttaaacattaatcaattttagaatatgactcaattgtccagaaagtaatataactatttcctcctatacgtgataatttctgtgttttttaaaaacaggtataattacaaacagtagatgactcttttcagtataaagttccttgagactgtagccacccacaattcaagatatggaacagatctgacaccccccaaattcccctgtgctcctttgtagcccctgttttcagtccctatagtttgctttttccagaatgtcacgtaactggcataaatatgattatgtgctttgtagcctttgaatctggctttatcattagcgtaatgcatttcgttcggattcatccaggttgtgtgttaatagttcattcgttttgatggccgagttgtccacccttgcatagatgtatcacagtttgttcatctattcacctgtagaagacgtttgggtgatgatgaataaagctcccagaagcacttgggcatgatttttgtgtgaacatagctttcatttcacttgggttttaaaatctaggaatggggttgctgagtggcattgtcttagtttgtttgtttgtttgtttgtttctgtaccaggaaatgaactgcattggagtatctcagtttaaatgatagtttggagatagtgtattccatgcaaaattctctttcctggaacttcagtaaatttcacataatactggccattacttaccatgtggagaactatctgaggattgtttatcctgttttttcagacaagatggaaacagttacataaaatagtggagatggggatacctaacacattgaaatctctttaatgtttctgatttccgctttctaatcaaaatgggtctctcagtgctactaagaaagggtagagtgtttcaacaagcaattaattgtctcactcatgttttcccacccagctcagtaacttaccttggtgttttgttttcatgttagttcactacttagtgcatttggtcctcattggtaaataaaaaggcatctcactataggtgtaccggatctttagaccaaatgggatggcagaatctcaggtggtttaggagggaaggccttgttcagatatatgcacacgactgtggggaacgaagatgggctgtcatggtgcatcccactgccaggaccattggaaaggaaaagcattgcagagagaatggctgaggcgttgagaggcttttacttttctagcagttgtgttcaagtccaaaataagaactaacccaaagaaatgtgactttttaacacacaatcttcagatcttttcctgaggagagactattaggcctataggttatcaaaatttaagaggcttagaactttgtacattgaggtctaaaggctacccactctgggattttgttttatttaaaaatggattcattataataggtaatcaattcacagggttcaacattcatgaatttcaagatcgataccccctgcctcacccaccctattcatcaagggcttctcctgtggggcaaccacagctatcaatttcttgtgattccttccaaagatactgtatgcatctacaagtaaatatgtacaaatgtgctttttcttcctctttttcacaaatggtgcaatatacagcttaaattttaaaaaaaagtagaatgtatgggagtgagggggcgtagactggacatgctgattcatatgcaataaggagtcagttcttaagataaatgaaggaaactagccctgcatccccatatgtactagtgtaaatgatctccacattgttgaaagaaaactcacaattttcctattgttggaatttagtttgtcgaccatcttttgttatttacaaacagtgttgcagtgaataactatgttcataagtcatctcacatctgcaaatgtatctgctgggcccatgtgtttgtaaaatgtttttggtcttgccaaatagccggcacgaggttgcaacatttcaggttatccccagcaatgcagagaaggcttattgcctcccctctggcaacacaatgtaatgacatttttttatctttgttttaattgctatttatcatatttttgttgaaattgagcatatttttctgtgtttaggaacaatctgcattcccttttctgtgagctctttgttcagatcatttgcccttttttttttcatttttcttctgagttatctttttcatcgatgtctttttttttttttttttgaaatggagtctcactctgttgcccaggctggagtgcagtggtgtgatctcggctcactgcagtctccgcctcccgggttcaagtaattcttctgcctcagcctcccgagtagctgggattacaggcgtgcaccaccacacccgactaatttttatatttttggtagagatggggtttcaacatcttggccaggctggtcttgaactcctcacctcctgatccacccacctcggcctcccaaagtgctgggattacaggcgtgagccaccgcgcccagcctttcattgatttcttttaggcattcttaaaatattagggaaatcagccctttgctaatttgttatattaagttgtaggtattttacctagtttatcatttatatagtggtattgttcatagtcatatttgtggccatatttattcagagttttgaggcattcatagaaaggcctttcccacttagatgtgaaaaaaattattctctatggttttgtccaaaacttttattatttcagtttttacatttaagtatttgctacatttgtcatacacaaaaagtttcagtatggtccaacttgatttttttttttttttaagagagagtcttactctatcacccaggcaggagtgcagtggcgtgatctcagctcactgcaacctccacctcttgagttcaagtgattctcctgcctcagcctcccaagtagctgggactataggcatgtatcatcatgcctggctaattttttgtatttttagtagagaaggtgtttcaccatgttggccaagttggtcttgaactcctgatctcaggtgatccgcctgcctcagcctcccaaagtgctgggattacaggcgtgagccaccctgcccggcccaacttaattttttttggttgagttctctggccagtttcccagtatcacttattgaatattccctctcttccctaaggattttaaatgctacctttatcaaacattagcttcccatactgtctgggtctatttctagacttttgttctgttgatctttcagcctgaacatgtgtgctgtatgacactttgtaaattatagcagcgttgtaatatctcacagggctagtttctccaatttccttcttttcagatttatcattgcatataaacttcagaatcagcttgtctagtgtatccctcccactcccgccatctccccctcaaaaaagaaaaacaattgtggtgttattttcttttaagattaggttgcctttataaaccaacttctgggaaagtagatttgttaagggcattaaatctttcccattcaaaatctggcatggttggccatttcttcaaattttcttttgtggctttcaggcatgttttaagttttgtcatctgggagttttagacatttcctgtgaaattgacttataatattttaactttttgttccttttgaaaataaggccatttcttccattgtatcttctcactagttgttggtttatatgtgatacctattgggttctctgtgttaattttgtacccagctgtcatcttttctgaaactctcttcatgttgatagtagtttttcagtggattcccttgggtttcttcaggtatacactcattgtgcaagtagtgatcattttacctcctgcctttgaattacctctttctctctctagttttattgtattaactagtacttgcagaacgttaattgtggtgatagtggacatccttcttttattcctgacttaaatggatgatatcttgttttctcattaagtttgatgctggctttggggtaaggtagatatatttggtcatccttctattattttactaagaattttatcaagaatgcataaattttttcaaatgccttttcagcatctatggagatgactatatataatttttctcttaatagctattaatatgagttgtattaccagttttctcattattaaactatgcttatattccttgactgaattctacttggttatgtatagtgttgttttaagttgctactggattgcatttgctaatattttatttaggacctttgcactggtatttacaaatgagaataatctagttttctctcttctctctcctgtctctctctctgagtgtgtagacttttgtcttattttgctgtcattgttatgttggctttttttttttttttaagttcgttgctttctaatagttttatagtggaattttctgttcttcacacagaaaaattcagggaatgatctcctgtgaagctgtcgggtttgggggccttatttagaactttattttttctatgatgattgatttgcttggatttcatgtctcccttggagtgattttggataaattatattttcccagaaaaataattcacttagtcagcttttcaaatttacttatatacagttgaatagtgttgaatattatcttttaattacctccatttttctagtatttctgctcttatttcttattttggatatttgtgtttttcttttttgattagattatttaataatttgctttgttccccccctccccccacccccagaagaaagacctattggacttattaagggatcagtttggccagtttttaaaagtatatcatggacactgaaaagagcatattctctgttttcagggtatagagatctatgtatgccagttcattataccctgttgatatgtgacgtaggtcttctgtatccttgtttctttctgtctactctattggtcatgatctgtaaattaatgtctcccacaacgaatttgttttactcagtttctccttaaatctattccctgtagtttttgctttacaagtgtggacactgtttgatctgcagataataataccacgtctttttctttttttagagacagggtctcgctatgctgcctaggctggtctcaaactcctgggctcaaacaatcctcctgcctcggcctcccaaagtgctagaattgcaggcatgagccaccacacctggcctcacaagtctttattgtgagttgctcctttagaattgtaaagtcccctttgtcttgtttaatccttcattctcggaattcagcattgtctgatattaaggtgacaatccatgccttctttctttgcctttgtttatcctttcttttttatcctctccaaatccacccctgccattttaggtgcttctctgtcatacaacataaaattgggttttgccttgtaatggaatattcatgtctgtttttgaataggcattaatttggctcatttgttaatatgacatacgtttggcattaattctgtcattcctgcttggttggggggaatgtgtttttaagtagcttttgaaacatctttttacagtctgtcttgtttgctttagttgtttgtatgattttctagtcatctggagttttatttttgttttaactgttacccttgcaactttttattgtacctgaatcttcacattttagacattatttattaatttcctactgtgaacaatggtaaattagcatatttcctctttccttttccctttcttcccgctactacctgatcttagttacttatagtattcgtcgttgtttacttctgttaagtttatttgtacgacattatttgacttattaactttaaatcagcactgtccagtagagctctctgtgatgatgtgaatgtacttcttatctgctctgtctcttatgatagccactggccatagtgtggctattaaacacttgaaatggaaggtcctgaattttaactattaatataagtttaagtttcaatagtcacatatggcttacagctaccatactgaaaagtgtagaccaggtgcagtggctcacacctgtaatcccagcactttgggaggccaaggcaggattgcttgagccctggagttcaagactagcctgggcaacacagcaaaaccccatctctacaaaaaatacaaaaattagctgggtgtggtggtgtgtgcctatagtcccagccactcaggaggctgaggcaggaggatcactggagcctgggaggtggaggttgcagtgagctatgatcacactactgtactccagcctgggtgacaataagaccctgtcttaaaagtatggaagtatggtttgaataatacatttttaaatcccagccatcaaagatgggaaagccatgtacattatactacttcctagattctagttctcttagtctcccagctagtgtcgattacattctacattgtcaggacttatattttgcattctcttctttcattataatcatcacttatctcagtcttcttcttacaattaaatggagttaatcctcacagttggttcttttgacatagtttttctagccatctcttggatagctatagtttactatttagtacattcctcaagaaggacttttatatagtattgcttgggatatgtttttttttttagtttggttgggtttttttatttttgcacatttaaaactttcagttacactggaatgacagattaggtgagtataaattctagggtcacacttcactgccttgagcattgttgtatcattctgcttgcattttgaattccattttgctatggagaaatatggtttcttttcctcttatgagtgactcgatcttttttcctgactccaaaaggatattttcttttttgaatgagaacacttttgctacagagtattttcattgagtgctcctaattcctttgcccttgactgtttttgaattatcacagtaaatatttgttctgcttcattatttcagttttcttatttggaacttaattaggcatagctgtgtgtttgttacctgtctccaattttatctctttgtggttctttttgaattctttcttaaattttcatttaatttatttggattttgtcatttctgccctgcatatatccttagacccttttaaatttattttctgtggtggtttgattttttccttttacttcttttctgagctttcctatatttttatctcttccttttgcctcaccatttcctccctgagctcttatagctctgttttgtgttcatcctttatagaagcaattgtctcatcggactttacaaattcatggtgaaatgcacattcaccattttcatctgcttgatggtatggatttttcttctggtgaatgatcgtttattcatttagtaaatgttcattgaatgcctactgttgccaatcactctgccctggtggagtttatgttcaggggcaggagacagacaataaataaaatagggaggcacttttgtcttattttggaaggtgtaagtgtcacagagcgcagtcagtcagggaggggggataatgagtgctagggagggagtagtacagtttcaaatgtgggctcacggaaccgagtcctgcaggtatctgagaagaacaagcaggtggagcaaggaacgtgggcagttgcctaaggctggaatgtgcaggcctctgaaaggaatggcaagggggccagggcaggagcgagggagcagagggccccatatgagggccgtcaggtaaggagagggcgggtccccctttgtaggctgctgtggctcttactgtgtgcttgagatggtgagctgctgaaaaatctaagtggaacagtgacctgacctggctttcgcattcatctgccactcgtatttctctccttcctcacttcccctccttcctttcccttcccactctcattttttaatccattagatgtcatgtgctcctctgctggttccttttaacctctccttgcaggagatgaatttattcctagaccaggctggctggagtgttctaatagccggaggatttacgtgagagtttctttcatcttgactttgcatgagcccatgcagtaaccagctgcagggcgtttgcaccttgcagaggggctcattgtctccaccactgcagagaccgactgcttccagcatggggcgggttgacaggatgcctctctgggtgtggcctcagctgttcccaggtgtaccctcactttccagaagaagcacgtttgcagagctgggggccttctttccgtttttcatcacgtccccctgctcagtcttcacttcttttaacagctcttccacctatttcatggtatttagctatctccttgcctcgccgaaaatgcagtttgtggttttggttctcattctttgggtgatttccaggaagccaagaggggtcgcggacttgatgccactattttcaaatccagagttccaattatggttttggcattttattacagagaacaaataagaaaaagagttgtatagtttggtagtggccttttacatttagagaatacaaagttaggctgggtgctcacacctgtaatcccagcactttgggaggctgagatgggtggatcacttgaggtcaggagttcgagaccagcctgaccaacattggtgaaaccctactaacaatacaaaaaattagctgggtgtggtggtgcatgcctgtagtcccagctacttgggaggctgaggcaggagaattgcttgaacccaggaggcggaggttgcagcgtgccgctgcactccagcctgggtgacagagtgaatgaggaaaaaaaagagaatacaaagttagaaaatgtggttgcttttgcccccctttgaacaaacttgccagtggtttccgctgtgagagccagcaaagctgagaagagcaaggtggccagtagcctttggaatgcttgtttccaggcggctctttgggctgaggttgaagatgggcagcttcaggcctctctccagacttagctcctccagggcagggacttggaggagcccctcgaagcaggctctgagtggtgtggttcttgggtgcatggcctctgtccatctaaagcaaagcagctgaggcacaaagtataataaagagctgactcgagccaaagagaggacagctgcccagaagatacagacccagtgaccctggatatgaactccgttcccctgtgttacaagtaggttgttaaggcaaagaaagggggacacggagtggggtgatacaaagttgtttgccaggaattctcataggcttacagaaatggcattgatgggcgattggctctccattgttaagctctagggtgcgggctgtagtctcggatggggtgtgattgagggaatttatagcttagctgctggtggcaaaagcaggtagtttcgagagatgagcacaacccagagaaggggaggacgggactgccgtctcctttcagtgtctctgggctggataactgaaaagtattcacattcctccaatgaaagctctttcctttactcaccctgaagaggggttggctcttggtgacgcgagtgggtcccagtgtctgtgctggcttctctgatgagcacgcacaccacacggggctgcgcctcttcctcctcccacttgacaatatggcctttcccaggccaggcgcctcctccatgatgagacagaagctacggctcttctcccaaaacagtagcaccctgcacacgatttcggtgtatacgttctgggttcgttgccagtctgtgaacggtccctctttgtagtcacggcccccagttgaaggcctctgcttgtgatgttggacgaggtattagtactatctggagccataaatcttatgtcttcctgatgaaagtctagacgaaaatctgagggagaagttcttggtgagatcttgggttttccttaatgtctgttctaccagtgtatcctatcttcctctgccaggatcaatcaagcattgtgtagacagatcttgcctctctgttaaaccgtctcctgtttctaaatcccttggccctcggcctcaggtgggctaattccctatccttctttcattggtaggagttgaataaacctgtatattataagaatatctaatttatccacaaatgttaattttgtattttctgtactatattgtgtctcgagtcataaaatatttactctgcttacttccgaggtatgtcactacttttttcctcctacgctgcagggattaaggagggaaaaggctttactgatgtcatagttagaatatgcccatcagggagacccagagacctgttcccgtgagactgacggaaagggttatgactgcataggaacgggaccatcctcaggcgctactgtgtggttcaattgataaagctcacaaattattttgtctcatttatttgtgggacatattcgtcaagtaaactttaaaaaatatactagtggatttaaatttttttttctttttttgagacagggtctcactctattactcaggctggagtgcagtggctcattcatggctcactgtagccttcacctcccaggctcaagtgatcctcctgccctcagcttcctgagcacaccaccacgcctggctaatttttaaaatttttttatttgtagagaaggagtcccactatgcagcacaggctggtctcgaactcctgggctcaagtgatcctcctgccttagcctcccaaagtgctggattacaggcatgagccatgttacctggcctgaatttttaatattaaatttccatttgaatttgggctatacaaaaaattaatagaattaatgttaattaaacttagaatttaagttacttcacaggaatttttatttaagtctgcttaggaattttttaggaacattaaattaaacattaaacattaacattgaaacaaacacagtcatctccattttaagcagaattcaaggagaactcattttattcttaagattgcttaaaatggagatgatcgtgtttgttttaattagacttcaaggctttgggatggggagtggaaacaaaaacaaaatacttagcacatttaagggacatagaatatttcttgcttccaaaattcaagttaaagtaagaacttggtaaaaatttttcactggataactagaagaaataaaagataagcagatttaaacaccagtaggacagatgttttttaatggtttgatctgcaggccaatttttatttttactgtttatttttgagatagggttttgctctgtcacccaggctggaatgcagtagcgtagtcacagctcgctgcagcctcaaccacccaggctcaagcaattctcccacctcagcctccccagtagctgggaccacaggtgggtgccaccacactcagctaattttttttcttattatttgtagagatggagtctcgctatgttacccaggctggtctcaaactcctaggctcaagcaacctgtccaccttggcctctgaaagtgctgggactgcaggcatgagccaccacgcccagcctgagacgtgttgttctgtgtggattgtggattcagtctttctgttccgcttgatactatttcatcccctcaatttcctcttccactcgagcccctgtaacagattgagaccatccagttctatggtgacaggaagaaactgctctccaatagcgaatgcagttactatccgtaatctattactcagtaattatcttcagataaatgcacagatgatctgttgtgaagtctctcgatgatgtgtgaaccaagggaatggaggcgccgatgcctcctggtgtgagcaggaaccacagggacagggcagtccttctggaaagtggcatgctgctgcctcgtgggtggcaccaataacctccagtcttgctcacagtaggcatttctgggcagaaaggacaccaggctaaccatcgtgttaaattactcatgcatttgcagttgtgctgtcattttagtcagcgctattgagaaagagcctaacgaacagagttttattttcttctgttccttttgaagggacctcatccatgcccatgtgtgatatcactgggaacttacatttgccctggcccttctccttgcactcttgaattcagacatctgttgagattccccaaccaggaatgaagacatgtctgagaggcagtgacgggacgaggtttctcatccccacacccgggtgctccccgtcaggtgtgtccaggctgccacgtcattatcagtgggcatctgtcccctaccaggacctgggccttctccaccctggtatccaggtgtctcagtgaatgtctggatctttaaacaaattgatgatgaaggagacctacgtttgctaataaacaaggtagaatggaggaagcatgctaatttgattggtggctgtcttttctctcccaggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaaggtaagaaagaatgcttagattgcaagtttttagttcaatattgaaatgttgggctgggcgcagtggctcagggccaggcgcagtggctcaggcctgtaatctcagtaatttgggaggccaaggcgggaggatcgcttgagcccaggagtttgagagtagcctgggcaacatagcaagaccccatctctataaataaactttaaaaattagccgggtgtggtggtgcgtgcctgtagtcccagctactcaggaggctgaggcaggaggatcccttgagcccaggaattcaaggctgcagtgagctatgatcacagcactctactccagcctcagcaacagagcaagataccatgtctcttaaaaaaagacatgtttatggtgggtttcacttgctgtgtgcctttattgttatctgttgttattttgcaagggatggtggtagttacacttctgatatttactaatcaacctgcgaaaatggagatactttgtttctaagtatatcctgttattgaaagtctgcttatatttattcctatttgataaataggattaggagaactataaatgtattaatttcagccattaaaaagatcacacctgggtgcagtggctcacgcctgtaatcccagcactttgggaggctgaggcagacagatcacctgaggtcaggagttcgagaccagcctggctaacatggtaaaaccccgtttctactaaaaacacaaaaaattagcggggtgtgatggcgtgtgccccagctacttgggaggctgaggcaggagaatcgcttgaacccaggaggcagaggttgcagtgagctgagatggcgccattgcactctagttgaggcaataagagcaaaactccatctccaaaaaaaaaaaaaaaagatcacagctcttctgagaagttgtgcctgtggcttatgttacatgccttccaaaatcaaaactgtcattttattagctgtgtctatgctactgttgatttgacactaaggtaagatgaaaatagagcaagtaactgttgtttttgtcatttagggtagagttttgtgttccagaatgtaaactctttctctattcttgtagttgccttttcctgaaggacatattaacgctttaagttttgcagggaaaagagtgaagacagagaaaggtgcattcacagtgttcagatttaggggcttcctatgttttctacaactttattttaatccattagtacttaagagattcacttcctaagtcatgggtcttctccgagccactgatgttaaactataaatgcttaaaaagcatgaatacgtgccttgaaggcaggttccaaatgttagtaccctcctgctcctccttggaggcccagctgaggaggtctgtgcaggccacagggctggaggaaaggcctgctctccctgagcggctgcagcaggaaggctccgaggaagctggtgggctgtcaggagcagaggcagcgctgcccagaagagcacggggctcggtgagggggagccgtgggttcacacgtcaaccctgttagccaggcagcctcactgtgctgggtctgcttcttgatcctgaagatcggggtcgttaaaacagttaaatgagatacctggggaggagagagggatgtatcagttcagttcccatgtgtctcaagcacctatgtgtctcatgttgtaaatgaatcattattgtgccagagtcttaaaaagcagagccaagtcactgttcatctccagacccagcgcagagctgccgaagacagcaggatggtggcctccagggggtcggggtgctgtgtccttcagaacgttattagtaattggaaaggacatttccaagtgtgtgctgatggactgaactgatttttgtttacagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcaggtgagagcttcctagtcctacgcgactgacttcacaagttttcttctgacaaacggtgtggtctttctctcaacgttagtagacgggcccaagaatttaatactgtgtttattgctgagacctcgcatgtatattcgacgttaatttctcatttccctgataaatgcatttgatgtatggccgttatttctgatgggagcctcaaggcactcgtgctgtaacttcttttccctctgtttcttctgggctcttttcaggccacctcacattgtaagggatgcttttattgtctggtaacagatatgccctaacttctttctggcactagcattaacttgtctgttttatacttacaagtatctctttgtttaacacccaaaggctactactttgacataggctggtgttctttactgaacaaaccttgtcaatgaggggaagtggattatgacttcctgtctacctctgctggttaagggacgtctttgacagtctgctgttgttgtctcaggagcagtggagtccacgcggggtgagatagcctttcctttatgcagcagaaagaaagatacttttgtgatagcagcctcgcagcacttcccttgctggatgagacacaactcttcagtcttatatgcaagagggatgaaagtcaggaatttttttgatttattaagttttggtcaataatttggccttagtagatacattatcctgctgaaaataatagaacctttaaaataaaagccccccaaacccctgtgagtgtttaaagattcatctgtatgggagttttatgaattgcctaagagatctgtccagaggaaacacatgtagtatgatgtacatcttctgtgaagaaaagaagtgtttctagtcctttattgttagcaccaaaggctttggacagccccaaggaagcagcagtgatgactgagtagtacctggattcagaggaagctgcgtacgtagccatgcagataccaattgctggtatgtgggtgggagtcttctgatcagctttctaggttgggactgtttccaccctgaaagaaactgaatgaaaaatgcctttttggcaatactgaagatatcttgaacattgattttggaaattatttttattatctacccagaatcagtatcgacttgctttatccacacggcagttctttaatatggttgatttaaaaatacaagaatatgttcattagaaactggaataagatcacgttttcagtgatcatatttgttaactcctgcgttcatcaagacttaccaaaagaagatgaatttgtttaaagtcaaattggaaaccccatccttttccacatgttgccaagacagatgttcagatatacatagaaaacgtgtgtgctggccaggcacagtggctcacgcttgtcatccctgcactttgggaggccatggcaggaggattgcttgaacccaggagttcaagaccagcctgggcaacaacgcaagatctcatctctacaaaagaaaacaaaacaaaaagcttgtgtgcttctgttgctgcagagctgtgtgtacattggaggctacttaaaatatagtaggagagttaacaggtggtgggttccttagtaaagggaataattgcccctaccctcgtcttttcatcatcagattttaccatttgagggttaacctcagagtactacaatttggaattcagtacctccccaactatctcaccgatttctaacaatgaagagatttcttagcttaacctctgatttccatgactttatcacacttattgtcattcagcacttaatagtattttgccatctttgttcacctaaaaatttagatttttttctaaatcattttaaagttagtttcagagtcttgatacttcatctcaaaatacctcattgcgcatctccaaaaactaaggacgtttgtctctataattacagttaacatttgcacacctatcagaatttgtaaaaattctcaagtattgattaattcttgattcatatcaaaatttgtcgtcttttgagaaaataaatttaagagaaactaagattatgtttttttaaatctgtcatcatccatccatccattcattcattcatgccattatttggcaggtctttttcttacagttttatagtagagcaagtgccgcccagagacggcagtgacttcctgtggtcacacaggccagcctcagcctgcgggtccagaccagcactcctcggcccgcactgtttaccgcacttactctaaaggttaacataggcacatttctttggatagaaacttttgttgctaaaccctaatatcatctttcttaaattatgtgccaagaaatttttcattcataaattgaattgtgttgtaacaatctaaaacggtaaaaatcataaatcagaataaaggatttaaaagatagacgtgctgggtgcagcggcatgcacctgtaaacccagccacttgggaggctgaggtaggagaatcacttgagcccagaagttcaagtccagcctgggcaacatagcaatacctcatctcttaagaaaaaaattttttaattaaaaaaaaaaatatatatatatatatatatatatatatacacacacatatacacacatatatatgtatatgtatcaaatgccagtattatattcctgacttccagaggcttggctttcttgtcattttttagatgaagagcttgacattcttctcagtcatgttgcgttcatgtttgtctttgttactagatacttcatatgatcatcagagtcttccgtagttgccctttgtgcatctacttcttctttttacaataatttaaattgtaggcaagttttattaggtttgttctactcttgctttactcttgtagctgtgctagcaagcgtttatcctatcacataaaacatgtctgctgaaattgtatattcagcactcatttctagagatcctagtcatcccttttcaaagttaaaaattccttttataggaatctactttaaaactatggacagggctgggcaccgtggctcacgcctgtaatcccagcagtttgggaggcggaggtgggcagatcacctaaggtcaggagttcgagaccagcctggccaacatggtgaaaccccgtatctactaaaaatacaaaaattaggccaggcacggtggctcacacctgtaatcccagcactttggaaggccaaggcatgtggatcacctgaggtcaagaccagcctgactaacatggtgaaaccccatctctactaaaatacaaaaattagccgggcatggtggtggatgcctgtaatctcagctactcgggaggctgaggcaggagaattgcttgaacccaggaggcagagtttgcagtgagccgagatcacgccatcgcactccagcctgagcaacaagagtgaaactccatctcaaaaaaaaaaaaattagccagccatggtggcgcggcccctgtaattccagatactcaggaggctgaggcaagagaatcacttgaaaccaggaggtggaggttgcagtgaaccgagatcacgccaccgcacttcagcctgggtgacagagtgagactccgtattaaaaaacaaaaaaagaatatatatattgtatatatattctacataaagatccttgcagacaaggatgattcttttaaacaatgttttactctcccagtagtaccttaaatatatatagtaacttcttatttcatgcggacaggttgttcatacgaatattagcttcttggaagattcagttatgcatagagtccgagttatgaaaattatttttgacataattctgaagtttttcctggacgattaaaacaacaactaactttattaaacgtggattatgtgatttttttttaaagactggcattacaacagtggtcctgctgtagaattacatttttaaatagtctctcagctcacggacagggatttgaagcaacagtctccgttcaaagcctgctttaagctcaataccagctctgcagtggggctccccttgggggaatagagctcaccttgcagtaggcaccatggtagcaaccagctcagaaaactaacctagggacagcagagaaatggaatgcggctctgccacattaaaaaagcaagtgtgcaagtgcgatgctacattgttttccaacccactttttctttgaggtgcaggctacatctgtgtgttggcagatggagagagacctcagatgtctcgagaaataagattagccatgagttgacccttgtggaagttggttgatggatgtgtgggttactgcatattcagtaaactagaagttccctgaggaccaggtgtgaccttgagcttggctctggtgcccagggcagtgctatgcactcagagcaggtgcccagcgaggaagggttgtgacatgctgggtgctgtcccagggttgcagtcctcactgcatggattttctaatcccgcttacaaagtagctgctgttttccagcattgctttgtgccagccctgtgctgagtgcttgtcacacatgatctcattggagtctcgctgcaggtgggtcttaagagccccattctacagaagggaagcagaagctcagacaagttgtgttatctgtctgggctcgcacagtaaggcagacaacaacgggatctggcctggcgtctgctcctgagcgcactgccctttctgtctcgccagcctgctccctgctacaggtgggaccgtgcacctgtttgccagtgggtccaactgcaggccagctgtgcaaacagattgaagaataaccttaaagtggttcatttttaaaacagaaatgcctttattttgaacattaactatcctattatgtattatattatgtatgttaattttctataatgcactgattgtacaacatttccctaaaatatgttgactgacttgtctctttgaatataattccaagatgaaagcaaatcccactaaaatgaacttttttcctccaactctcccctttagtatacactgcgctgtgacatgaagcggtctctgttggccaaggacttgacaaagacctgtgaatttatcgttcactccgctgtaagcttcactcggggactctggtgcttaatgataggaatctcccatggggtctgagagtttaccctatttacaagctcaccatttagcctcttactgtttcacgggtgctggcagaagacacaagacttctgggtcagagacagtcggtggcatgcgcatcacgtgtgcatcattgtcctgggcccagagtcccccagctgaggccgcgggccagagggactccacgtcggcacatcaggcaggacctttcctccccctggctctctggatggtagactggccctttgcatcccagcccctggataaaaaatgccaggcaggctctcatgaagctcggctgtatctgtagattctgaaattatgtaacatggaggtgatcactgttactgctgttttggtaacgtttaaagtatgattcttcaggtgacagctctatagctcagaggccaatagcaacctgacctcctgggttcaatgctcagccccccagctccaccactgagctgagcaggccactgagctctctgccccgcttgcctcgtctgtgaagtgggaccatctgggaggtgtgaagagccctttggagggtcactgtgctgaggtttcaaataagtacttgccaataacactgttctgtttcttagatctgattttaaaattctgaatctgaaaggcacgttggagattaagacatctctcccctcattttacagatgaggaaactgagtttcagcaagatggggaaatttgacagaactgtgttcaggacccaggcttgcgcctcttagttccccgtccttcctgcatcgccaggctgccgttggtttatttttgaaagggaaaagctatttgacctgcagaactcttggccttcacctactgatttcggtttcacctctcgttttagcctcagaaggggaagtttactcccagtcccgtggacttcacgattacacctgaaaccttacagaacgtcaaagaggtaagacgtcctgcacaggcgaatgccgtgggtatcttcccagcagccagaccccacggactagctattgcccgggtggtcttcatttggaaatcacgtcatcagccggcagagatttctgattgtacccaaattactcagtattttccatttgatttcctttttaagctcagtaaagcagcttagaagaggactgcttttgaaaagttcctcagggagggtccatgtctattaatctcaccattttccctcagttttactgcatcatgggcccccaagaccccctgctgcccatgacacggccacgtcccttcatttctcatggttagccggggcctgcgcccggccccctggcctgttgtcatcctccatggatgtttagtttgcagtttcttccccagcattcccatcagacagaggccgggcagcaacgtgcttttcaaagattccgcagtgccctccgtggtggacgcctcacggccagggcaggtacagtgaggacacagacgcctgggcagtgccagcccagctcccccgcctcctgcatcaggacagggctgtctggctgtcagtggcagccgctggtggagcctcagctggtccctcgagctgcacggtgaacttgggcccgtccaaaactctgcctggccccggcctccctgatcttgccctctcatccactgccatgcatttctcctaaacagtggagtcctgtagttcttcctggatgtaacttttcatccttcctctaattctttattctgctgtctggaccacactgactaggatcaagtgaaggacaagctgggaggcctgggccctgggatgtcattggcctcatccctcagaggctggacatgtgtcgtggggagcctttcagacaggtgagggaggaaaggccactcctctgtctgttctgcacgtctcccttctccgggctctgagggcacgcgaccccagtgggccactcagactcccgtctcccacctctgtagcctgtcttcggaagcgctgacctcagcagtaatgtgattcatttctagacaccgtttcttcttcgggatagctgctgcttccatgacggacgcagtggcctttcatctccttttcctgtattgattctgtttctcaggggttggttctgtttgtcgagtgtgtgtgtctttttcttgcttttgttttccttaaatgtgtattgatcctcggttgtcagtttacatttacaaatgaggatctaatgtgtgtggtggtgttgtagaggctgtatccttagcccaggtgagaacctgttctcctggtcctcagcacctgctcatcagaggcgctctgccctgggtgtggcacgtggccggggtgtttgtaggcagcttgtctcctgagtccagaggctcgctgtctgcattgtggctgtgaatgacgtgggacacttgtcctaccttgccccgagtctgcttttccgggtgggagatcccctttgcaggaagctgtggtgccagtctgtggcagcttcccccatctggtgagctcacctgtgatacctgcctactgcccttcgcaggcccccgcccgatggcaggctgaccacacgccctgcgagcacacccgctctcaccgctccccctgccacctggaggacgggtgccccgaactcccgggagccggattgtctgtccactttctgccggacagaaacacttcactggggtggtccccacggggcgttccttgtggcttttctaggtataggtttatttgtaaacacgaagaacttttctttccacagaaccattcaggtttattgttggaaaataagaaaataacacataaagcaaataaaataaaattgcttattcacaaaatgccactggtggttttttgttttgctttttaagtagaaaagagatgtattgtagaaaatcttgtagatttttaagtagaaaagagatttattggaaggatataagacagctttacaggaactactaggctggagctcagactcaaaatagtataggtttattttatttgtatatgttaatatcatgtcagtgggaggagagggaaaatgattgtttagtcagtatcttgagctgaatgttgaaagctatcctttttcatcagtcgcctaaaagaattttaatgtgtactgctactgctttttgtttttctacacaaatagcttctcttagttatttttaaaactctgtcttggccaggcacagtagatcatgcctggaatcccaccactttgggaggccaaggcaggaggatcacttaaggtcaggagttcaagaccagcgtgggcaacatagaacctgtctctacaaaagaaaaatgtaaaaattagctgggtgtggtggcatgcgatcgtagtcccagctactagggaggcttaggcaaaaggattgcctgagcccaggaggtgaggctgcagtgagccatgtactccagcctgggcaacagagcaagaccctgtctctaaaaatgtttataataaaaacaaataaataaaagctccatcttgaatgcagacttcttcagaggtctgtacctttggggactgccaggtccagagtcccgggcttttcaggtccagagcttcactgcctgatcaggtggccaccagccacacatcaccattgaccctggacacatggctggaccaagtagctgagttggatgtgtaaatactgaccagatttcaaagactcaggatgaaaagaagaatgtaaaacatcattcatatttttgatattgattatatgtggaagtgataacacttttgatatattcgttaattttaccttcttttttaatgtggctaccagaaaattccaaattatatatgtggcttccactcgcagcttgcattatgtttctgttggacagtagtatgccaatatctgatcctttcagtaactgggatccagccagaggtaaagattcctagaaaaattgtctctgtctagaccaagcccattcaacccacagcccaccggccaggatggctttgaatgtgacccaacacaaattcataaaccttaaaacatgagattttgtttctgtgatttttttttagctcatcagctatcattagtgttaatatattttatgtgtgacccaagacaattcttcttcttccaacgtggcccagggaagccaaaagagtggacacccctgctctagaccatcatcagtccttcctggccagcgtcaggtgtgcagagtaaaggtttgtaggcttctcatcaagcgtcaaagaaactagttttcttcaaatttccatgaaataaaataaatgtcttgggttttaaaaattgtacaattgggaacatctttgaatgtttttttttttaagagacagcatctcattcttgtcacccagactggagtgcactggtgtaatcattgctcactggagcctcaagcaatcctcctgcctctgcctcccacgtaactgagactacaggtgtgcaccagcctgcccagctaatttttaaaacattttttagagatggggtcttgctgtgttacacaggctgttcttgaactcctggcctcaagtgatcctcctgcctttgcctcccaaagccctgggattacgggcctgagccactgtgcctggccaggacttttctttttaactgtgtgtgtgtcaggttgtcttgaacaccatggcgactccctcagactttttcatgtcttattccttggtaagaaggagctttctagctctgagactaggcaattaggatggttctctgaggcattctctgtacacagagtgtcagtcaggtgccatatgtagagagtcgttgaataattcagccggctaatgtccaagacgtcagtacttcgctcctttcttcccgttttgtgagacggtcccggtggactgtgtaaccactatccaacttcgcttccaggttttatttgcaccaaagtatggagcactttccccccttgcctgcattctgatgtatttgttttcattttgttttagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcggtgagggccgtgccaccaggcctggcgcttgcctgtccccctcgactgccaccctcacgttccatggttaagaggatgctggggggctgggcacagtggcgcacccctgtaatcccagctactcaggaggctgaggtgggagggtggtttgaggctgcagtgagctgagatcgcaccattgcactccagcctgggcagcagagcagaccatgaccctgactctaaaaaacgagaggacgtcggggaagcaaaagtaagagcgtggctgtgccttagcagtagccgcgtgtctaaggaaagtgaggggaggggaccctggaggattcttggagcagactggtgggtggtgccggtgcggatgtggaccccgcagcctctgctggccctgaccgcgtgatgtggcctccctcccgcagggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtgggtaagtggcactcgcctccagccctcatgggcccatgggaagggccgctcagcgccagggcctgctgtgggtcacagagctcagaacctgccgcccttcggtccctcagtgccagggcctgccacaggccatacagctcagagcctgctgcccttcggctgctcaacaaaaccttgttaaggagctgctgtgccgcacaggggacacacccacaggcagtcctggtgcttgtgggacttccactgtcacatggggaaacacacagacccacatcagtgtagacatgggcaggtgacgctgagctctgtgtagacatgggcaggtgacgctgagctccgtgtagacatgggcaggtgacgctgagctctgtgtagacatgggcaggtgacgctgagctccgtgaagaaaactcccgtgaacgagcaccacaggagtggggggtggtgtggatactgagaaagtggctctgtgtgaaggtccaggacccgtgaaaaccccagagtgagcgctcagaagcaggaaggccttgagccccgcggcctagatgcctctagtgagtttccatgaacctgtgtgttcatattttaaccatgggatctgaatcaggtcacagacacccttttatattctgcctttttcccttaacattgtatcatgaacatttccatgtttttaactcttcctataaatattgtaatgggacctccatcttaataagaatcatgttaattgggagatcactccacactacgaagaagtagaacagagagacccagtaggaagggaccgagccttctcagtagcaggggactgtgattcagagaggctcggggacctctaggttggaagtcaggagtgagcactgcatccacatcaagagcagcacctctgtgtgttcccctccaattccgtgcgagtgacctcaaatgcacggtcaggcccgagactggaactcactcggactctaagcagcgcctgggtatcatggcggctccagtgcagctgttttcctgctgtaaaggaaagcccccgccagctccctatcttgcctgctgggcatccctctctgtccactccagccacaccctccacccttctggggggcacaacaagaggggtggagaacccattgaagggagtggtggcaggaagtgcccagaggactctaatgtagtgacaataaagtgaggaaggacaggccggccactgctggtggccgactcttcttgtggctgatgtttgggcggaggtggacactcccacacggggatgttgtcctgcagaccccagccacaggtgggcactgactccaaggccccttccacagctgagctgccacagtgtggggctcagcacagggtgccctctgcccacacgatgcccttcccacccctcctcacactggggaaggagatggtgcttgtttgtcgtcaggtgcttcctcttcacacacatcccttttgttaggatcaacaaggctcacccatatcagctgaagagtcggtggagaaggaatcctgtttgctgaaaggtgatggatgaatagtatccaatggagcaacaatgaaattgttgcttctgaagactgtttctcacctggggattggggacatgggcccagacagctatgcgctggttcacagtctgctatttcattaagaaccgtaggaaatgtaaaaataaggcaaaggaatacaaatgaattgaaagggttctagaatatcctttttaggaaagcaaagggacagggaaagtgtagttggtgaagcctgatcactcatgttccaagatgagaggacaaaaattcacttagagaaagttgacagaggtagtcagacatcagcatagtcatctccactgaaagtttggctgaaaggtcagggtggcgctgaggggacagcaatgaaacccacccgcaccgggtgctccttcgccgttagagcttcctgcgactgcagtggtggcggcgtgtggtttcgctgcttggtaacagtgagcacaaacccaccctctcttctcttctcagaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaatatgactgctttccttagagaataattattacctgaagcgcatccagacaacgtggctacctttatcatttcattcaaccctgagtggcccaaacaaaggcctcaggccggccacttccttccacttcttggtctgacctctccatgatctgttactaggcaaaactcagatgtttggctaccttgggctgcaactgtcccactcttgcccaggcttgctggagttggggttatccacagtcagaggttcagagttgtcaaattctccaattagagcaagagatgaggaaaggaaagggagacgaaagaaagaggctgtgcctcagaaataataacgccgcatatctacaactatctgatctttgacaaacctgagaaaaacaagcaatggggaaaggattccctatttaataaatggtgctgggaaaactggccaaccatatgtagaaagctgaaactggatcccttccttgcaccttatacaaaaatcagttcaagatggattaaagacttaaacgttagacctaaaaccataacctaggcattaccattcaggacataggcatgggcaaggacttcatgtctaaaacaccaaaaccaatggcaaccaaaggcaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaacaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattcaaaagtcaggaaacaacaggtgctggagaggatgtggagaaataagaacacttttacactgttggtaggactgtacactagttcaaccattgtggaagacagtgtggcgattcctcaaggatctagaactagaaataccatttgacccagccatcccattactgggtatatacccaaaggactataaatcatgctgctataaagacacacgcacgtgtatgtttattgcggcattattcacaatagcaaagacttggaaccaacccaaatgtccaacaatgacagattggattaagaaaatgtggcacatatacaccatggaatactatgcagccataaaaaacgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggagggggagggatagcattgggagatatacctaatgctagatgacgagttagtgggtgcagcgcaccagcatggcacatgtatacatatgtaactaacctgcacactgtgcacatgtaccctaaaacttaaagtataataataaaaaagaaaaattgcttcaaatgaacaacaaaaaaaaagaggctgtgaacaatgaatctaaaacaatattttcttttgggaaatgcccgttttggcaggaatacattttggctccgctgtgctgtgaattcggaggaaaagtagggagggccggaaagcccagggcttcatgcagagtagacatcaagaacccacctgctctggagtcttggtgggcaaggggaacgaaccttccagtccatttctaccgtcaccataattcctgtgtctgaatctgaatcaccttcttcaaaaactgggggctgaggttgcctccacatgctaacgctgattcagggcggcagcagatgctggtgttctcagttcct

SEQ ID NO: 12556 - DNA, 39293 bp, Human
tagatagtaccagctcactgaagctaagcactggttccttttacattattgctggtttacacttcttgtaggaaggagaaggtaacaaatacattgatttattgaaaggtctttattactcttaggctgccagagcaagcaagatggaatatttaccatcttggtgaagtaattatactttagagttggcacatagtaggtatttaataagtagttcctgaataccgaaagcattgcagaaggcattgcagaaggcgaagagttggttgtgtggagatttctgttaatcactgtcttcacgagaagtccattgtgagaactggcagataaaaagctaactgtattcttattttgcattaagataagcatggcatccctagagtggaatgcagttcactctgttctgcattgaccttagagtgttatatttagttttaatgacccatttcattgaagatttattaataaaatatctgttgagagcatggtgaggggtctagagatattaatttaaggactagttagatggaaggacctagcgtatttatatgaagaatagtagggcattaatatataatattcatataataggattcatgaaaacttttttgaagtacttgaagggttgatatgttgggggagtaggtgagtgctttcacataccccgaaagaataaagaataattgcagagaagtgtggtgttaatgaaataacagatttaagaggaggaagcagaaagctgctagtagtaaggcgggaagttgaaactagaatgtggccagtagtagtttgtaggataccttgaaaagtctcaagagatcattttcttggggcaggaggaggaaggagttatgcttggaaaatgttcagcgattatagataacattcaggaacatcttggccttgagaagaagagatattaatccattatttttccctttatttaatagctgttgaatgactgttgtctgctaggcactgttgtagactctgggaatatggaaaacataatcgtttacttcctaccatcaagtggaaaagacaataaaatgttataaatttttaatgtctggtagtgttaagtgctttgaagaaaaataaagcaggataagaagataatgccaggggagccattttaaattagatggttaggaaagatctctctcagttaacacttgataaggaatctgaatcatatgaggggtatcagaaagggtcaagacaaagggaaaacttgaagtatgggaatagcaggggtgagtgaagaagagaggtaggaaatgaagttaaatacttggccagggactggaggccagatgattttataggtcttgctttttgggatgagaatgcattggaaggttttgaacagaatgatactaggttttacttaacagtgttaactctggtgttctgagactagattaaaagtgggcaaaggtaaaaagcaggcagactggttaggagtcttttccagtcatttaggcaagtgatgatggtggcttgaatcaagttgatagcagtgaaggtgctgaagtggttggaccccagagttattttaaaggcagtggcaaccatattttcttggcagtttggatgtaaggtttgagagagagagatcaaccaagatttttttgtcttatacaactcgaaggaagataaagaagcctctaggagaggcaggttttaggtggaagatcaggaatttatttttagatatattaagaaaaatctaaatggtcatgtcagatgaacagttaaatatgagaaaaaataatagtagacgtaaaataaaagcttattttattatccctacagtaaaataatgttgcctccagaccattttaacataaatatggtaacatggggataatgaatcttttggaggctagagtttcttagcatctaatagtagctttgctctcaacttttacggtatgttttgttgtttaattatcaaaaccacttttatcagtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaaggtaagagtgtttttaaagctattttttaaagtctttttaaaaaaaaaaaaaaaaagacagagcctctgttgcccaggctggagtacagtggtgtgatcatagctcagtgtcacctcaaactcctgggctcaagcaatcctgcctcggcctcccaaagtgctggggattacaggcatgaactgccatgcctgaccttaaagtcttaagtattgtatgtgttattttgcccatttttattggactctttcccatcctctcttcacggtagttgagacctcactttcttgtattgaatgtgatgttcctatagttactataattctctcatcagttaaaattagctaagtggggccgggcgcagcagctcatgcctgtaatcccagcactttgggagaccgaggtaggcggatcatttgaggtcaggagttcaagatcagcctggccaacatggcgaaaccctgtctctactaaaaataccaaaaattagctgggcgtggtggtgtgcgcctgtaatcccaactactcgggaggatgaggcagagaattacttgaacccgggaggtggagcttacattgagccaagatcgtgccactgcactccagcctgggtgacacagcaagactccgtctcaaaaaaaaaaaaatagctaattggtttattagaagggaattttaagtgttagaacattttcacatacattttttttacaagcattattttctccttttgtccatataattctggtttcttttagcttaaaaaaattttttttctattcttatttcccgaaatgaaaggttttagtatgtattgaatgaaaaaggattttatggtcaactaagtaagggaaagctggtttaaacaaagacaaaagtgttcctttattgtaggagttttcagattatgtaatatgcttatatacattttcagaagttagtagtatgcagtgttcccagactcatttgttgacaaaattatctttatggaaataggttttgaatgaaaaatgtttcggcaaacacactgagtagaattatagtagtagactgtatttcctattcttcaacctgccttctttgttaatatctctgctgaaattttctctttaggtggttaccagtgttttttactgtggaacttacttgcagtgtatttaatcttgacctcactgtttagcactgctacccacaccatccttgtttttaaatacttttacctcttaacatctctgacactgcttaacctagttttcttatcactaacagttttttctctgtctgtgttagggttgggcttaaagtaatgccagcagatataatagaaatcttaaaatctgagtggtttaatagttgagaaatctttcagggatccaggttgaaagaagctgttaccttcaacacatggcttataagctcaccataggcattgacattggcaagcagatgagtgaagacagagtatgaagaatcatatgggagattttactcactaggcctgatggtgttgtatgtcatttctgcccttatgacattggtcagtacccagttacatggctttgctaagatgcaaatgggttgggaagtatagtccctggctgagcagccacttagcacaacttatactgtggaagagaagtgtaaatcactggtgatcagttaaattgaccatctagctaaaggtataattctcctttgtttttgtgatgtgtagtctaagaatacccaaaacaaatttttgagagttgcccatgttaagaaacaataaaggatagtacttttttcctgttttcttatgcttatcatacattgatttgcacctctgtgactttgaaatgtgtgtcttaatttgatcagtgaattttttttttttttgagacagggtctcactctcatccaggctacagtgcagtggcatgattatagctcatcataacctttaactcctgtccccaggcaatactgccaacccggcctcccaaaggcataagccaccatgcccagcctacaattcagatttttaacttttttttttttttagcaaagtcccaagagtacttttttttttaaattttgttttaattgacaaataataattgtacatatttatggggtacatagtaatgtttcattacatataatgggattagatcagggtaattcgcatatccatcacctcaaatatttatttctttgggttagaaacattcaatattctccttctagctatttgaaattatataatatgttattgttaactgtagtcatcctatagtgctatagaacactggaactacttctatctagttgtacttttgtgtcttttaataaatctctccctatccctcttttcccctaccctttgcagcctctactgtcatctgttctgctttttacttgtataagatcaactttttttagcttccacatatgagagagagcatgtggtatctttttaacttaatgtcttccagttccatccatgttgctgtgaatgacaggacttcattcttttttatggctgaattgtattccattgtgtatatataccatattttctttatcagttaatctgttgttagacacttaggttgattccatatcttgactattgtgaatagtgctgcagtaaaatgtgagtgcagatttctcttcaatatactggtttcctttcctttagttaaatattcagtagtggcatcgctgaattgtgtgttagttcgatttatagttttttgaggaaccttcatactgttctccctagtggctgtactgttgacattcctaccaataatgtgtaagagttcccttttctcttcattcttgccagcatttgttatttatctttttgataataaccatcctaactggggtgaaccttgttgtggtcttcattttcctgatatgtgtgcatttccctgatgatttgtgattttgagcattttttcatatatttattgaccatttctatgtctttttttgagaaatgtctgttcagatcatttgccgattttaaaatcggattgattgttttttagctgttgagatgtttgagttccttctatattctgaatattcatcctctgccagatgagtagttgtatttcctcccattctgtaagttctcttttcactcttgattgtttcctttgctgtgcagaaaagttttccagtttgagataatcatatttatttttgcttttattgactgcacttttgaggtcttattcatgaaatcttttcccgacctattaaagaggttatccttttcctaatgagtggtcttgtcaaaagtcagttggctatagataacatggattatgttcttttgttctatgtgttctattgatctatgtgtttgttctcttggtcaatgggtctgtttttatgtcagttctgttggtctgtgggtccgtttttgtgccagtccatgcttattacagctttgtagtatattttgaggtcagtaagtgtgacaccttcagctttgttctttgctcagtattgctttgactgtctggggttgtatgtagttctgtacaaattttatggtttgtttttaaatttttatgaataattttattggtagtttgatagggattgaattgaatctgtaaattgctttgagtaattttgtcattttaacaatatttgttcttatataagcatgggatgtcattacatatgtatgctctttggtttctttcatcagtgttttttttttttttgtagaggtttttcatcttcttggttaaactgcttcctagatatttaaaaaaatttttgtagctgtggttaatgggattgcattttttattttttattgtatgtgtatagaaacactacttatttttgtgtacttattttgtttctggcagctttattgaattcatttattggttctaagggttttggtagagtttttaggtttttgtttatataagattatgtcatctgcaaacagggacagtttgcttccttcccaatttggataccttttatttttttctcttgcataattgctctggctagtacttgcttaactgtcttttttttattttttatttttttgtcttgagacagggtcttgctctgtctcccaagctggagcgcagtggtgtgatcatggctcattgaagccttgaactcctgggctcaagcagtccttgcaactcagcctcccgtgtagctgggactgcaggcatgtgccactgcactcagcttcttattcttaatgtttatcaaaatgggggtctcactgtgttgcccaggctggtcctgaactcctgggctcaagcgatcctcctgccttggcctgccaaagtactgagattacaggcatgagccagtgtgcctggcctttaactgccttttttcccacttgaagatgctttgcctttatctcaaactgacctcattgactggctttctcttaactactgtttagggcaaaggtcagcaaacattttctttaatagatcagagagaataaatattgtagctttgtgggtcacataaggcctctgtctcatcttttttttacaatgtaaaaaccatttttcattcacagacctataacaacacagggattttgtccgttggtcacagttcatggacccttagcttgaggtgtcctcgttgtagtttgtcttccacatttagttacaactttgtatttcatgggttttttttttttttttttttttttgagacaaagtcttgctttgtcgtttaggctggagtacagtggtgtgatcttggctcactgcagcctccacatcccaggttcaagtgattctcctgcctcggcctcccaagtagctggaattataggcacacaccaccacactcggctgatttttgtatttttagtagagacggagtttctccatgttggccaggctggtctcgaactcctgacctcaggtgatccgcccacctcagcctcccaaactgctgggattacaggtgtgagccaccgcacttggccaaaaagtttttgattgttttgatttgtgtccgttagattctgttagtagagtggagggatggcttaggtaaagttcctgccatcagagatactctgtttctgttgtaggattcagaaaagaaaaaaagaacaggaagttttcttcttttacatacatactttattttctttaaaaaatgtgtttatgaaaattgaacattaaacaagtatgttatgggaagtgggtctggctataaggagctaaaaacagttataaaattctcagttttgtcatctttgcccaaaataaatccaactaattagtgttaaagtaggtgcagcagagcatcccagaagtagtcttgtggcctccccaggacagaactcctccccacccaactgtttgtgaagacaccctgcagaggtccctgatgaactccttgtctctggctgcttttctgttcttgctttctttagagaatgtatttttcccttagccctttgaaagcttttgagacacacagttggtatgccaattatagcattctttatccctgagatctgggggatttcacggtcataaatacacactgttttgaatatataaatatttttctggggagagttgattgttttcatcttaatatcaaaatggtcagtgacctgaaagaatttactgtctatccattcattaaagcagttttgcaacagtagtgttttactctacctatgattaagatttgaactttgggaaacttttttatttcttggtaaaagatgtaaattttttggaatgaaaagatttcagtctaaaccaacaatttatgatattgctctctatgaatctcttactagtgactaataaatattaaggcacttaatggattcactttagctgtattttttcatgtggatatgtgtaaataccttgccataagagtaataagcaaaattgatttagtatatttttgaacaaatgcatttttgctagacctttaaagtttaaggtttctatgggagagtccaactatgttctacaatctacattttggatttttaatttttactagtttactgcttatacaaatctgaaaatttaaaaaattaaaaaacaaccttttttttttttaaattccagatggagatcttataacaatttttgatagttctgacctttcctttgcaattcagtgcagtaggatactgaaactgacattatttggtgagtagtaaactttctaatgaatttactattttattcattgtattttaaagatgtttggcttttttccttttaaagactcaggtaagcaataacttattcaaatattattacatttatttgtgttcaggtagttgttttagattacttgaagcttatggctgtgtatgtttttaagaaaatgatagaagtttaattcagtaagaacagagtgttaagtatgttttttttgaaatcaggtataacttaggtatccctggtgcagtattatagttttaatttagctgtattagaatttttaaattgtaattatcttccttcacattacagtatgttgttacttattatcagggcttaacatgtaagtctgatacttgaaaccagtagtcgccaacctttttgcactggaaactggtttcgtgtaagacagttcttctatggaagggggcaggagaaggtttggggatgaaactcttccactttgcatgtgcaattcacaatagggttcacactcctatgtgaatctaatgccactgctgaactgacaggaggcggagcccaccacttaacctcctgctgtgctgcccagcccggtttggttcctaacaggccacagagtagcactgggttggggacccttgctttagacagtatttcccgaggggtacttaaagattaaaaatagttctgataaaaaccaatagaagactaattttaatcttttagattttttcttttagatcttaatagatatgcaaggcagaactcttaagggacaagatagaaaagattacagagttaaatggtagtgtgattatgtgaaaaataaaatgtgtacactttttccggctgttttgttgttttgtttagcattaattttatttttttttaattttgttgcatgaaacttagagttcagtgtgaaatatgatcatggtctattgatttaatttgtatctatttcatctccatctaggaaggatgaatatgaataatcagaatttaaatgttaataacaaaaactgtttaaaattatttaaaataaaggtatctttttacagtattgaatgtaaaatacttaactattgactaggcataaagcagattagataatctgaagacccttactttaaacaggatctgctagataaacttacaaatgtgttttctgaattctgtaactcagcttgcacaggaaagtaagggaaatatccagggaacaaaaaagtagagggaactaaaggcctgatgtaccaaaagctgaaacttggggtgttcttggtggtgatagtagagattttagcctgcataatttaaggaattgccatctggtgtctacatggtgtaggcccttggtcctagtccctcagtaggccatgctttcaaaaagaatattttagaaaagtctaccttgatacagggaaagtcaaggaagcttaactcttataccttgggccgtcaggggcttgggaagtctcccttcaggattcataattgtggtccttaggtgagttgggtttaaatttaaactatccatgtagtttggtaactcccaagcccagatgttaccattttagaaaaatctcagaagaaaggccaaaatctctcttgaggggtatattctcaatccaggtcacataggtttctcacagacaaaaccgtaagacacatgaagctgtcaggtaagcaagaaccactggacacaactaatagcaggattagattttcaacaacttcagttaagatatgtgatagtctacaaaattaaaagttatttaagacatagaagaaggaataagaatataaaagcagccggccgtggtggctcacgcctgtaattccagcactttgggaggccaaggcgggcggattgcctgagtgcaggagttcgcgaccagcctgagcaacacggtaaaaccctatctctactgaaatgcaaaaaattagccagctgtagtggtgtgtgcctgtagtcccagctacttgagaggctgaggcaggagaattgcttgaacctgggaggtggaggttgcagtgagtcgagatcgcgccactgcactccagcctgggtgacagagtgagactccatctcagaaaaaacaaaacaaaacgagaacataagagcaagatgctattgtattatggaaaaacaataaacagattttataaagaacttaaagtaacttggaaatgagaaatataatcattgaaattaaatactaagtggataggttaaacacattagtcatagctaaaaagagaattagtgaactgaaaaggaaatccaaagaaattacagagtaaagcacaaaaacacaggcaaaagagaagttgaaaatgagaacatccagaatatttctattcagagtttcaagaaggagagaatgggagagtggaaatacattgaggtaatgactaaagaaattttcagagttatataaaagctatagaccctcagattcagaaggcacggggagccttgagcagggataagtaaaagtaaatccccactggacatattgtcatgaaactggaaaatgtcttaagacagagagattaccttaaaagtagccagagagaataagactgatcacatatgaaacaattagactgttagtagacttcttcatagtaataatagaggctaaaagacagtattatcacagttgcaaacagtaaagaaaaataactagaaaagtagcatcctatactccactaaatttcacgaatgaggagaagtaaaaatactttgaaagactgagaatttaccactcatggacccttgttaaaataatttttaacagtggtcttcatcaagaaggaaatttagtccagaaggtggtgaaagatgcaagaagcaatgtgagcagataaactgttgcttggtcagtaggctatgctttcaaaaactattttagaaaagcttttccattgatacagaaaaagtcaaggaagcttaactcttaaaccttgggctgtcaggggattgggaagcaccaatgaaatttatgtgtacgttttaatgagcattgattgttacaaaattaatagtcttagggaataaaaacaatttgggacaaaaatactgggcaataatatgtaagaaaggaagggatgataggaataaaaatattttaaggacttatttgggaggaacattgtaattacctttagatttttttaattgcatactacatatgcagaagtatgcatggtgtacatgtaagagttataattgaaaaattagacattgtcaggaaaggagaaaaaaagaaaacaagggtacctgttcagttcagtagaaagtggtggcggaataaaagaggtagaaagctcaatagatagaacagaatactaatcacagtacacagaaattgactacatatatcggttaaaataatctcttaatggaattttaaaaaaaatccagttccatgctacttccaagagacataaaagattattatgcaaagcttgaaagtagagggctaggaaaagagactagacaaatgcaaagaaagctggttattaacagaatagacttatataaaaacttgagtagtaatagtcactttatgatgataaaaagaataattcactaggactatatagcaatctgaacacttatgcatgttagctttagatgttttcccctaagaaaaattgacagaacaaagagaaatcaataaatttacaattatgggagagccgataaatcaagcaggctcaaacagcgttggtcttgtacatctagcagttagggagaaatacagtttttttttttttcgagtactcatagtgcattatagaagttgactgtaagtcaagtcttccagaaaatcccaaaatgtaacagataattagatatcttaaaggtcatattctctggcttctttagagactattggacagaatatgtaacccaaatttccctacttttggagacaaaatatggttttaaataagtcaaagaagaaataataatgggaattataaataagtagataatgacttctgtgtaaccaagtttttagagaatgctaaagctgtacttagagtagtacttacagccttaaatactttatattagtaaactggattggaaatttttgagcaaggtattcaaacagttacaaaaggacaaacctcaaataacttggaaggaaataataagagcagacgtgaactagaaattggaattgttaggatcaacaattttgaaaagatgcagttggcaaatctttatgaggattagttaaggagaaacaaggcacaaataagcaatgttagaaatgaagtttatagtagaaactttaaaaatttatatataccatgaattcctttatttaaatttgaaaactcaggtgacatggacagtatcctaggtaaatttaatgtactgtttcaagaagtagaaaaattggttgccccaattaacattaaagaaattgggccaactattttaccaaatatctaaggaacagatgattctaaattatacaaactattcaagagcataggcaaagagggaatatacactaattcattttgtggggttaatataacattaacatgaaaaccagccaaggaaaatgcaaaccagtgtcacgtatgaacatagatagaaaatattaagtaatatttacaaatcaaactcatcagtgaatatttaaacacaccagtgtcaaaattgctcacccaaggagtctaagattgctttaaattagaaaatcacatactattttccataaaacagattaaaggagaaaaactagatcatctctagataaagaaaagccattcatatctcaatcatgttgaaaagtcgtagcaaactatgaataaaagggaattcttttttgtgaggcagagtctctcactgttgcccaggctggagggcagtggtgcgatctcagctcactgcaagctccgcctccggggctcaccccattctcccatctcagcttcccgagtagctgggactacaggcacctgccaccacgcccggctaatttgtttttgtatttttagtagagacggggtttcaccgtgttagccaggatggtctcgatctcctgaccttgtgatctgcctgcctcggcctcccaaagtgcagggattacagatatgagccaccacgcctggccaaaagggaattcttttacctcatatgggggcatttattacgtagaacaactgctgtatgcctaatataaaaggattataaatgtaactaaaatacctattataattatatacaacaaaagatacttgggataaatctaacatggcaagattgttttggatgaaacataaaattttttaaaatcaagtaggggaatgggttttgaggaaaggtactctgggagatttaattatgtctatgctgtttcatttcttagtggttaggagcaaagatgaaaaaaatactaagatttggccaggtgcggtggctcacacctgtaatcccagcactttgggaggccgaagtgggcagatcacgaggtcaggagttcgagaccagcctggccaacatggcgaaactccgtctctaccaaaaatacaaaaaaaaaaaaaaaaaaaaaattagctgggtgtagtggtgcgtgcctgtaatcccagccacttgggaggctgagacatgagaattgctgaacctgggaggcagaggttgcagtgagccaagatcaggccactgcattacagtctgggtgacagagcaagactctgtctcaaaaaaaatataaatacatattaagctttaacaaagatgggtgtttagtaagtttatcttgttgtgtgcttgaaatggttcattaaagtcttatgattatattcacactaatgaagatacattattatgtgtgctagggttctccagagggatggaaccaataagatacatgggagttttttagggagaattgcaaggtgattacaaggcgaagtccggtgataggccatctgcaagctggggaaagagagaagctgatgctgatagtggctcagtggctcagtccaagtccaaaagcctgaaaaccagggaagctgatagtgcagcctttgtctgttgccaaaggcctgagagtcccctgggaagctgctggtacaagccctggagtccaaaggccaaaaaacctggagtctgatgtccaagggcaggaggagtggaagcaagcatctggcataggagggagagcgagctaaagacccagcaagcaaacttatcctaccttcttctgcctgttttgtgatagctgcactggcagctgattgggtggtgcccaccaacactgaagatgggtcttcctcttctggttcactgactcaaatgtcagtgtcctctggcaacacctcacagacacacccagaaacagtactttaccagccatctaggcattcctcactctaatcaagctgacacctaatattaacttaattaatttaaacttagctaatttaaacttttaattgagtataatttggagcttagtgctcttaaacccactgagtagataataacagattataggccatactaggaatgtaaatgcaaggttcttaaaagttctggtaagatgtatcagtgtgctccaaagaccaccaggaacacacctgtagttgaatgaagttgggtttactgacttactgcagcaagggagaatgaataccacggagaacaataggatgtcttacaagtatgttagaaaagtatttttttttgggcttgggtttgtgttacctgattttggataaggttcaaggaagtagagctttgctctgcattggatgctctcaggaagtagagatgattctatgtttgggtatcttatcaaatcttatctagaaggtgagaggaatgaatcttactaaatcttatctggaaggtgagaggaatgaattgaggctaaagctgcagttggtaaagtagtagcagttactcatattagccaggataaaaggttgtttggtcatttttctggtgtggtcagtgttcttgtttttgtctggagttttgacatggttatggactgttgatctatcacagattatagtcttgtgtgatgttggtgttctttgaaatatttatattcaacgggagaacaccacagcctacctgtgagtgccaggccagcttccagcaacactaaggcctgtcttactgtaccagaccagtttctggctgctaggagctgtttttctcatcaaatattggagaaaaaacagtaataccaagtgaaaaccaataattgatgtaggtaggagattgtattgaacttcatagctatgcagggagtatgtgaattactgtgagttttcttctaaaagcttataattggtggtttgattttgaaacatgtttaacaaagaatcgccctgaacttttattttcacgtagatgtccttttctaattaggtgcttcaggagtttgtatgtatgtatactggcaatgtgcaaagcattttagtttaatttttgaacgcctgtcttggggtttgcaatcagagccttgtgtcactttctttttaaaaataacctgagtggtgacagtgtttgttgctgaatgaaggatttcatttttttcagtcaactgaaaatcatttggacaaaatgaataataagtgaagtaatgttgctttcattaaaaaatcacaactagagattaccgagtaatctctggcattttgtggcttatatactgtttctggaagtaactgctttgaaggacagtcatgatgtagataagttctgcatatatttttaaatttatatttattttttaaaattttttgagacaaggtctccctctgtcatccaggctggagtgcagtggagtgatctcagccaactggacttcccctcccgggatcaagcaatcctcccaccccagcctcctgagtagctgggactgcaggcatgtgctgccacacttggctaattttttaaggtttttgtagagatgaagtctcactgtattgctcaggtttttcttgaactcctgggctcaagcagttctccctccttggcttcccaaagtggtgggattacaggtgtgagccaccatgcctggccctgcatatatttttttaacgatttcttttaagatcagctattttagttagctgttttttttcaagacaaagttatgcaagagggataacagacctatcagtcatgttatatctttaaacatgtatagagtaaggtatttttgtattattttaagaatagcgtgaaataaaatgagctttttaagttatataatttttattaaatttaataatttctattaaatttaataaatatttaagaacagcatgaaataaagtgagcttttgaagttatgatttttattaaatttaatcatttctattaaaaagtagagctcggattttcctaccaaacctttttaccagtaaggtcataggctataggtatggcatcaagaaagactgataattctgctttttttccaaaataagttattagccatagagaattcttttttttaaaaaaaaaagttactccattacattgatatcttgtttttgtttttttaaaggaattgtatttatttttccttgttgcatattattagtatacttattcatgaacttctaattttaagcaaataaatgtttttatttcagttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatggtaaaccctgaatccattgtattctgacttattgttcttacgtctttttggaggttttaaaaaactctttttaagtaggagaaggatggcatccccaatgtcactcttgtttcttcctctgcctctctactagtatttatgtctgtgttcctaaactttgctgttcatcagaattactaggaggtttcattataccaatttctggatctcatcatagacctactggagcgtagcacctggaaatcccatttttaaagtgttttttgggtgattctttcgcaactagtcttagacttttggatttgttacacaggtcagttttcaaatccttttgacacatgaaccctttttagtataatagataagtaatgaaccttgggaattgaaaatcatttcatgaataattacatagtgttggaagtattttcaactaaaaatcacttagattagtaatgttcattaaaaatggtatgttgtaaagttgaaacacagtttttaataataattaaagaaaaactaattttttccccattgtataatgacatgtactgtttgtgttaagataaagcaaaatgtgtcaacatttggaactgacataattttgggaccgaatgtattttaaaatgtggactgaactttaagtatgtgttaatgacttgaaagtacagttaaaaaactgctttcttcttttaagattcttagatgttgcatttaaagaaaactcttattattatttttttctttttacaaattctttgtttgcttataattttcatagtttaaaactgtccatattgtgaaatagtaatttaaaaaaagtctagactggatgactgcatataaagggcttaacatgagataatttttgtggataaatggtatgtattctatttttggccactaaatattttggaagtttttgttttctatttttattttagttacagtttaaataaagatgtattttccatcatttctctcttcctgtcttctaatagtcatatggaattatgttaatgatagatgtttaataaatatttggtgattgattattcctagttgcacttctatttcagaacataatggagatttgctgaatactataatgagatcctcttggtcactttatgatgaaaccttttatatttcaggtcaaagaaggttgcctattctgagccctacctctccaaacaaaaatttccaattttagatcaagaatcaatgaaaaagttagacaatttttccagaagaattcatagatgctgacacaacatttgcatataatttcaggggatttaaccatctgcagaatattaagaagtgtagatgagaatttaaccagtatagccaatactgttcagaaattagctacagtggcccacattctactctaaggaatggatttatgagttttttgctttaggtgaaactttttcctcacctctttcttgctactgtttatactttattctttgtgtctatattttttatacatactgttagctttttacctatgttaatgtaaaaggtgttaaaattggtttcttctctgcattttggaaatcatgccatatgttgttttcttgtatggccattttctagttattgtgtcctgtctgacatatctgatgataagatgatataagaataatacaatctgcattatatttttagagatagttcttatttttttagaaaacaaaaacaacaagaaaaccatacatcagaaactgaaatctagtccacaaaatgaaattgccaatcagctatcagtgctatttagaacctgtggcttaccctcaccaagaaatgtggccacctgtggtcttcagctctctattacagcggttcttggatgcttgttttcctttaagaggcaaatgatgtgtaaactaccttagatagaagattgacctgttgcagtatctccagcagctaatggagcaagtagtaggacgtatagtatgtttcctgatggttttagtttgtgataagtgaaaagaggcataggtagtgagatgtgaggggaaacaacttgtaagactgacgtggtatgctcttgggattagaggaaggaagttggtagggaagatagataactggtagacatgttttaaaggaatacttctagtagtagttttctttttccaaacatttagaaaatattagggtagcctggaatggtatgttaggaatgaatgagctgccagccagtgtgtgctgtgggtacttatattcggtttagcacttaacatttttttcagaagatacattttgtattgattacaggggtgatctaagaactgatgttcatttacttgcttggtaacaaaagtgataatcattgtcccttaattgagtaaatggttagcaacagtctttttgtttacttgttcgtgttttttgtttgtttcttttgatgtcttttgtatcttggacttggattcctatttgtaaaatgtatgttaaaattcttgaactctttttctttcacaagacagtagtataaatgcctgtggaatatcttagtatcctgagaagaaaagcatgattttaaatttaacctgctcataatatttgacattttgtttttctgttgttgttttaaacattttattatagaaaagtttaagtatataagaaagtagacattataatgaatcccagaaacccacatccagtttcaacagttaccaacttatagtatcatataattacactatacacatttccgcccctcctgttacccagagtggagtacaatctcagctcactacaaactttgcctcctgggttcaagtgattctcgtgactcagcctcctgagtagctgggattacaggcatgcatcactgtgcctagctaatttttgtatttttggtagagattgggttttgccaggctggtctcgagctcctgacctcaagtgatctacccacctcggcctctcaaagtgctggaattacaggcatgagctgttgcacccggctcccctcctgtattattttgatgcagatcccatatacatcatttcatctgtaagcattttaataagtattttaataagtaatacatattaaaatagaaggtagcaaattcaaaaatgtttttaatgtgctatttatggaagattatgaattaattatggttggcttgatttccatgtaatttaatagtggaccagtagacagtagaaataaaatgtaaaatttgagattataaccttagttcagtttctttttataaaataaagccttagttcctataattattatttccagagtgcccagtgggtatctgatactaggatataggttattgggctccaaaaaaaccaaaaaaagtaaaatgtttctctttatcaaggagcttgtatttttttcatctaatgtttcttacaaaaggaggtaaataatttttttggaaagcttttgttcatcttctgtttctttttgccctcttctccctgttactagaaggaaaaatataaaaaaaataaaggaattaaaatgatctgtaatcctatattccgacatgcttaacattccagactatcattatacacctgcattatttcccttgtacttttaggccttactgaatatagataaaaaggaaacaagtttttgtttattcctctatttttacagatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcaggtaagttggtttccaactcctttacacccttcgtttccttcatctttccgttcttccctttccttctttctttaattgaagaataacttggatatggtgaagtgcacaaatcttaagggttctgcttaacaaatttttacatatgtgtacacttatgtaaaagactaactagattaagatgtagatgatttccagcacttcagaaagctttcttatgtcctctccccaagagtagcaccctcccccttaaagaataagcactgttgggttcaagtaaatttttgaaagtaaaatttagaaagtttttaaaaatctgaactattttataatttgattagttgcagtattcgaattatatttgatttgtcttatctcctcatcttagagaaattgaaaattaaatgtagattttcttgttaaattgcttgagtatacagtgggtttttatataaataagtttttaaccttaaagcagtacctatattgttttattctgtttaacttttggttataatttcttcattattttttcctgctttttctcttttcggattctaataacacatacattggagagcttgatactgtctcatgggtcattaaggttcatttttcttcagtcttctctctgttcttcaggttgggtgatttctgttgaactcttcaaggtcgctgtgatttctaatatgctgtggaacctttctagtgaattgtttaattgtgctttcagctctagaatttccattgggtttttatagtttctgtttttctgttgagattctttattttacattcattaagtctatattttcctttaattgtttgaatgtatttatgtttgattctttaaaaatatttagctgctttaaaatgtttatctgcaatatgtaacacttggacccatttggagtcagtttctattgactgggttcctctcccccacacacactccccccaactccagtagggtcacatttttctgtttctttgcctgtctgatagtgtttggttgaaaactagacattctggttaatatgttgtagtgacttggacttatattcttttgaggattttctgttattgttgatctagcagggagttgatttgtatggacttaacataaataacaaacagaaaagcgctctctaaaagaaaaaggtatttgggaatagagcattgcattgaaaatatgcatgccatagtaaactatgtgcatattcagtgaggtaaaggcagacaaaggtttttaaaggaaaaaatgaggagaatatataattgttttgaaataattattgttggctacaaagatcattagcaagagtgatgccagtctgaggttggacaggcagtttctgggcagatgtcctcacagtcacagaagtttttttttttgcttttttttttgcaaagttgtgatggcctttgtgtaggcttgtggtttttgaactcttttgtgatagtttttgcaagaatcctctcttcatggccttatcagagtttttaatttttttttaacattaatgacttcattttggttttgataactttcacatactcaaaactgctccttctttctccctatggtgtatagcagctgatatgtatgctcagtcctttcagcttgctctaggtgctgcatttttctctgagccttcttgagatatcctcgtctgctctcccagccctatagtcagctggggatttggacagagtgtatatacctagatcgtgggtcttaccctttcagtagcaccttcacttccgggattttcctcctaaatcttcagctgcttgtctagccataaggttgttaacactgtggttttctgccattggagctgcagaggtcagcgcttttaattcttatccattctaattttattggggtaaactcctctggtttctgattgactttcagttatttcaaatagtttcttttgttttgttcatgtttttagttgttacctgggagagagtttatctgatggatttactttgcctttatcagtagttggaaatgtgtacagtccattttgtatttcttagagactttcatggaattactcacaaaagagaattgtgtgaaaatttgatgaggtcagacttttaaattttgatttaaatgtagtatattccagactagaataatattaatatgattcacattatttgaagaccatttttctcacagctttgtatgttgaattatagtaggaaaaactgtatgcatagctaggatacttttgtagttcttcaggtgtgatgtggtaaaaatgtggcttattagaataatgaatgtggcagtgggaaggagggataaaatattacaaacatggaatgaacattaactgtaataaattacatataagggaggaaagaggagccaaagtaataaatatatatatttaggctaataacagtgtcttttgtgggaagaatgtgtgtatttatctacatagatataaatttaagtaaaatggtggtagatagaaaccatcatccattttattttggcaatcatcagtctctcttgcattaccactattatatcctagtttaggttcttattaatacttggactgtcagctgtcaactgtgcctaatactgtggtaagttctggggatacatcagagcagaagatagaggtttgcccttagagaaattagtctgctgataatagcaagtacttatatggaactttctgagtagtagtcacttttataagcttttgctgtataattccttttataagcccatgctataagctcttgtaaactcataatcctcacaataaccttatcaagtaggaattagtatatcctttgtacagatgaggaaactgaggcacagaaagagattatgtaacatgtccagagttacacagctagtgagtgacagcactaggatttgaacctgggtagtctagctccaaaacctatgcttttaaccactcttctgcattgccaaagcagaaagaatttaaaggaataagacatatttacattgtcctcagaatatcttttttgactgtcacagcattggaactgtaatatattctctccattcatttctgtgttcattattttgtaagaattatagtggctccatatgtaagttagagtgctaggccttgttcggcagacaaaaagaatcaacagtcaggagcccggccaaaagagtgcagagtctttaagagggaaagtgagagctattcagaaatgcaaagtagaagtcagtatgagttaacaaaagtaaactagatagaagttcactagtagaaaaagtattcatgagtcaagaaggcttactagaagtgtggaattataattggattttaaataatgttatatttaaatatgtgaatgttatatttaaatatatgggatctagtgggagagaaatagaggtcaaaaaaatattagctatgttatgggagtagggagaaggttagtttagctgaaagggaggcatgtgagaagagaaattgtgagaaataatgtttggacccttaatgccaaactaggaggttgaacttaatttatggtcagtgaagaccccttgaagaatgaagtgacaattttggttcctgtgcagaatacattgcttggagtagggggatattggcattgcagacatgagttttgatttttgcagggagaggttaagactcaggaatatagtactctacactttataaggaaggagttccagttgtagctttggattaagagattggagcaaaggaaaaaataaagtacatacatttaatgtaaaaaggcgtatttgtggttatatacttattctatagtacttttagtatcttttaaccaaacttattccttgagcttgctgggggaaggccttgtgttggatactaaactgacttttttttgactatccagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtaaaatagagtttagaacacatgtttgggaaagtacatgtgtagaagtgtttattacagcattgttgtaaacacttcatgtatttagtcatgccttaaacacaggaaaaattttgatttactgacatgatttgatgttaaaaaaccaaatagaacaatatgtcaggtatgtttccaattattggaatgaaaaaaatacctcaaaaaagtgtttctatgaatatagatacagagtgaaagaccagtcattagtcagtggtgacccttggaggggaggatagtgaagttcagactggtgatttcacactttattttgtgttatagatgctattttatctccctcctttcttcaacatctgtgcatgatttttctaatttaaaaaagatttctgaatagaggtaaaggataactttagttgtagtgggttttttttgttaagattagtagccttttataattttgtaaatttagcaatatgtctttaatggaaaaaaagcagtgtattttaagtcagactttttcttctgaaataatctgtccttggatatgcagtttagtctctctgggttttgatattctttcactgtaaaatgtgaaaactggactgaacccagtggtttcaaaagaatgtctttagttctgaatgaaatataacctgaaagctccatatttaaaataggggattgaagggcaacagacttcacacagcaggcactaaggtgcctcattgaaaaccttggagttctgcagaatgtgactaagtacttaactaatctctagggtgccttccagataatgaagtgtgatttttgtattgtctatgtgtgttgggacctttaaagccgcattccacttcaaaacaaacaccaggtggtgctctaactatttgtttaacgggtcagatagtggtataatgtatttccagccccagaagcaagtgattaaggttatcaattacattaaaacaaaaacaaaacataggctaaaatgaactgaccacttttggaatagaatcctatcatcctgtggtgatactttcagagttacctggctaggtgtggtgcctcacgcctataatcccagcactttgggaggccgagccaggaggatcacttgagcccaggagtttgagactaggctgggtgacatagtgagaccctgtccctacaaaataaaaaaagatttaaaaaaattagccaggtgctatggcatgtgcctatagttccagctacttgggaagctgaagtgggaggattgtttgcattgttgaattgaagtgggtggtctaggctgcagtgagctgtatcactccactgcactccagcctgggcaacagaacgagaccctgtctcaaaaacaaacaaagccaaaaaaaaaaaatccacagagttgtctgttggatgaacaccagtcattatggactagcaggtgacattttgctgatgaatcagtggtttgcgaagaatttcttattgcttaagccttttctcaaccaactttaattaactcctcctctgcaccaaaatgctactgccaaaactagaacaaactagaactaaagcagatgtcagctgaaatggacaaaagcagagtataggtatgatgagagtttaatgcctacatcaagcgaactaaagatttgtttttaaataaatcccattttaagcagtgtatactgtgatacaatgacagttggaaggatcattgtaccaaataatgtttgctgtttatgtataaataaatgggaattaaggcgctactagcaatatctaaacattctatgaagtgtttaattgagcattttcaaataagtaaaattttaaaaatgcgaaaggacatacagtgaaaattctctctcccacctctgtccacagcaaccaaattccttttttcagaggtagcagattaacactgtttatatgcatttaatttttagagtagtattgtatgccttgctgcaattaactgttagcttacattaaaacatacagtatgaaaattgtacaattaatatgtgacatcatttaaactattaataactgatctaattctagatcagtgctgtccaaaagaattacgatagaagccacatgtagtttttctatttagcagcattagaaaaatgtttaagaaaaggtaaaattaattttatttagcctaatgtatccaacgtgtactcactattaaaaagttaatttttttggtactgtgtattggaagtctgggatttgacactgatttggaacacttcaaacaacaaacaacatatcacatttcaaacaagccacatttcaggtgctcaatagccacatgtagctagtgattattttaagagcacagctttagataaatatagtcgttatttatagattcccagcatgaattataggctacttttactttttgttgtataatgagtctttgacattgtcagttatttagatcaactactggttataatttgagcagaattaccaacataaaatgtattacttataatttgttaacatagcaatctcttacaatgtgttaatagtccatactaaaattaagaattctgagttgttacttaactcccataaaagggactttggaactgtgaattttattccaaataaatgtagtcttaatatgtttttcagttaaaaggatcaacaagatattgagcatcattaaaaaaaaaccaaaagggataatgttactctttttcatataaagccagtgcctgttacaggaagactatgtgatgttgccagaaatgtaactggtaaggagaagaacgctaaaaatcatcagagatcgggagatattgctgtttgacagcctaaaaaaatgaaaaagcatataattaaaatctttaaaatcatatgccaatataatgaaaagctgagtagcctttattatgtaaatattgaaacatacatagaataatcaactcttcatgtagtcatgtggcttcaacacttaccaatattttggcattcttttttcatcattttttccccactgcaccccttttaatttgctggagtagtttaaatcaaattatgaacagcttattatactcaggtatttcagtatatatgtccaactgataatcttctttttaatataaccaccatgctgttacttaacagtgattctttttatttttaattgtgacagggtgtcactctgttgcccaggttggagtgtactggcttgattacagctcacctgcaacctcaacagtgattcttaatgtcaacgtgtgctagtctgtgtttgaatttccctaattgtttcaagattcgtttgttaaattgacttgttcaaatgaggggcctaacaaggttcacactttgcattgttaatgtgtcttgagtcgttttttctaatagccattagaaaaaacttacatgtttctaaaatcccttacatgtttctaaaatcaaaactatgtgtattatttattactgtgtaactattatcccaaaacatagatacttagacaacaaaagttaattatctcatacagttttagacagatatcccggaatggtttagctgggtgattttggctcagcatctctcatgaggttgcagttaaaaatggctgctggggttatagtcatctgaagcttaaccagagctggaggattcagttctttaccatttggacttctccatggggctgcttgggtgacctcatgacatgacagcttcaccagaatgagtaatcagaagagagtgaggtagaagataaccttttatagcctgtcctcagaaatgtcactgtcatttctgcaatattttcttggtatacaggtcagccctattcagtatgtgagggactaacagggagcagatactcatgtgcttgttgcttatttggtcatttttgtattgtggagttaaatctttctaatttctaagaatataaacgataccaacccattgtcataaatgctatacatgtgcagaagccgttgagggtcatgatagaggttggctactctgtgtaataaataattcccagaagtcttaccattactctttgcttcatcctgttctcttttccccttaattttttttattactttttactttattctgtcattgattctttttgaaaatatacataaaacatagcttatatatagtcatgcactgtataacatttcagtcaacagtggactgcatatatgatggtggtctcataagattataatggaggtgaaaaatttctattgcctagtgatgtgtagccatcataatgtagcacaaggcattacttacgtgtttgtggtgattctggtgtaaacagacttactgccagtcatataaaagtgtagctcacataattatgggtagtacctaatacttgataatgatgataggtgactctcttactcatttgtgaatttactatactatatttttaaatcattagagtgtactcctacttatttaaaaaaaaacaaagctgtagaaccaggctcagataggtccttcagaaggtattccggaagaaggcattgttatcataggagatgagagctccatggatgttcttgaccctgaagaccttccagtgggacaggatatggaggtggaaaatagtgatatcaatgatcctgatgctgtataggcctaggctaatgtgtatgtttgtgtcataatttttttctaaatgtttaaaaaagtaaaaatttaaaattaaaagaatagaaaaatgcttatagaataaggatataaagaataaatatttttgtatagtagcacaatgtactttaagctaaagtattaaaaaagttaaaaaatcaagtttataaagtaaaaacattacagtaagctaaggttaatttattgaagaaatggaattttaaaaaataaatgtagtatagcctaagtgtatagcgtttgtaaacctttagtagtgcacagtaatgtccttggccttcacattcactcaacacaagtacctcacttggagcagcttttaatcctacaagctccagtcatggtaagtgccctaggcaggcataccattttttatcttttttgccatattttcactgtaccttttttatgttttgatatgtttagatacacaaataattaccatgtgttagaattgcctaagtattcagtacaggaacatgctctacaggtttgtagactgctatgtaccatatagcctagctatgtagtaggctatatacatctaggtttgtgtaagtatactatatgattatacagtgacacaattttcagaacctactcttgtcattaagcaatgcatgaccatattttttattactcaaaacattgcttactataaacaatgtctgcattttgctctcttcatatatcctatagatctctcaagtatgtgaagaagttcatcctttttctttttttaaacaattaaacagacttcttaattaattttcagaatactgtgacagtcccatttggacttgaatgaggtgggtttaaagtaagtaccgtaaatcctcacttaacattgttgataggttcttggaaattgtaactttaagtgagatgacgtatgaggaaatcagttctaccataggctaattgatatgagtaagttgagttcctacagcatatctctgatcacaaaaatacccccagacttctagataaagactaaaaacaaatgtgagttatagatacatttaagaaagattaataaaaacaaataagataatgatttatgcagttattccaattcagggttgtgggtggctgaaatctatcccatcagctcagtagcaaagtggggaccaaccctgacaggttgctattccattgcagggtgcattgcaaccacacacacacccatagtcgttcagactgagatcatttagacatgctaagtaacctaacatacacatctttgggatgtgggaggaaattgaagtgcccagagaaaacccacacagacttggggagaatgtgcagactctacacagaacagtaaccccaactgggaataatttttttttccttctcagtgttttaacgaaacaatgtcgaacaaaagatgttatttgaggatctgctgtgtaaaaggaatcttgtgtagagatataataaacctctgaaatttttaactctagggatgtttttcaaaatcaatttatagcagtttatgaaaacatgcaaaaaaaaaaagctttatgaagagttgtaccctataaatttttattgaggggaataactgtggttttgaccaggagttccttactcattgatgaccacagtctactactacgtggaaccttaatctcagccttttttgatgatgcccaagttaatatttatattgttttgttcatgggataatatatgcaaaatgactttataaactaaagctttggagttatgcctgagttccagtgatggttcttagctcttcatggttctgttcttagctattgactgcaggtaagttgcttaatttttctgtatctgagataaggaatactaatatggttgaatttttttaaatgtgtttattgcctgtttgcttatttttttattgtggagttaagccttctaattttcaagaattaagagttcattgttatgtgctatacgtatttattccccttgattatatttctgtacctacttacctttttattttagattctggtcacttctattccgaaagttagttatgaagtacaatccaggattaaggtggcatctaaatttggttaatttctgtgctaccttttatgctattagtctaaatcattaagaaagcatttaagaaacttttgtaagcgtttctttttttttcttgtcatatttgggaataggataaatagcttaaaatagttgagctgatttttatttgtattctttttttattataaagaaacatttgctaggaaataagctggatataaacatagttgtatctcctttagtgctacccagcactaaacacttagacacgtatagggctgagcagctggtataatagagtgggctccgtctcattttctaagcctgtgagtcctagctgcctactgcagctcgatttgagtgggagttgatataatgtctttttttttttctcacttcagcagtaagtatctggtttgctcatagtcttttgattaataggtagtttgaatatttttcaaagaatcagccaacatgtgattattttaaagatttaaataccagatagatattaaaatgcaaggttattgctactagatattacatctagctaaatcaaccattgtgaaataattgagaagtagagataataaagacataaaccaataaatctttgcttgaaaatcacaggtatgggaacagattgtgaggacagaaaaataaaaagtaaaaagaaaaatcataggtaataagtgtctaaagggtttcttcataggaacagtggttgttgaccccaaataggacaaataggactcccatgttcaagaacacatcaccgttgttaaaaaggtctgccattattaaatagtgcaatgaagaaccatttagactttattagagtccacgttattggcaaaagatgttggatattcatagaaaatcaaacttgacaaattccaaaagtgtctttcagctctggaacaaaagatgtcatatagttccttgctaccaaagagtttgttcatatggtaatagaggcccatacctttagagggcaaatacagtgctttaggaaggacttagatgatataaatggtatttgtcccttttctcatttttatttactgattttcaactcacttggcttttaatgaacattagcgttacttatctgttggcagctgggttggaaaacatttgtttttctagactttatgaaatggtagccactggtgttgcacttaatgtttattgccagttagttctctgcagttaatccacagcagaggaatcacacttctaaaatggttcattctcttcttcatagacatttaaagttgaacaaatactttcttgtatattgttactctgtttggatggagagggaatgtatatgtatcttaaaaatatttctctttgccacattaaacatgccttttttccttgtgtgtgtgtgtgtgtgttttcaggtcagatgtaccaacagtaccagcaacaggccggctatggtgcacagcagccgcaggctccacctcagcagcctcaacagtatggtattcagtattcaggtgagcaggtgttgaaagggagttggctcatggttttttgtttctatactcattaaactttaagttcttaattccttgatttgtagtacattgatataataggtattaagtttttattaggggaaacaacatttgttttatttatttttaaatattttacattaatattgtaaatcaacatttcagttttctggtggggagataaaacttacagtagatgattctgcagtaacttgtagtataaaaagtttttaatacaaagctgtcttactaacattatcagtttatctcttaggcgacttagtgcaagttttcccccttccctccacctctccatttatatgtaacacgtaattccagtgtactcttagtacctgtagaaatatgaacagtttactatacatggaaaggtgatgttatttaaataagagctcaattaagctacttagattttaaaatctcttgcaagtatgtaggaataccagaaataggccataaaaataaaatcgtataaaatgtaattcaggcaactaagaacattgtttagttgttttaaataagcatcctgagtattttgtttctattttaccatctgtccactgaagattatatgtatttaagtatgataaatattattaatgtaactttggctataattccagtattttttacagttatgtcagagagtttgtgtccaactcttgttttacagccaaagattgaagtatcagaatttcaactgtaattagaaataatttatgcaggttgaatctagtctaaattctattttatagagttttgtggtatcagctagagcaggagtcagtaaagtatagcccacaggccaaatctggactattgcctgtttttttgaataaagttttattggaacacacttctacttttatattctctactgctacttgggcactagaatggcagagttgagtagttgcaacagaagaccatgtggcccacaaagcctaaactatttactatctggctctttacagaaaagtttgctgactcctgacctagaccataacattctgtcattaattaaaatttgaaatattttgacacaattttatttagattgtatttgctgtagagtgacttaacttgtagctacttgtttttaattgtataaaatacatagaacttaagtttggattatatcaggaggaaggttatttttaggatgcagttcttttaaaaaaatcagtgttacaaactatgttatttatagaaagaatagcagagctgaagagatttagtcatcatttaatctcgggatttcggtcctcactatgctttagaatcacctgggggaggctatgtgtggggccccattcccagagattttgaatttcatttgattgggtgtgggactcaggcgtttgcattttataaatgaggcaactagttttgaaagagattgtgacttgtcaaagcacatacagccattcagtggagggagctggatcagttcagtatttccctgtatcattctgcattctacaacctagactggagttggcagacttactccataaaaggctagatgtcctatgtattaaaaaaaaaactcacataatttccatatttccatttttttgctatttctgatgtccttcacctaaagttatttattattttggagggacggaagggagactatatatatacacacacacacatgatagaagcattgccacattatgttcaagagactggtgggctgctaatgaaatcttcagcctgtagggttattccctcccctaagcaataattaaggatcagattacttccaggcccagttaaaaaaaaacagttcagatttcaggtgccaggatgaaaaggcacttttcttttttctcgcagtgttaaaatgaataggcattttcagtataaagctgaatccatctatttcttcaaaaccttatagtgaaaatttaagttttatgtagaggataggagaacttgtatgacattcagaattttttatgagttggtttcaggtcagtatttagatgctaccatgagttaatgcgttaaagatacttgatttacttattaagaactaagcttgctcttaataaatttagtcagggtcttcactctgagtaaaatttagtcttttcaaattattatctttgtatttctgatcctactagtctattaacttgaatttgattgagagatatggaaatagtcaactaaatactctgcttggagactaagaggtggtggtggtaacattggaccatctttgacactgttggtttgccagtttccctctgaccttttccagttttgttcatggactatgtcataaaggtttctttcatgagtaaattttgaacccaggttcaaggtgagttcagaatatactcaaattcattcaatcctttttttttttaatgcagggttgtacatattttaataattttcttatgtatctggtatttaatgctgacaggattccagtcaatggagaggtttcattgcaagtagctgcaggtgtgtttcatggtagagataaaagttttcagtgaagcagactttcgttgtaaaaaaaattacatcctagtaaataatgaatatagatgttgctttttatggggcaatatggtatgctttttatgtgttatgctgtactgctaagtaaaaattttgagttgtaaaggcaaaaaacatcagataccaaatctaaaaggaatgattttaaagattgtgaaaatggtactttttatttatttgcaaaatttaaagcacctgattagtacaataagatgtatttatagtattatttcatataaaaatgttcattctccgcaatgtgtttttatttgatactgttaagtaggtctcccctgaaaacctggttaatgactatttagctttcccatttttggtcttcctagaaagtataattctttcatttatcatttgagcatctgttctaggaattatgctatgtcaggaatttgctctcagggattatgtcttagagagtttaaaaaattgtagagaatgcctctttgataactacttggtcttgaaatattatgtgatggaatctaccactctgcttgttacatacatatttattaaatttctcaccatttttggtccacctaacagtaagactaattctttggaaaagtagttttactaaaagataagatacatgttatttattttgccttttcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccattagtggtcttgaaattttaatttagtcactaacattatgtgaaaaaaggaacaatttttcagaagtccttattggtgtttggtcttaaaatgaagtataaacattttaactaacttacagatttccattcagagaaaacagtgccatttggtttttgcccttcctttgaaaaaaatgcatttggtaatcgttggtttaaaatgaactttattacttcataggatgaaaggttaatttaggacataaacaaacagtagatataatgggggttggtagagcctgaataaaacttagtgattttccttctcgataaaaggtatagttaacatactgatgaaccattcagaaataacaaacaaaaactcaatcttaaaaaaaaactacatctctttattgcagaatttatacttgtttgaaaaatacaaaatgtagcgttgataagattgaagcatgttgaaaggtaagtacagggaaaggtcctttcagaatgactgcaacagtgcagcaaggattcccattccccgcctaaaggacaatacctttttaatagaaataaatgagttagttagttagatttttattacagattgaattaaacagttagttacaaagacattctctgatacattcattcatagaggtcttaacgtataaatacatagtaaatatcctataaaatggtaggcaatctcatcgtgcattatctttttgtgctcagacttgacttcacattcagtctctacatacagcttgattagaatcataaaaacaatatgaagacgattgcataaagggatagtttgacaaagcatattcagatattgtaacatttatggtgggtaaaaatgtatcttttgaaacaatatattagactccatttttagctgaaatgaaatttactgattcaatctttttaagaatttgtggatgtttaaaggaaatgtatattagcatgaatgtgtaactattaaactcctccgcaaagctattcagctgttgctaaaaaattgaagtttaaatataaaaaattgaagtttaaatataaatgtgaaaattcggaccttttttccccagatatacatgctgaagataatttgatccaataagttaaactaagtagagatttatggaattaactcatcaataggaagagtacacatcaataaaagtaaattttttttaaaaagtatatacctttttgatgttaattttgttataaaagtatctcaaaacatcattacaacagtgtgataaataatatacaaatgatctcttaaaataccatgaatagggagccagcttccccaaaaatgttattctgttaacatcagtatcttgctttcttaaaatgactttgtaaaacctgataaatactctcagcaatcttttctaataataaacatctagtattgctattaattagattgtagacttttatacatagtaaacaaaatagctttaaatgaatgcggcatagtattttcaatgatttttgtttgcaatgatgaaacagaaggtaactttgtgcagcatctaccattttccaggaattgtagtcccacattcataccactgaacataattgatttgggtgtgaccacctatttctccaaattggacaggttcctggcgaactgctctgaaataacctgagagagaaaatagtttcattttaatagctgctgtattatatttttgccctcacagctcatagattgaaggatgtcgttgactagctgaaggctaatcttagtgaagcgaggtaatttagaaaactgagagcaagaagttctggtgttttttcctgaggtgtagtcatggttggctaaaatgggcacctgaaaaattgttgacatttgccgtgtcaagttaggaggggatggttggtagtgagtttcactgcccattatgtgttcaaagaacttagtaggtcatctttcagtattgttggtatttttaagtgcccgtgaacaaaatgtgttactgaaaaatcgaatc

SEQ ID NO: 12557 - DNA, 421883 bp, Human
  misc_feature (1)...(421883): n = A,T,C or G
tcaatactaggaatttagtatttcttttctagagtcttattttaactttttattgagtaaaactagtttgaaaagttgagttttttcctgttccagagcctaattttatttaggatctgacccatgaaaattcttaatgagttacataagatgtcattccttcagttaactacaatgaaagattatgaaagtaactgatgaatggagatatgaagtgctacgtttttcaaaacaattggaactgctgtggcactattgactggagattctttgtggggggcaatgtaaggagggcttttctcttaggatacctccttagaccaacccagagctctgggaagctgctcttgaggattttgtatcttttcatcccgctagtgggcctaatttgcagtgaccccctttaccttaagtcatagtatctgcaacaaggcctcatttcttggggaagatagcaaacttgtagttaaaaggctctaggcccagtcctagatataggaattgaataaaatcatgaatgtaatcatgtaatcatttcctccttgtaaattaagatttgttactaatttatgtattcagctggtaaatgagcaactttctattgtgtcaggaatgggggcagtagattaagacagaaccactaacagggaggaggtcattgcctatggaaatagctgttgcagcactcttctgagcctgaattttaaaaataacaaacatggctttgcttcatgatctatgaagtaccataggaattcgggaggtctgaaaacgaaaagtatcaagttcaagctaaaagattaaactacaagcatttattaggttgaatatgagaataaaataaaagtgtagtcaacccttgattattcacagattggctagagtttatgattatcaatgcccttcgattctccttttgcttccaactaccaactattgaatatttttttgctcattaacacctgtctaggagtgggaaggtgaaatgctaatcagccaatttggttaattgttagtggctgctataatccttttttttttaagttgagataaggaaatactttacttaaatattggctgtggactactaaactttatgtcaccttcccttcctttttactgcatggataaatgcaggtatttagttcttagtaaggtagtagagagaattaaaaagatagtaattcatcaatccaatgtttttcaagtatcacactataaattcacattacataattcttattggccagtgttcagaaaatattaatcttctacaatatgactactttaaaagaaagcttcaagatttaatagttgcaattttaagtgtagccctatataaataactgcacttgctaagtggatttgtatcaacaggaacataacttctagaaaattactcaagactaccctcccttttgcctgtgatagacatttgggaccctccccaaaccaaataagggaaagaagaatgttctgagcattaagagcactaagaataaatctgagctctcacggataagattactttcaactctttatttcatgttttctgacatagaccccaggatctgtaattatcttagagaaactgcgggggcttagatggtactttgtagttcatttggttttttttgtttgtttgtttgttttttgcctttctctctttggggctgaagagctggtgtgtctgtgtgtgtgttcctctagagtgccaaaaaagaaaaaaaaaagtgctgaagagtcctagggagatgaggctatttttgtttgaagctgatacttctagctgagccacaagtgctgcttggaaagggcttaggttgtttccagggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggtattgctaccattttccgatagtatcaagtaaggaaaaaaaatatgcaaatcgacagccacattaactgtcgatgtgtccatttaaaatgttgctttaaggtaattgccttggtcaatgattctatacaggatctgagaagtggatttaggagctgagaggctgccagatctgtatattgggggagcaaaaagagatttctcttaaattttgcatgtggaaactgttctctgctataccaaaggccccactagttaacagttgttactcacacctctataaatagctatggtcatgtaacatgatggccgatatcttatccagcaaaaattacaaagttttcaaggatggagaccatgatgaacttaaaatattacactaatgcttacttaaaatattacactaatgcttacttaaacttaaaaagtaatttgaagcatttctgctttatgatatttttaaatggagaccttaaatttgtttttcctttcctactagggtatgtaaaacacacatacatatatatgatttatatacaatttaagacataagtgttcccataaaatttgtatttatttgaccattaatggaaattcagagataaagactggaattccacaaacttactgtgaatcagtatgatttttaaaataaagcaattaagtgttagaattctggttctttttgtaaattcattcttcattttcctctaaatggtaaattctatctttatgttacaataaatattttctgtttcaatgctttactgaaagctacatactataatacatatcttctatttgatggttgctagttatatatatttatatttcatatatacttcatatatatatgtacgtatttcttagaatgaaggaaaccttcaaaactaaattactttgaatacagacacagtctggttctagttgaggtaaaacttttggaggtggatctaaaatttgcttctgacagctgtaagaaaatcagacaggtggtgctcttaacaacttccaagttaaatgctgtgctggtttgctttgaataatacaactgaaaaatagaatatttgtttttatttttgagggtagaaattagtatggacacacagtaatttctgttggagatttttagtcaatatttataagaagtgccttatttgtaccttgcactgagaaattcagtctgacacctcgtattaataacaattactgagagatttctatgtgttaggtattttgctcagaacgttatgtgtgtttacttatttaaaactgacacaattcaattaagtaggcattattatctcagtttggcagaaaaaggaactgtaactaaaatgttatgtgacttgctcaagaccagcattaccaacatttaaacccagcccctttaaatcttgtttgtgtgtgtgtgtgtgtgtgtgtgtgtgttttcttttctgtgagaggatatcaggtttactctttaccaattttagttcagaatttgctaactaaatataaatagcatttttcctattccttagatattctgtgtcatgttgcttttagtttgccttaaagaaagctatgtataaaaacttcttgtttagctctgcacaagttattaagatagctacgagcgtcttaatcttctgtttctctacctctgttcagggtttgggctcccaggtgattcaggaggtcagttgactaaaccatcttgggcttgcttgtggattatgttttgtagaacttgcatttgattcaaaagactttttacaggaaaattcttgattatgaaatagagcttttgtttctgcctttgctctgcgggggtttaaaagggccttggaagaccttctggagttacccataaaaataattacattagtaataaaattaaaaagtagaaataccatctaattcttgggtgatggtcattttccacttccgggccttaacagttcataggatctatgttatctgaacatcaattatgcatttttttttgttttctggaatgatttattaataatatttctcaaatgaaaattagactgccaactcaaatgaactcatcttttaaggaagcacagtcattctttgatgatatccaaagttttttcacactttgttactacacagtttcatgttatctttgcaattctcaccttttgtgccctagctacaattgtcttcctccagtcttttataaaaggtatacctttgtacagtgccttggtacaggctattttctgagcctgaaatagtcttattttatctcatctgctatatttttttcaaccatttatttatttattttattttttttagagcagaatttttctctgtcacccatattggaatgcagtggcatgatcatagctcactgcagtctcaaactcctgggttccagcaatctttctacctcagcatcagaagtagttaggactacaggtgtgcaccaccatgcctggctaattttttttttattattatttttgtaaagacacgacctccttatgttgaccaggctgtacttaactactggcctcaagccaagattctcttgcctctgcctcccaaaacattgggaatacaggcaagaaccatcacgcctggggcttgcaatcacttttggacacattactgaaatgtaagcactctatcagtagacctatgccacctatcaatcaattaccttttccatccatttatcacgcacacacacaaaacagtttgtggcacttaagaatataagagataactcattaccttagaaagctctagttaactgttctcatctcaagttttgggaagacaaggctcatacagattatatgactgtctcatggtcatgggaaattaggagagatctgaggataaatttcatgcctcccatggctcatcccagtgcttattcaactacagtgcatgtcgtgcctataacctcacctagttgctcacatcaatttccactgcaggttccaagctggcttacttcatccagtggaagaaaggaaataatgctaaatacagaattgtgtttcaggtacagagtaatagataaattagaaataggacaaagttgaactccaaaggattttagggtaataacacctttgattctggcaaaataaattaataaagataattataacagcaatgataacatatttattctgaagacataagatgtcaagcactgtattaagcttgataaatattcatttaatcttcagggccaccaaatgagaataaaggctaatattattgctgtttagagaataggaagctgaagttgagagagtttaaagaatgtgctagaattcacacaactgtatgtgatatagctaggattcatacccatgcctgaccacagagtcatattggatatgtcttcttactgtgtgagactgttaggttggtcaattaggttgttattggagcctacactaggaccatgttacatttaggtaggttgaatcaggcccagactggattacactcaaacagcacacaggtttagggctataaacagtcctttatcttccttgcaatgtaatgtatccaagttgctgggaatcccatatataattaacttagtatttactagaacgcttagttcaagaaagctttttatttaaaatgttagaagagcttatatccaactctcaacttataaactattacataacctcaggcttcaggagaagaattattgcactatgtgtggaattctttccttaccattagccgaatcacgtttcactgcttctgtaacaatcaaacctatgagaagatttgatattcaaaatttagagcaaaaatggtcatttatattctacacactgcattactcccatagagtctgcagcacaagattactcactattgctctcaagaaaaaaaaaaaatcaagaattcacagccagactacttaacaactaggcaaacaagttatatcatctagcatgacagatggtgaaattatgaggcgatccaacctatgtttctgcatttacctcatcaaagcaaagggcagctgccctggcttaagcggggatgagctgggggtacaaagggatgtagcactagtttcaagccctggtcacttccaggagatgttcttgattttcctgataaagcaacataccacatatattatttttagtcttataagtacattttaaaactgacattagaaagctagcctattcaaaagaggagtaccacgatggtgaaaggcacagttaaatgaaaagatttgtgcatggtttgtttaagtagaagactggattttttcattatgtagcacttgagggcaatgcacagacccatggataaaagtctggaagtcacaaaaaaggcacactattggcaaaatacaaggcaaaacccaaccaaccattaaaatgatagctagaactgactcttctgactagaaagaaagaaaagagaaagcaagaaaggagggaaggaaaaggaaatacacagcctccaatttttaagaaatagagggatgaggaatatgccaaaatctacaccatagtaggcagtaggctctgggaacctctacagtacaaacaacccagttacttcaaataagttcctgggaacaagaacaagaaaatctggagaacagatgaaaagaaatgtaaaaagttagcaacccatcacaatgtatggaatggttggatcatgattcaaacaaacaaccttaaaaaattctgatgaaacaagtgaaaatttaatatactctggatgttagataaccttaatgaataattatatttttagtgggataaccgtattgtggttgtcttttaaaattacttattatttggagatacacattcaaatatttatgaaggaggtgatgtgatatttgaaatttgcttctaaataatatgcccaagaagaaagtagttggggtgtgggtggggtaggattggccattagttgattatgttgaggctgataatgggtacattaagtttcattataatattgtctacttttgggattatttaagcttcttcacaataaagagttaagaaaaaaaacagagttgatgttgttagtagagtaaatcttttaataagaatttaattttcataacatatatgggtcagtgaattctctggtcaccaaatttattcgtaagtgcaaattactctctaaattgaacagtgtctgttgttactgaaatgaaaaccaaatatgctcatattaagcagagtagtctggaaatatacttatgtttgtaaaagcagacaaggaagtaatcatttttaatatctattataatatgggaatctggaggttagtttcatattattggtaacattaattagagacattaattagaaatagtttgtttttgagataggtcatgggaaaacctgagaacaatttgaaagcctaagaagtcaacatgatgcaagaaaaaatagttctaaaaagtgctatggcttggaacattgcatttattgacagggtattaagtatgaagcttttgtatgactatctctttgaaatatcacaaaaactgtgaaaggcaggtatcacataaacctgattagtctgactctgaaacttcttgttattctttactgctcaagttcactttaggaaaatagaaaaaaaaaaaaaagcagattgtgaaaaccaggagagtatagttcactgaaaatcagagagaaaatatagtgcagagctgggagaaagaagcattaagaaaagagagtgtgatagagtagtaagtgcatggagttttacttaagtcagaaattggggttcaggcactatctccactactcaaccactcttggtctggggaggatggggcctcaaaagaagggtcatgaacttggttaattaaaaataatatggccagaggaatttttaaaaattttacaagatcatgctatttggcaaattaagtttatgttttttaaattgttcaaatcatccatgatacaaaatttgcagtgacaatgagcagaaaatatagctgtgtagtgtcagcccttgttaggttccgttaagaagctttttcttgtagtttttattattatttgtaataggaactatttttctccccaccccataagcacatagtatccatgaaaatgttccgtttatgagcttaaatgtttcttattttttttcctatttatttttggttatcattatgactgtaatttaaaattcatgctacttttacaatgcaaaaatgaattgaggctattcagttattatactaaaggcttaggaatccatagagacttaaggcctccaatactgttggcattaatttttaatcagttaacaatatttaatatgagagaaacataaaacagtgcaactaagcaattttaaaatcatctacattgacctttgtgttgaatatatcaatttgaaaagaaaatggttaagattttccagtaaagcttttggttttatagttatgcttagttggagcttaaagatagtattaaaacattattcttttcttctttcaaacaaaaagaaacccgttggggacatgtttaatgtatttttaaaaaatacatattatctaatgtaacatatttaaaaagaacaaagcaggggaaaaatcttcatctggcaactatgcattaacatcatacaataatgtcgactttacggagttcaggctccattttacttaaagttctaggaagatttgtcaaggttaagtttttgctgtctccagttcccacctgccctggataatacgaatgacaggcttggttttttacagagaatacttatttgattgtcatgtaaatatatattacccctagtgagggttatgcagagacagatgaacttcctggtccaaacagatagtaatttttatcttcaaaggaaaccaaaaagagtatccttggcaaatgtgcaatgaataaagtcttgctctgctctatacaagttaatgctctctaaacatcaaacatctccacatctccatgcctgaagtgaagctgtcaaagacacacagaatttacaattgtgagagattctttggtatgtaaatgagctgtttcctcataaactgcagactctatctcacttacaatgtactttaaatattacatttaaatatatgtggtttagatattttctaatttgttatctgtgccagaagctagggcatgtggttttcacccaaacaagttaaagacatgatattttgacctataagaacaaagataatttaaatggagcaacctgttctttataggggaaacttggtttcatttagacagcatgaagctggaactcattgtgacaaaccagttttatctttgctacgcatttgctgcatcattctcccctccctgacacaggttactgaagtgttgagaaaaacaaaagaaggaaaaactcttagtatttcaaacttagttttaatatggtctagggcattagtgagctcgtggatgtgagagattcagtttccatttatacagacgttcaaaatacatatttagcaaactttccttggaaaattgtctgttgcctttgaaaataaaattatcatgtgattaggggaattttctgtttgaggaagacatttaatataatgtcaagacaaaaataagagatatgaagtggcacttctctgacattcactgctggagctattatttttgcccatggttattctgatttaacctatatattattgactaggggaaaaagcgtactgtaaaatctgaaagttactacagtatagtaaaatgccaagtttgtgaatttaaatctgcagaaatattaggcattgcatttagaaaaaggcaagttacctccatctgaaatataacaaaattttagattctatggtattaattatcatcctagatgtagatttatgaagcagtatgtcatgccagaggtttggttttattcaatattttaatacctattacgtaccaaattgaatgcctgacaatgtggacacaaaaatgaatgataaaaggtccctgctacattgcaaaacaaaaagaaaagagcaaaaaataacagtgagaataaagactggacagattataaaacatttgattccaatttgaattgcagccatgtctctttttattgcactttgctttattgcatgccacagatattgcatttttcaaagaaaatgaataaagctatcaccaccatttttccaacagcatgcgttcatttcctgtctctgtgtcacattttggtaattctcacagtatttcaaatgttttcgttattggtatgtctgtttcggtgatctgtgaccattgttctttgatatcaatattgtaattgttttaggtcaccacaagctgcccctatataagatggtgaatttcatcaataaatatgtgtgttctgactgctccaacaactagacattcccactatctctccttctcctcaggcttttctgttccccgagacacaacaatattgagattaggaaaattaataacctacaacagcctctaagaattcaagtgaaaggaagagttgcatatctttactttcaatcaaaagctgaaaataattaagcttactgaggaaggcatgccaaaagccaagataggctgaaagctaggcctcttgcaccaaacagccaagttgtgaatgcaaaggaaaagttcttgaaggaaattaaaagtgctactgaacacatgaatgataagaaagtgaaacaaacttattgctgatgtggagaaagttttagtggtctggatagaagatccaaccagccagaattctctttcagccaaagcctaatccagaccaaggccctaaatctcttcaattctgtgaagatgtggagaggtaaggaagctgcagaagaaaagttggaagctagcagaggttggttcatgaggtttaagaaaagaagccatctccacaacataaaagtgcaaggtggaagcagcaaggattgatgtagaagctgcagcaagttatccagaagatctagctaagatcattgatgaaggtggctacgctaaacaacacattttcaatgtagactaaacagtcctctattagaagaagatgccatccaggactttcagagctagataggagaagtcaatgcctggctccaaagcttcaaagtttaggctgactcttgttagggaataatgcagctggtgacttcaagttgaagccaatgctggtttaccattatgacaattccagggctctaaagaattacaataaatttactttgcctgtgctctatcaatgagataataaagcctgcatgacagcacatctgtttacaacatagtttactgaatattttaagcccactgttgagatttactactcaaaaaaaaaattcttccaaagtatttctgcttattgacaatgcacctggtcacccaagagctctgatggtgatatacaaaaagattaatgttgttttcgtgcctaacagaagatcatttttgcagctcatggctcaagaagtaattttgattttcaagacattttttaagaaatacattttgtgggccaggctcggtggctcatgcctataatcccagcaatttggaggccaaggtgggtggatcacctgaggtcaggagttcaagaccagcctggccaatgtggtgaaaccctgcctgtactaaaaatacaaaaaatcagctgggcgtggtggcaggcacctgtaatcccagttacttgggaggctgaggcaggagaattacttgaacccgggtggtggaggctgcagtgagccgagatcgtgccactgcactccagcctggggaacaagagcaaaactctgtctcaaaaaataaaataaaataaaataaaataaaataataaaaaattaaaaaaaacattttataaggctataggtgacatagggagaaatacctcttatggatccaagcaaactatattgacaactttctcaagaattcaccattctagatgccattaaaaaatataatttttacattacaaatttttttatttttattgttattattatactttaagttctagggtacatggggaattgaacaataaaaaatatttttgattcatggcaggaggtcaaaatatcaccattatgtaaaaagttgattccaaccctcatgatgactttgaggggctcaagacatcagtggaggaagcaactgcagatgcagtggaaacagcaagagatctagaattagaagtggaagctgaagatgctgtaatctcatgattaaacttgaatggatgaagagtgacttttttgttgttgtttttttttcttttgagccagtgtctagttcggcatgcactggcacagtcttggctcactgcaacctctgcctcctgggttcaagtgattctcgtgcctcacccactgagtagtgggattataggtgtgcatcacactgccaggctaatttttgtatgtttttgtagagacggggtttcaccatgttggccaaggtggtcttgaactcctggtctcaagggatccacccaccttggcctcccaacgtgctgggattacaggcatgagccaccatgcctggcctaggaggtgctttctatgaatgagcaaagagagtggtttcttgagatggaagctactctactcttaatggagatgctgtgaactttgttgaaatgactacaaaggatttagaatataacatagagtagaagataaagcaatggctgggtttaagaggattaactctgatttcaaaagaaattctcctatgggtaaaatcctatcaaacagtgaatgtcacatactacagagacatctttcatgaaatgtggagtccatcgatgtggccaacttcactcttgtcttattttaagtaattgcttcagccactccaacctttagcaaccatcaccctgatcagtcagcagccataaatattaaggcaagaccttcaattagcaaaaagattatgactcactgaaggctcacatgattgttagtattttttagcaataaagtattttttattttcaatcttgttggctcagagtaggtgtatatatttatgggatgcatgaaatatttttatacaggcatacaatgagtaataatcacatcaggataagcggggtatccatgacctcaagcatttatcctttctttgtgttagaaacagtccagttatactcttttagttatttttaaatgtacaatgaattactgttgactgtagtcactattgtgctatcaaatgctagatattattctttctaactatatttctgtacccattaaccatccccaccaacaaagtatttttaaattaaggtcttacactgctttttaagacataatgttattgcacatttaatagactagaatacagtgcagacataacttttatatacactaggatacagaaaaaaaaatgtgtgatttgctttcttgcaattatttgctttattgcatggtatctccaaggtgtgccttatggtgtttgatgtaaagaatgtcatattattgttcataaatcttatgattatttcactttgaaacttgctgaaaataatttagtataactaaagaatgtcctattcttaacactggtaattcgcagtgcacatgacattattgtgaaggtgtaatgatttttcaaggagtaaggagatcaagagtacatttgatcaatgcagaaatgacaaaaaaaaaaaaaagagacaggaagtaggtgagaattagtagtctgtgggatgtagccctgggatgactgggataccaagttaccttgccaagaaattgggtaaaattcctgatttaaatactaaattttcggtcaggcacactgttgctataatactataaaagctggatgtttcatgtttctgattcgtttttaacagttattatgtttcctagttccctgtcatcccatctgagtgttctcccattatttgaacctctattgctgatttccatccccacatacgctactttgagcttactttgtatgtatagagaccatttccagttcatgaagaaataaaaaaaaataccaactgtcagaaaggtaatcattaaacgagtttcttctggcttacaaagaagaatcagttgctacagtaaaaccaaatctgttggcagagttgttctaaatactatgagaactagtggtcaggccagtggtcttgtcaagagttgctgtaaaagcatgacagggtccatagaccaagcctctgaaaatgtgagcagaaagtacttagggtagcagtaatgactagattaaggcaataagtcagcagaattctctagggcctttgttcatagtgactgagagttatattagaaataatagttctgacagtttccggaaaattttggctacctcttgaattaagtagaccagatttcactgctcagtttctgcccagtccctcaggatttgaagtgtcttgttggtctggctagaatgatgtgctatactatcgtggtatgggtctctgtttttgagggacgtgagctctcaatacccaggtgctttgagacatagtattttatcttcttcctatcactctgtcatttacctgtggatggagaggaatgaaaagtctgaccccctgagtgataagcatgcacctaacaaacatcacttgtatatatttttggtatctacttttgccaggtactgttttaattctaaggatgaaatgtaaaatatacagaaatctagtcctcaagaaatgatgagataattgtatatgtaactctctgacactgggctgccagttcaaagtttcttgaaagaagtatgtataaagttatatacaaaaattgtgagataggtttcttggtttcttgtcaaatttaaaatagacaatgtttacatgtataaagctattagggaatgaatcaatataaaacaaataagcaaatcaactgatgagatattaatattgggaaaatctaagaagctaggagaatggatggatttggttggtcagggactgacataaaggaggagaacttatgttaacatttgaagaatgtttctaaattaaaggacaggaacacagaagaaagagcaaagaattaagtttttaacaacatccctagatcctaaaaattccaggttaattcattttagaaacaagtatttgatttcttaaactaaattaataaatatggtgatcttgggttcagtgaaccaagctgaaggagacacactttattggcattcagggtggaaaaatttgttgcaacgatcttccctaaagattgcaaaataattagtacccagtagcacctctcaccataattttgactccataaacacccccaaaattttcctatcagagatgataaactacaccacagttaacaagaacataaagatgagtatagatgctagtggtagcttcaaaggagatgggattgaaatcctcaactatgagaaactctaagcttagttatctttcaattttatatataagattctttttatgtcaatagaggggatttggattggtgagaaggtcattttgcttctccaatcagttatttgtttgcctcaatttgctacttataattctataatagaaagggaaaaaaaaagacaataacctcagggaaatacagggcaaaaagattcacaaactaaatggaatgacatacttccctcttgagaaaaatcagtgaaaggtgatgacttattttctgtgtccttgagctaactaatgagttgcaaagtgacagcataatttgaggagaggcacaggtggaagcagttctgatgggtaaagtgaaagagagtgctttgcaaaattgcccgatagagttttacacaagctaaatagcaaacctcaaggtggattacatttcttttacttgagagtcacccaatattttgtcatagtgaactctacatgtgcttagagtacctccagtgtttctttaatcctttgcaatactatcatgatgacaaatgtattttcaaatcatataaaaacttgcttaaaattaagttgttaggtaatactgagctagaggccaaaatgcgcaagaactctatatacaagtgtaaaaagaattaggacactgtggtgattactgaataatgctgtcccgcttagttttcaagagaacagccgtctcctcagttcagtgtttaaaaacatactatgagtcatcataatttttaaaatatttttcttaaaaattcattttagtaaaatacagactctgaaagtttcataactcacatatgcggttgactcttgaacaacacaagggtaaggacaccgacttaccagtcgaaaattcacatataactttgactcctcccaaaactttattaatagcctactgttgaccagaggctttaccaaaaacattgttgattaacacatattttgtatgttatatgtgtgtgcgtgtgcctgtgtgtgtgtgtgtgtgtgtgtgtgtgtctgtatatatatatagagagagagagataattacaatgaagtaagctagggaaaggaaaatgttttttaagaaaatcataaagaagataaaatatatttagtatccatttagtggaactggatcatcataaagaccttcaatttcatcatcttcacattgagtagactgaggaggaggaaaaagaggaaggattggtttgctgtcccagtggtggcagaagcagaagaggttaaggagttggaaggggaggccagagagccaggcatatgcactataactttcatttaaaaagattctcacgtaagtggaactacacagttaaaacccatgttgttcaagagtcaactgtctttatatatcatttactaaggagtaatggagttgatatccacataaccaacacccagatcagggaactatttccagcacatgggaagcccatattcatctatccatactttgactctcactttggtgtcgcttcccaattaaggctcctctttctttgaactttcctctccagggaaccagcttttttggtaatggttttctttctttgctttatagttttatgacctcaacatcgataaacaacatagttatgctaagtttgttctttatataaatggagcaccatggcatgtattgttctgtgttttgctgcattaattcctcattttgtttataagagtcatctatgttgttgtatgtagctagagtttgttatttttctttctgtacagtgtttcattgcataaaagtcactgtttatccaatagatttttgtttcaattgggggaggctatgatgaatgatatttttatgttctttttttagttttaatatctattattctattatcaatgtatgtttatttcatggcactatgttctatggtgaaaagttgaattcagcatgaagaagacaccttgctcactcaaactggattgtttaaatctaattggaaaatgtggagaaagggtgaccttgtgggtgtctcctagaaacgtcctgttttttagaagaaattgatctagtctcacaagatatataaaatggatgtttggaggagcagagagaaaatgaatagaatcctaaggacttctcagagttttgtctctgagatagtaatcctcaccgtatagcaacccctttttgagactgtatgggcagcaatgtaaaaattgacatgtagagtgaggcattcaactaatattgattgaatgtcatgtcctcattgccaagcattttacttggagctggaccaatagcagtggacaaaaaaggtccctattttcctgcttctgtcagaacactccatgactagaatctccattgtcactaggttctgcaccttgctgtcctgggcactggtgagagcaactgagtttttgcttgttgaggctcctccttctaggatccttggtacacttttatccaatggacatcatctttaatttgacttgctggctttattagaatattgctattgttaacattcaggcaaaacttaggtttccacttctattcttcctgcttttagatgaagattgcccatctttaaaaggtgacaacttcaggcagttaattttgtccactttagtttagtttgctagcttaagctctcagaaattattcaatattcaatttaacggaaggaggttttactgaggtggaaagcctaactctgcctcagtgtgtgagaaaagaaggattaaaagataatctatctccatttatctatattgtattacctccaaaaacgaaaaaaaaattctatttgtaaaactctgtgaagagcatgggtatactaggcattctttcctgttttttgatttgggtcaaaatgtatgaatgcatgtgagctatatggacataacaactttgagaaaattccgaataagttttattctcccagatcagagtttgtcagtgtgtagtccccagaccagcagtgtcaacatcacctgggcacttattggaaagggacattactgggatacatctcagacttttgggatcataaactgtaagaggagagtatggcctagtgatctgtgttctaacaaaccttttagatcattctgacacacgttgaagttttaaagccgcaaccctagttaactacatatagactttaaaaacaaattccctactaattccaattaattagggataaagatccaaatcaatcatgtagtatagtggcttaaaactcacaataacagaggattcttttcatgataaatttgtgatcatgcacaagaagattcttttcatgggcaatggaaatctgaagaatggagatggaggaaaagaaatcaaagagagaaactatttgcctggaagagagcaaaagtgtgtggaggtcaagagcccaacatgtgcacactgaaactcatgaaattttccccataatcagctatttctctggacctgcagggttctgtttttttatctgtatgcacagtctctaaactttggagtcctcatttcttgtattcaccttttcctttttcttctcatttaaacttcagttattttttaaattagaactcctgttctaatttaaactcctgttatttcatatatggatgtctgtatgtgacagattgtatttttcaaaagtggctgcagcaagatttcccatctcatgtgttcttcttatactgtgatcttgactcttcttctcttgagaggtgaggtctacttttcctcccgttaaacacaaacagacttgtataacagcttcaacaaagaacatacagtgaaaatgacttccaaggttagatcataaaaataccagacatatccaggttgctggtttgggatacctgcttttgaaactatgctgtgaaaaaattaaagcagcctggaggcaggcccataatgaaagagaccaagaccttgacctgcaaacccagccaagcttccagccaacagccagcaccaactttccagcaatgtgaatgagtcatcttgataatggatcctctagtccccagtagagccaccacatgtgacaactgtggagcagaggcaggccatacctgctgaactctaaccaaattacaaatttctgggcaaaataaatgattacagttgttttaggccactaaactttggaatcttttattatgcagctacagataatacattatattagcatttttgtaatctcctcacttctaatgtatcttgcaatcttgcacactaagttcataatactacattacccaatgaataatggtaacttatttagtgtacagttgtttcagccaaattcaacatgacgctaggcaattttataattgttatacttcttcagtttcatcattgatttatttacacatttattcctttagtaaaatatatttaataaatgttgattattataataaaatgtttgagttactggagagaaattcataaaaaagaacaaggaagaagaggaggagagaggggagaagaaggaagaggatgagaaagaggaggaggagagaaaaaagcagattctcaactaaggttgtcacacaacttgacaattttgcaaatgtgaatgggcattttttaaattagaatgcccaaaagatacacggttgtgagccatggattttgagcaatacttaatttcactgagcaggcctaaacaaactgtgcataagagagtgctcacacaatgtctactgatgaagagtagtgagaatattggttgtggtatacagaataattgtcccccaaaatattcatgtcctaatccccagaatctgtaaatatgttaccttacctggaaaagagaatttgcagatgtggttttattaagaacctcgagcgggagagaggaccctgaattatctgggtgggcccaataaaatcacggaagtcctcaaaattggagaactttttctgttggtggccagcgggagatgcaatcagccagcactggctttgaagatagaggaagaagctatgagccaagttatgtggcaacctgtagaaggtagaaagtacaaggagatggattctctctagaggccccagaaaggaatgtagccctgaagacactttgattttagctccttgagacccatgttggacttccaagtacagaattgtaagataaatttgtgttaaatttgtggtactatgttatggtgcagtagaaaactaatataccagtgtgtatctgattactataactctctcttactcactggaagacaaatttttagagggctcatataaaattagcataggagaatggcaaatttatttttcctgggcccagtgcagtggctcattcttgtaatcacagcactttgggaggccgagatgggcggatcacctgaggtcaggagtttgagaccagcctggccaacatggcgaaacccatctctactaaaaatacaaaaattagccgggtgtgttggcgggcacctgtcatcccagctacttggaggctgaggcaggagaatcactaggacccgggagacagaggttgcagtgaaccaacatcgcaccacttcactccagcctgggtgacaagagcaaaactccgtctcaaaaaacaaacaaacaaatttatttttcatgaaatatttttacataaatctttttaaaaataaatagtctcccttttatattagcaatctgaaactaaaaaggagttcctttatcaaggtcacagagctcatgattgtgacaactaatgatacattgacgaacaagattattctttctgtagcaatgactttcaagccaagaaatgaagttatctagcaagtaacattttccagctaataatcagcaaaattagagaggcactttatttttttttccactaatatatatttgaaaaccttaggagagagactgtagcttgtgcaatatttatttcttcttaatattgctacattgaacctgcttccattcaactcaacaggcatttctgaaatacaaactgtgacttgttctataatcaatggtgtttgtatatatattcagccacctacatgcaatatataatacatattatctgcattttaaactgaacttttaaaaacgacccctctggttcttcgaccaggacaccttgccctactttggaatgggtatccttcacgttcctgggctggcacacatcaggaagctatgtacattttcagctggataagagcctattaatagaaagctgacactgctgtggttaaaaaaaatcaggtcagagattaatttcatgaaacccatagtcatgtcagctaaatatgatctgtttgaggtaggtgaaggatgtgtgatcactctgttgttcaaactcaaataaatatgtctttcttttatatttgcaccatgaaatattttttcatttgtctaggaattctaatccttgcataaaatcatgcagattttaaacttctgaaacaatctttgtgcttaaacatcttccaaataagactacttagagaaaaaaaaatggggatcagaatgtgggatacaagaagatatgacaaggtgattaactgaatttgttgtaaaaataaaagttagaaatagaaatttggaataagcataaagttaggtttgcaggaaagcaagttgtatcagtttgacctggaaatactggatgttatttaaagggcagaatgtagacatacctttgatgaggagtattaaaagaaaatattcaggaaggaaaacaacaataacaacagagcaaaattgtaagtggtaagaaatcatacatacatgtttatacagcatttacacagtataaatgcatatgaataaatatgaagtatacatatatttgatttgtgatgtacagaataaaatgtaaaattaaagattttaataaatattgagttcctacaacatatcagacactgcatgaagcactaaaagaaaacatttgatttttttttttttgcaaacctgctttataaataatgtaaagtataacgtatattatggatataattttcgtttttgagatggggcctcactctgttatccaggctggagtccagtggcatgatcatagctcactgcatctcaaactcctgggctcaagggatccttccaagtcgctgcaagcacaggcacatgccacgacacccagctaattttttttgtagagacaggatcttactgtgttgccaaggctggtctcaaattcctagcctcaagtgatcctcctgcctcggcataccaaagtgctaggattataggcttcagccactgcccccagcctaatttttataggtcttttttgctttattatatatttttaactgacacatatatatgagttacatgtgatatttccacacttacatacaatgtataatgatcaaatcagggtaattagcatgttcatcacatcaaatatttatcatttctttttgttgggaatattcaaaatccattattctagctattaaaaatatgcaaaaaattgttgttaattatagtcactttacaatgctgtaggacagtagaacttattcctcctatctagctggagttttatatccattaaccaacctttggctatcctcacatccccacactttctagcctctagtaaccactattctactctctacgtctatgagatcaacttttatagcttccacatatgagtgagaacaaataatatttgtctttttgtgtctagcctatctcacttgacatagctcatccacgttgctgtgaatgacaggatttcattcttttttagggacaaataatattccattgtgtgtgtgtgtgtgtgtgtgtatatacatgtttttcaaacgtgaatgggcattatatatatacacacacacacatacacacacacattccattattcatatatacacacacagacgcatacaccacatttgctttcttcattcatctgtggatggatacttaggttgattacatatcttggttatcatgaatagtgccacactaaacctgggagtgcagttatctcttcaacatactgatttcaattcgtttggatatataccaagtagtaggattcctggatcaatggtagttatattttcagttttttgaggaagccccatactatttttcataatggctgcactaatttacattcccaccaacagtgtgtgagagttcccttctccatgtccttgccattatttattatcttttgtctttttgataatagacattctaactggagtgagatatctcattatggtgttcatttacatttcactgatgattcgtggtgttgagtatttttttcatacacctgttggccatttgtatgtatcttttgagcgatgtctattcagttcatttgccaggtttttaatcacactatttgtttattatttgtttttgctattgtttgagtttcttgtatattctggacattaatatcttataaaacaaatagtttgcaaatcttttattcttttctgttggttatttctttactatgttgattgtttcctttgctgtgcagaatctttttagtttgatataatcccatttgtctatttttgcttttgtttcctgtgcttttgtggtcttttccataaaatgttttcccagaccattgccttaaaggaattcccctaaattttcctgtagtttcatggtttcaggccttacatttaagtctttaatccattttgagttaatttttgcataaattttaatttaaaattaaactttaatttaaaataaatttagattaaaattttaaatacacttacgtttttcaaaaatatttgaccattctgcagttataatattgatataaatatcttcaataagtgtaattaaaaataattttctaaaattgtatttttatatataatagtgtaatagtataacagtagcttaaagtcagtagctagttttaatatttctattctagaataacattgcaagtatgttttattttctaaatttacattttgtatatctttgaattcatattaaaatggtcaatttgagggttttttttgttttttttttttttgtttttttttttaatgaagcactttcccacggtaacattcttatgttaatcatatggtggggagtttaaagcaggaagtgatttatacatacctacagccatgcctcccaaaccttaacatgtatatgaatcacttgaggatcttgtcaaaaggcaggttctgatttagtagttctgggatggagcctgagaacctgcattcctaacaagccccccaggtactgaggaggtgctggtcttagagcacagtttgagtagcaatatcctagagcatcttaaagggtgactagaaaataactctgctttagcttccagtctctaggtttcaactgaaatgaataaaccaatggatatcctgtgagaaaggaccagaggaagaagattttcttttatcatttatcttttatgtgacttttgaaagaatgtatatgagcctttttaagaaggaaagttcacaatactggttatttgtgtgccatccaactcatattcattgttatgtggcatcaaatagtttcaatcctgccaaatctaaaaacaattttttcacctttcaatgatacttttatgatggctttggaaggcttagatgttttaaatggatattaattgtaagacattttattttgatgctttttaacacaaatattatcaattactatcaatttatatttactgaatatcatctggtgtcttgtattaggtttgacacttctgaacacatttctctctacaaggcactgcaagctgtctccatgcttaatttaaaaaaaaagtttcaactaagctctgaataattgagttcattgagcagaataaaatagtggattaattaatagtgttacctttaatggattagtgttgaaaaatatgctcatctctctttctgttaagagtgataaatttttaattccttgtaataattaggaaacataaaacgtgcaaatatatgctgaaatgtatttattcattaaactgataccaaatcattacgtttattttaattgaaattggaaatgtttcccagttttaatgtaagttgggattttgctcatggaaagtttggcattagctgaccattcccaaatcatgagtctgttttctaggatactgttggcacacaatatgagcctcagatttgttcaatgcataaaatttcccaatgctttggtaagtgaaggatgatgcagtcgtcctttgtacttattttaggtcattaaccaaatgtactacttttccttgttatttgatacatctaattttatgctgtattcagttattgattttatttctatgatgagaaagaaatgtcatgatgataagtaggtggaattatagaaaaatagagttggaatgaattgaagaccacctcaagcagtttcatataagacacaagtgttattcatgttaaaaaattatgtgcctggagactacttctagtctgtctactgtccctaggcaggaatatgcttaaactgtgagaaagtcaaagaaaattaatatctaccctatagttaaatatttccacgcactggtactcaatattttccttagaaaactacttgtgcctaaccatacttatgtcaagatgtcttcatcttgacgcacagtggtgcgtgcctgtagtcccagctatttgggagcctgacgtggaaggatcccttgaggccaggagttcaaagctgtgatacatgatgatcaggcatgtgaacagccactgcacttaaaagatgtcctctcctaaatctctcctgttaagatttaacacaagtgattctccttactcagcctcccgagtagctgggattacaggcgcccgccaccaccatgcccagataatttttttttttggattgctgttcttatttcctttttttaaaattttattattattacactttaaattttagggtacatgtgcacaaagtgcaggtttgttacatatgtatacatgtgccatgttggtgtgctgcacccattaactcatcatttagcattaggtatatctcctaatgctatccctcccccctccccccaccccagataacttttttttttctgtatttttagtagagaccgggtttcaccatgttggccaggctggtctcgaactcctgtgacctctcaggcgatacacccacctcagcctcccaaagtgctgggattacaggtgtgagccattgcgcccggccccctcttctattttcgaacttgaaaatggcagatcaccactgtctttatagagactctttgttttgtagaacactaatcttgaacatcgttcttagcttttgacttaagttgaaaggtttgaaccaagaaaaacttttcttcatatgctgtatattatttccagacttttagtcatattaacttcttatgtgcaaatctcaatagtgtattttgggaatgtgtagatgtgatatttcaaactttattatcagataaagcaaaggttctgactgatccaaaaatctccaccaaactaattagatggaatgccagccttgattctgtgcttgtgcttactgactaaatatcagctctgtgtatcaagaatatttggtgaaaaaattgtatgaagagtcagacaatcatagatctaaaatcctgtactcacaatgtgacttatccatgttttctttctgaaatgcagcttttttgatctatgatagaacgattacaatgacagttcatatactatatatatgaaagtaccagcactgtcttatacataataggacatcataaatatgaatttatttcttttatcttatgttgatcaaacattatgggagcgctaaagaattataaatctacataggtgtatgcatgaatcatacatacataaaatggataatacataaaaattatttcatttttatttattcataatagtaaagattataatgtccctctaacttaagcagactacagtgtgggcaactgttacattgttcttttttgccctctcatatcttgtgaatatagcgtaatttttgttctactcaattcagttctcttggttattccaaaagtattcgcatttgcatttatcagatttagaatttaaagtaaaaccttatttttatacattgaggttttacttttcaattttcatttgcatactaatcacattttagtattttacaggaattatgaagttcctaagtaaattacttctttcagctctaagaatgctcacaaatgactaaggtaaatagtcttctcagagttgattcagcttattgggcccttgtgttatttttctattgttgtgctacagtgttatcacactcagcagcttaaagtagcagtcttgattatcccacagtttctctgtgtcaggagtctgggtgtgacttaattgggtcttctactttggggcctctcaaatctgtggcacatttttaggatctgatctgctctcctagatgtatttagactctaggagtcccactttggtgctcaaataaacttaatgcagtttttttcttttgttaaatgttatgaaaaacatgagggaccacattcatttaactttgtttccagagagtccccatacttaaaagaaaaagaggaggcatttggtgtctggtcttgcattaacttctactcatagtccaactgtcgctgtttaaaatgaaggtacattataggctctcatagcatggatatgtctcatttgtagcatttgtcacagatacaattgttcatttatatgattatttaatagatatctctgtcacttactcttggcccagtaaagacagcgactatgaaaaaaattgcttaccttttgtacccaagcacctggcagagtgcttggtacatagaaggcattcagtaaatcattgcagagtgaatgaacacatagcgacatggaatgagagtcatcagtaactcaaagctcttcctgggcaacataagtgatgttatcaagcatcaggaagcaatagaggctgcattgatttgaagctgggacctgttttaagggaagaaagaaattcacagtgagaatggtgcattactatggctgagccatgttgttctttggtatattcatttttatctctattttctctaacatttttaataccctggcatttactgaggcatcattagacatggcacttgtgaaacttcagtatattttggagactcttaatagctattgcatgcaagaaatcattccgttcacttgtgaagtcaactggacaggtgaaaattaaagctatttttgaaatcacttgtggttgttccatataaaattattctccagttgtaactttagtttattgaaaaagcttatttcaggacttctagtataaatttacttctaattatttggaaagtttcttatatatcatccatccactgaacaatcatataccgagtgcctccttttttagctagatacagtagaaggagctaggaatagagactggtagggtggaaagacaggaattttaatgtaatatatctataaactttatatgagaacaattatgattcatgcacgcaatatcatgatagcacataagtaggataccagcccataggctagggacaaaagtgggaacattctcaggaataaattctatttagaggagatacgtgagtgaagtctttaagaaccaattcaagtcagtttggagaagaacaaagagagaagtgattaattccctaattttgttccatctgtgttttgccaacttatatttaattctctcatgtaattaataaacaagtgtttatcaagcagtttgagattggcaagatggatttctttttttataaatacacaaataacatatgcttgagttataaaagtaagaaagtacagaaaatagaaaaaagatacactcatcattataactatattatactcctctaatttcttttcacatgtatgttataattatatatttttacaaaaatggggttatgctgactaatgttttatgatgagttctctaataaaaatttcttgaattttttcctatcagtaaatataagttttactccacatatatatgcatggatatattgtatttcattatattgtttacttagctgatccttttttgttgaatactgcttccattctttttgtttttgtttttttgagatggagtctccctctgtcacccagactggagtgcagtgtcacaacctcggctcactccaacctccgcctcctgggttcaagtgattctcctgcctcagactctcaagtagctgggattacaggcgcacaccaccatgccctgctaatttttgtatttttagtagagacggggtttcaccatgttggccaggctggtcatgacctcctgacctcaagtgatctgcctgcctcggcttcccaaagtgctgagattacaggtgtgagccaccgagcccagcctgcttccatttttttttcatgagtataaacaatacagaaatgatcatatttttgctcagtgattcattcctttgtaaaactttaaaatgctgattcaaagacatatgattttaagcatttgacataatgataaattttccccagaaaacgtatcccagttttaacaaccatattcaatatgttaatcttcatttcttcataccttttccaatactgtgaatgtacttttgaatgttttctgatgatataagaaaaaacatatcatttttaaagttgcataatgagattgaggtttaccatttattgttcaatattgtttcttttgtgaaatgcctacacatttcaggataaattttgccaaattcaaatgagttataaccatatatttgaaatatatagccctttactaagttgctttcaattctcactgatttagtcattttttcactaagatatttatgataaacacaactctcgtgaaaatgttttaagaaggctaaagtgaaattggcaagaagataacacttttgaagaccgtgctgggatcaggatagaattgcaagtgactgacaagtattttttaaattaaattatcatagctgccctagaagatagagcatattaataatgaaacttaaagataaggaacttaaagtacagagatactaaataatttacccaatcaatcagttagtaagatgtacagaaaggaattgagcccatgttgtctgagttcatatatgatatatgtatataaggttgcccatttgaagtatcacatttatctcaggctcctaagttcaatatcattattttcacttgcagttagtaaattttggagtatagttgacaccttattggcacttcttcatagtaaaagctattttgaaagtataagtctgggctgggcttggaggctcatgcctataatccaggcactttgggaggccgaggtggaagaattgcctgaggccaagagttcaagaccaggctgggcaacataaaaggccccatctctaattaaaaaaaaaaaaaaaaagactaaaagagaaagcataaatctgaatgtgccattaataaagttacatgtctagaacatagtagactgtgaagccatgaaatagcttaacagtaaaggaaagaggctttaatattttccttacaaatgaaagtatcttcaggttgtaaatcagaatttatgaatatggcaaataaacataatctgcaagttgtataatttctatatggagagcatctgacgattaaaaacaaaatcttgctgcagcaacacaaatgacatgtttgtaaattcaaacacaagccatgtgcggagagactacaacctttatccaaacgcttgtttgatacagcagagggccatgtgctgaaaatacaatctccacatgttaaggcccagtaatcttctaaattaatgtaatctgtatatatagagaaagtatatgatcacagtttctgaatctcttttgaggtttcttctgagtttcttcataggcatatatcaacattaataacctattttattttttaccaacaatagtgagtttatgtccttccagcacaatgctgcttttataagtcccattgagtttagtctacgaagcatatttactttcacatttccaaattagcagaattaaaatgttaaagaccatgtacctcataatggaagcagaaattcattaagaaataatttatgaaaatgaatcaataaagtaatccctaattaatacaataatccagtactgtaattgaattcagtttctttttgagaaccacttgtgactgtgtctgaaagctttgcagtgttttcaaattgttttgtaagaagagaaccctcaagattctttcagtggaggcaaaggcaaaaactcaggcttatcaatgtgtggggggactcccagaggcaacaagttcccaggggacctcagtatctagattagtgcttgccaacatgtaacatgtgccactaatggtaaagatgattgtatatagtataaagatgagcatttctattttaatagtcatacatttctttgaatacttattagaagcaatataactagcacatctaacccataatttataactgtagctagatgaagctatattttttgaaaattgctacataataaaagtttttaaaatattgtagatttatacataacaaagaatatttggcttatgattaaaaatgggttattaaataaatactgcatggacacatttatatatcaggaagaaaatcagtgaacctctgtttctaccatatatgagtaactactgaaagaataacatcttaaatataaaaataaaacaataaaagtgttgactaaactagaaaattatatgtaaagcctaatgatgaggaacttcctgagaatgaaaatttaagatatactttttaataagatggacatattcatatgtccatcacacacatacacacacaaaatctatggtacaacaaattatggcataaaaaaagcaaataggaaacaaagggaaaaaaaccatgcttgttcaatagaagtctatatttggtcagatgtatttatgcacttatataaaatgtatgtatatgtatgtatggattaaatcattaaaatatttttcagattatattaaaaataatatgagtgatacttgattatgttagaaataataaagttgatacttaaactactgaaaaatctccttacggtctttctcattctactaaattatttaattttgttctttataatttcattaaatgtcatttttatcttgcttgcactataaatatatttagcaaattctttattcacaggaaactaggagataaacttcagtttggtaacattgaatgagcacacatttgaaaggattgattttccaataatgatcattggcttggcttcctctttcacagagataatgaggccagtctctgcccatgccactgaaacttaaacttgaaaattttactcagtgatgctaaccatcaaaaacaaaataggaggcttaataggcataaaagttaattaaactatggttataaattttacaaatattaatttcttcaggaatgcaatcttttattattaaaaagcttttgtttttgtttttgagacagtcttgttttgttacccaggctagagtacagtggcacaatctcggctcactgtaacctccgcctcccaggttcaagcaattctcctgcctcagtctcctgagtagctgggttataagtctatacaaccacacttggctaatattttttttttttttttgtagagagggtttcgccatattgcccaggctggtctcgaacactaggcctcccaaaatgctggagttacaggcatgagccaccacgcctggcccaaaaacatctttatttgttgttggctgccatcactaaaccgtcttgaatcatatgaatcatcttacacatctgatgtgttatgtcaattatttcaggctttcttctaaaatatctgcttatttctctccaatatgttcagaggagttttgcctagccctagaaagagttaatgtatattttatacatatatgtttatatatatgtgtgtgtttatatgtattatatataaatatatatttatatataaataattatttgatggaaataataattattaaataattattaaaatatttattttgacaatgtatcatttagaataaaatgaggatagaaggcaacataccacctggctactttgttacaagagtcacaatgatgacagcttacctctcaaattaaaatcttattttgtaaacaaatatatctacatgcatctagtcaacaatgatatgcaaatcacatctgcttgtgcacacaatgagatatgtgtgagtgtttacgtgtttggcatatttgtcaataatataaaatattaagaactaagaaatgaccattatttttcccatctaggtactaatctattctagtgactataaattcataattttccccagcaaacttacttgttttccttgatttcccgtagtggtgaatgacaccactgtctgtttatttacctactttctagaaatagaacactaataatcaaatcattgaccttccccaccctcgatttatcatatcattacccctcccaacacaaacactctctaatcatcaaacaatttaagtcctgcagacactgtttcctggatattttaaaattccatctctttctctctattcttcgtgtcattctgagagtttggcctcttatcacaaaaaccctagatttctgcaaaatcttctaatttagcttctgagtcttaccccaactactgtgcccagctgtttaaataagctttccaaaatacaaatatgattaagatccttctgtaatatttagctctggcttgctgtgttgtttgttatgaagtccagcctcttcatttcagcactcgcaggcattgtaaatgtattttctgcctacctatctctttatccttttccctctccattttgctacaagtgtctttgcctccggcaatgtgaatagacctgcaatgtcatgaatgtaggcttctttcattctttaagcttttacacatgctgcccctttccctggcttagttgtcctcctcacagtatgttcccacagcagcctgtgcgtgacagggtcacacgattaacagtgctgtgattatggctcacttctctgtctgcctcagcagtctctaagacccttgagggaaggatcagatcttgtttttctgtgtccaacactgtcacggtaagcactcaatattcatttgtcaaatgataaaaggggacaaattcagtagttgagttagttgtagcaatctttcggtaactcatctatttattccagataggtataatgttattccttttgataaaaatattaactctaattacattttctaaacaacatataggaaaatatcagtaggggtgagtacattattggaactgatgcatttgagaaaagtagattattagatgcatgtgaattgctaatttcagtttatgcccaatgatatcttcagaaatgcatgctgtgaggtaaaaatttctggaaagatctaacttttacgaagtgattgcaaagtagatatccaagggaatttccagttgtcattatcagcaaagggttcagaatctatggaacatggacaatggcagtaagcaaagtataaagaatctcaaatctttaaaaattaaggagtatagagtctaggtccgtctttttcattatcataacatgaaacaatgtctggaacatagtaagtgcttagtaaacatctgataaatgaatgtatgaaagaataaatgcatgaatgttggagggataattgaataaataagtaaataaattgatcccattttataatatttagctatggtataaaaacaaaacaaataccaaaataaagtgtcttgaaaaatcatcacagacctcaatacagaaaaaaaaagagtaaaacaggtatatatgtaaataaaagaagttttgagaggaagggagataactctgaacataatttatagtactaaagtttcagtaaaggataagatatgcattgggtttgattagaaagataaaaatcaagtgttgacatttttcctgtggcctctgagataagactaagactaaatcagcctgttcatttctagttctaattgtgtgtctgtgatcttagtttagattatgtgtacacagaaaaaagtaaaaataaatactattatggttgtgactggatttcagtagttctttgatttatccatttgttatacattagtccttggaataacaaaggtctgagttctgaatatctgaaatttaagtgagaactaatgttagattaaataatacatccaacattaaaattcagtttagtgctgctgcataatctcataaatctaaatcacatactgatttttttttaaataactgtcctttggctgaagtaatagcatgaagtcgttgatgtgtatgaataacacagtaattaagttgtttttactttgttgctggtttgagattttgtcctgggctgtgagtgctagtccactgacatatggaaataacaagagcttccttttaaaaggtgctctttccaccataagtgcagggagagggaagtttatcctaagtagtatgattttcatggagttcagtttctctgtgttgtcagcagtacccttcacatggaaggaaatacattgagatagggtaactcctggagtcagctgagttggggtacccctctttgctcttcaaactcattttttagttttatttcaataattgttggggtacaggtggtttttggttgcacagataagttctttagtagttgtttttgagattttggtgaactcatcacctgagcagggtacactgtacccaatatgtagtcttttatccctcgttcccccctacaacccttccctctgtgtcctcaaagtccattgtatcattctaatgcctttgcattttcatagcttagctctcacttataagtgagaacatatgatatttggttttccattcttgtgttacttcacttagaataatgcccccagctccatccaagttgctggaatggccattacgtgattctgttttatggctgagtggtattccatggggtatgtatgccacattttatcatttgttggttgatgggcatttaggttggttatatatttttattcaaacttattttttaaaaaacagattcaaatgcaacttctcctcactagaatgtaaacgtcatgagagcagggactatattgccagtgtttagaatggtgcctgacatatagttaccattcattaggtatttacaattattcttgataccttagttccagctaatagaattgataaagtctagctctctgagttctagtcttgataccaccattttccagtacttatcacataatgtttctgagcctcagtttcctctttctaaagtgagaatgagactagctgccaaccaacctcaagtagatcagttgatatgatgtatgtgaattgtgtaacaaactgaagtgttgcacaaatgtattaatataatattgttaacctaacaaacaagtaaaaacttttgaagtggtcttttgttacctgccagcttagagttccccagttcatgtagatcaaaactgggattgccacaggttgcagaaggatgcctggacaaagaagtgagaatgtgtgcaaatctgacatgttctctctgcaagaaacactgagctctggtgtagcagccctgactgcttagaggaggcaactccttttaccaattagcaccaatggggcatgtggagtaactggagccatggcaaagatcaccattgattctccattatattcgatttagtgttaaaaaatatagtccctgttatgatgaaacctgctattcaatgtacagaaagggctgcaactttgtccttcttaaatcctatgggtatgcataccacaggggtgaacaaaaggtgttgatgacaacatatcactctgagtttctttaacctgttgtaaggtaaagcattatgctgttcatagaaagttgataaattttggtcctcaaaagtcagacttgtcaatgcaggacattttgttacctacttaaattctatctctgctgtgcatccagaaaaatataaaactttaatactgatatctttattaaaaatggatatgcatatatttaatagtcatcatcacaaaattgattatggtatactttaaatagcctttcttggccagccttttataataacacagataaattgtctactttttctggtgagagagtggggaaaaaataaggaattaggtagatacaacatgtatgtttttccaagtattttcatatttgcaacttttcagttatgttcagtatttaactgataagtacatataaataataatttttttgtttttaaaacaatttgctaacagccaaaagtgcatataatactattcaatagatgtaattgtgctaaacaaaggcagaattcttttctctagagtttaaatgtgggaagcaaaaactggacagtagaattatccctgtacttatgaacgtctctcaacaatacttatagttatttgtgattttgaatgatgaatgttctactgcctctccaactgctgtataaccagagcggtcaatatttttggacacaaaactgaatgcacttcatatccccgtgtgtctctaccagaacaaaacttcagggcccagaaaaactgagaacagctaccactatttctgttccctcagattatgtccccatccctttcccataataaagcttcctgcccttttttcaggcccccactgccaggactccacccattttctccattgtccactgcacagcgccatcatcattgtccgaagctaaatctttcccctttacacacccaacccgggttccattctgaggagggcattcctcctttctcagctcctactcctggagattctattgcagtggctaagattcaatggtgttctacatgcagaccctctgggggcttagcttaagggaagggagagcactctgcttattcacattaataagtcttcagataccgtgaggatctggtgatacaggttcagatacaaaacatgctcctggaataaatgcctgggaacggtaacacaaaagggcacaaaggggttcatttctaatacagtacacatttttggagcatctattccataaaaggcatcatgtggcattcagtattcaactctgcacaccaattcaataacatttgcttagtgccagtcattgtgctgggcaccagaggtatacaaatgaatatgagaagcttctaggagcttatgttctaatgggagatctggaaacataaacaggcaattgcaatataatatgccaatatgtgcaaaaagggtattctggaaacatccaggaaggacatttatctcatctcggaggcatatatccatggcttcctgaaagaactgaagcttgagctgactagcacttgctccacactagataaaatgcaaacatatttaaaagtgtgaggatgtctagagttttatttgtgtaacaattcagctgcataatactaaaaagattttggtaggttgcataatattaaaaaggttttgatactgagaccataaccaaccctcatacattctttaatcaaaatggggaaatacatttgtgctccaaataaccaccttacagaaatctttcaggacataatgcttatttagaaaaaaaaaatagcaccaaattatgaaagggattaacaaaaaaatggcaataatgtgcttttttgcaattggtagtgaatgcattaaaaacagtatgatttttacatgaatgaaaatgcatagttttacctattatgcattctgaacattggttgaagaaataaatttctgaattatttacatctcatggctttattgcaatggtagttatgaatgagtttagcatcagttgtgtactttgcaatgtaaaggctcttcaaataaatgaaactctaagcctccagggcttatattctcagttatataaccccaatgatcatatccacgaaaaagcagtttaatctcagaattttagaatttcatgtacagagcaaagaataaatggatagagctgaagtaatttcccctcagagagacattgtagaaagccatatttatatgtaagaatatttatcattgttatcaattaatagttagggagtttgtcattaaagggaagagttaacagctattgtgcctgacatattgctaagtactgcaactattttttatgatcatcctatgaggtagttttaatgatctgttttatagagaacaccgaggtgcagatgctagtacaaagttaggattcaaacccagcactgtcccatcctagcactacttttatttcctgtgccatatgcctctcctatgcctgattcatatttatgaaatgctggcttaaattattactaccaaatttaaaaaacatgtaatactttttaaagtttttactatgtcagttacttttctagattaaaagagcagaaattggcgaactctttttgtaaagggcctgttagtaaatgttttaggttttgtgggctgtatggtctatatcactcttgctcaactctgccactgtgggaggaacgcatagacaatagacaaaatgcaatatgaaaatgaatgggtgtggctatgttccaataaacttgagtcctgcaaagggagtaggtagcaaggtagacaatcaggtgaatttatttcagatttaagatgcagaatactcaaattcataagaactgagagatcactgtgagtcccaggattcacacaggttttgggtttgctggagtatacaactagaagggatgagtaatgggagctagggtttcttaaacgtagtgtgcaatctttgatacttcatgttttttttgtaatgttgagactatatacagggccttaaatatggaagtggaaaatatacatacaatacgatctgttatttttgcttcaacctcacgatagcgtgtctattgcacttaggattttgctatagggtacattcccttaagggcacttactgagtactgctatttaccttgaatattacatgctttcactttccattgatcttggtcactgtagaagggagggtcagtccctgatttacatttgcagaaaatgactagtttttagacaaatgaagtgatacctctagggtccccagcaaactcttcttccagcacccagtttgctgctccatccacaaccttttgctgtggagccatggcatattcttaatgccttattaaaataatctgataagatcttttctaattattctttattttcataggaactaaagtcatcttcaaaggaaaaaataatacaggaataccttgaagatacttcagatttaggtccagatcactgcaataaagccattatctcattaaaacaaatcacactaattctttggtatcccagtacatataaaagttatatctacactatagagtagtctattatgtatataattacattatgtctaaaaatatatacacactttaatttaaaaatactttatttctaaaaactgctaacaaacatcaaagccttcagcaagtcataatctttttgctggtaaagtgtcttgccttgatgttgatgtctgctgaccaatcatggtggtggttgctaaaggttggggtggctgtggcaatttcttaacaaaagacaacaatgaagtttgctgcatcgatggactctgactttcagaaaagatttctcaatagcctgcaacattgtttgatagcattttactcacaggagaacttctttcaatattggagataatcctctacaactaggccagttttttaatttactaagtttataaaatattctaaatcctttgttgtcatttcaacaatgttcacagcatctttaccagcagtagattccatttcaagaaatcactttctttgctcatccataagaaagcatctcctcacctgttcaagtttaatcatgagattgcggcagttcagttccatcttcaggctccacttctaattctagatctcttcctatttctattacatctgcagttgtttcctccacggaagtcttgaaccccttaaagtgatcatgagggttggaatcaactgttaaggaaatcctgataatgttgatattttgacctcctactttgaatcccaaatgtttttgatggcatatagaatggtgaatcctccagaagattgtaaatttgcttcatttagatccaagaaaagagtcgctagctatagctttacaaaaacgtatttcttaaaaaataactctagaaataaaaattactctttgatccatgggccacagaaaagatttttgtgttagggggcatcaaaaacaacattaatctccttaaacatctctatcagagctcttgagtgaccaagtacattctcaataagcagaaatattttgaaagaaatatatacatatattttttctgagtaataggtctcaacattgggctcgaaatattcagtaaacagacgtgctgtcatgcaggatttgtcattccactgatagattaaaaaactgttgttccactgatagagcatagacaaggtagatttagtataattcttcagagccttgggtttgtcagaatggtaaatgagcattggattcaacttaaagtcaccagctgcattagctcctaatgatagagttagcctgtcctttgaagctttgaagccaagcattgacttctctctaggagtcaattgatttataaaaatcctaaatggcatcttctttcaatataaggctgtttcatccacattgaaagtttgttgtttagtgtagccattttcatccatcatcttagctagatcttctggacaccttgcagcatatatcctctacattagcatttgttgcttcaccttgcacttctatcttatggagatggcttatttcactaaatctcataaaccaacctctgctaccttccaacttttcttctgcagcttccttacttctctaagccttcacagaattgaagagagttagtgccttggtctggattaggctttggctgaagggagtgttttggttggtttgatctattcagaacacttgaattttcttcagatcagcattaaggctgttttgcttttttatcatttatgtcctcaccagggtagcactttttaatttctttcaataacttttcctttgcactcacaacttagctgtttggtgcaaaaggcctagcttttggcctagctcagctttgaacatggcttcctcactaagcttaatcattgtagcttttgatttaaaagaagagatgtgtaactcttcctcccatttgaacatttagaggccattgtagggttattaactggcctaattttgattgtgtctcagggaatagggacgtctgaggagagggagagagagtagagatggccagttaatggaacagtcagaacacacacaacatttatcaatcaagttcaccttcttgaatgggtgggattcatggagcctgtaaacaattaatgggtgcaaacaaatacaacagtaacgtcagaaatcactgatcacagatcactgtaacagatgtaataataatggagtagtttgaaatattgtgagaattaccaaaatgtgacacagaggcatgaagcaagcacatgctatgggaaaaatgatgccaatggacttgctggacgcagggttgctacaaccctcaatttgtaaaagtgcaggatctgcaatgtgataaagtgaagcacaataaaaggtagtatgcctttacttgtatgcttttaatttctcacttcgatttccaaatctctttatggtaagttcacttagtaactagtcagtctttcatcaggatccactgcagggcaaattggctttgtcccatttaccaagagcttgctttagatcgtacagtctgagaaggatatgactgcagaaagtgtcatataaaaaataataaaatcctgtttcatagggaacactactagaatgatgaggtttgtaaaagacttttattcaaaagaactatgagaagtacaaatgaacaatggaataaattaataagtgatttcattaaaatgttctgctttacataattaagacttagatgttatagattattctcagtttaaatttcatgagaaataatttgcaggacaccaggaaatgttgctattttgctataacacacattttaacattattatgaattccaaagactcaaaaatgttcattattttctgtataaggaactgtgagtctcaagatggcacaacttaacgctatttgcataccacagaggcatattctgggtggagccatgttctagaatttttttttttcacttgcttgtttgcttttcgtttcaaatatcaggccttcttgctagagaatggggtttgatcctttcacaacttagaatttctcaggattaattgataaatttaataagcttgatgttttaaaactaaagtcatgctacctaaataatactaaaaatatattaaaatgcatttttttggcatttcatactataaattttcagttgtttattaatcctaaaatgatccctgtattttaggttctgagggtagtggattttgttgaataaattattgtagaatcatttaacaaacattataaccagaatttcattctgtttggtaacattcatgctttggacatttttaaatcattagataaaaattttctttttctgggataagtgaagaaagtgggtttcctttggagaaacattttattgtaaatattttaatttaacaatttttaaaatgacatgatgtaattaaattatataaaagctacaacctatagtagagctttctctgaaagctctatccttcacagaattgaagagagttagtgccttggtctggattagtctggattaggcatccacaaatattgatttttgatgaaagaataaaatatgtggtcttttacagttatagattcataaggtaaaaataatagggttatttgaatgttaaaatcttatttaaagaatctaatatttcaatttattgaaaaaatgaataatttggacaaatagctgcatttaatttctggtcaaattgtagttactctgaattctgacattatcatttcattaaaatatgttgatggcatatgcctcactgacctatggtgtttgcatgtatgtgcacacatgcatacatcttttaaaatatacacttttctacatgcaaatattttttaatccagctaacctaattatgaccagaagccatcccttggatgatttcagttttcagctacatctggaatttgagaaggaatcaatttcctctacaatttaatcaaaattttattttacacaactcattaatagtaatgccttaggtgtacatttaacttaaacttttaaaagataattttattgtatggtgaggagaccatataacatttgtcataggttgaattgtatcttcccacaaccttatgttgaagttctaattcccagaaactcagagtatgatcttaattggtcatagtgtctttacagaggtaatcaagttaaaattaggtcattaaggtgtgatccaatccattataactggtatccttatggaaaggggaaatttggagacagaaacacatagaggaagaatgccatgttaacatgaagccagccatctacaagccaaagagagaagcttaaacagattcttccctcacaggcctcagaaagaaccctatcaatactttgatttcagacttccgcttcctccagaactgtgtggcaacacatttgtgttgtgtgtaagtcacccagtttgtggtatgttgttatgtcagccctagcaaactaacatagcatttatttttttgccaaatgacaagtcagctttcacccatggttaagttttgttaagccctactcataagatggcctcattttattaccgaagtgctctttgagccattgtggcttctgaaatgatggaatatttctcagaaagtcatatatacctccagaaatctggcttgtgtgatgattttcagtttcactggtgcagagatgttatataaacctatagcaatgtaattgtgatcaattttggggctagcatattaactattgtagttttcttatgaaaactgccttagcaaaactctttaatgatctggctctttttatgatttgtagagtatttgaaagaagacatgtttaattagaagtaacatgggtaaaataattgatgctatttttgaagaacttcctctaacactgaaccaatgagtttaatatccaaatttgaatatataatgtgtatccctgttgttatcagattaaaaaagaaagtgatttttatgcaagaaaaaaatgattcctaaactgtttttcatttttcttatttttttctaagatagaagcagacattgaatggcagatatcttgcagagcataaccctagatcaatactattcaagggaggctgcttagtaggttccaaaaacatgagctctaaagcaaccacaattttataaagcctattttactgaatcagctatggcttgctgacactaatgcagttgtaatgcttgaataagcttagtcaaataaagcttatgaagctcactccacagaaattactgctttgagtgatttaaatgtcagaaatatgggcttgtcatttttttcccagtaaaatcctattcagataagctatttgaaatgatccgatagggaattcactgttccttgtaatactgacagtcccaatgcctagagtccaccctgcattgaccccaaggaaagtgacgtcctgcctgtctctagcagtaatacaaggttgagtcccccgacagtaaatatcaaattggttcttagaggacaagggtctcatttttcatttattttttaacctcctttagatgctgaggatgtaattttatcttgggaatgcttaataaaatgactgctctcctgcttagtaaaaactgaaatgttaagcagtgtgaaggggccagatagaaaaagtccattcattattttatttatatctttgcttttaaaagtcagtttctatcagcaatgcaattgcccagagaaaaagccttttattagttgccaatgagtggcatttcttcctcacaaaaattttaagacccccatcttaggtctatttggacgagcaggatgagaatgttgaagactaagcaatacacagtactttgaaaactctgataatgagtagacttcagaaaattggttctttttaactcttctttttcagtttcctttcatatcaaagaggaaaagaatacttgtccccactctctaggtgggtgcagctttatcggcctgtttctaaaactgtgtgagctttttagaagaaaggtgttgtataaagtattatttgtgtttacctaattgcttgctcttttgaaatatgggcatgaataccttaatgttcttttcagaagcacataaaggagcttcaagctcatttaaaagtccttcgaaaggcacagggagctgctggtttttttcttcatagattaaatgataaaaacaaaacacataggaaaccttatctctctaaattttcaggctgcattttcttcctaaaatacgtgtatttccttcgtgagatgtgtatactcaatccagaaagatagaggtttgggcaaaactatcatgatctgttctaaaccttttaaataacttaataaagatttgggactgggcatggtggctcatgcctataatcccagcactttgagaggctgagacaggtggatcatctgaggtcaggagttcgagaccagcctggccaacatggtgaaaccccatctgtactaaaaatacaaaaattagctgggcgtggtggggcatgcctgtaatcccagctactcaggaggctgaggcaggagaattgcttgaacccaggaggtggaggttgcagtgagccaagatcgtgccactgcaccccagcctgggcaacaagagtgaaattccatctcaaagaaaaaaaaatatttgggttcaggtaaaacaaatataatgatatgttaatacaatggtgtccatatttaaatatatattttttctcacaaaattcttaaatattttactatatgagagagaaaaatactctatggatttgttttctacacaattgtggtaatagcattaattctggagtcactaaagaaagtgccaatttatattactgacaaatttatattactgataattaaagatgcatgaaagtagacatattttattataattttttatatcaaagcgcttgggctactcaataaattcagtcctttccctgtttactgattatatattttaaaacagtggtttccattctttttggcaccagagaccagttttgtggaagacaatttttccacaggccagggcaggggacatggtttcaggatgagttaagcacattatatttatcgtgcactttatttctattattactactatcattattattttttttgagacagagtctcactctttcgcccaggctggagtagaatgggcacggtcttggctcactgcaacctctgcttccagagttcaagcaattctcctgcctcagcctcccaagtagttgggactataggcatgtgccacacacccggctaatttttgtatttttagtagagacggggtttcactatgttggccaggctggtctcaaactcctgacctcatgatctgcctgcctcggcctcccaaagtgctgggattacaggtgtgagccacagcgactggccctgtttctattattattacattgtaatatataataaaataattatacaactcaccataatgtagaattggtagaaactctgaagtgtgttccctgtaactggacagtcccacctgggggcgattggagacagtgacagatcatcaggcattagattctcataaggaaccaacaacctagattcctcccatgcacaattcactatagggttcatgatcctatgagaatctaatgccgctgctgatctgacaggagatggagctcaggcggtaatgcaagccctggagagtggctgtaaatacagataaagtgttgcctgcccacccgctgctcacctcctgctgtgtgacctggttcctaatgggtccgtggcctgggggttggggactccagctgtaacatatctctagtcatatacacatacatattaaaaattgtaattgttaaattatcactacttttccaacaaatggatggaaatttccttataagtagaaaatataggactactatcatttatatttaaatatatttttaaaaaacaggttgcttcatcacatttgcctgaatactgaaaaaagtaaaatttaaaaaagaaacttgggtcttagttcttgcacttccataaatttcctgaaagtagctattggcaatatgaggaatctacaattttctgcctacagtcttaagcagaagctttatatgaagtatttatcattactagtgaatacatctgcatgaacttatggttaccttgtgtgcctttgaaggagggggactgtcatactctcttacaggtaataaaatagaatctactgtgacacaatagtgtgattatgactccatgtggggtaaagcagcaggaaatgattaattcttaaggaagagctgatttccatgaaaatatctttaggaaagagaaagtaaaaaacgcacattagagtcaacaaatcatgaaaagctcatgattctgaagcattcagcttagtatttttttccaaattgaaatggcatgtcattactcaaggcttttctgtttcagtgggtttgcaattcaatgacaatgggacaatttagtaggaggaatgctggggctaggtaaagttttatttgtgcaaatttggcccaggaagaaaatgtgtcagcacaaacataaaatactagaaaattaatttcccaaatgaactgagtatagttcatggatcttatgtttatcttattcaaatgatatttgctaagaaccagagccttgctactatatccgtgagattgaacccacataatttgggagattttctgcagattctttccgcaaacttctaattcacaaagttgggcaaatcctggaatggcttatcttactgcatgagacttcctgggttcatgagaggaagatgaataatttttctacaatgaaactgattcaacctgtcaaatttattttcgtaaaaggtcttttcatgggtcctgttaatttttatccctaatctgtcccactgtacatagtgccctctgacattttgatttaggctacttgggcatgtagtggtaataaggaatcctggccatgatttctgttattttaacatgaaagatatttattctattaaaatagccaagcttatcaagtttaacatatactaatagtcttttacagcatttctttaaacattcccagaaaaagatacatgctatggactggtttgcattcagccctgcccgataaaactttcatgttgaaatccttacccttaatgtaatggtatttatagataggggccttcaagaggtaattagtttagaatagccttcagactctcagaagtaaatgtctcctgtttaagcacactagggatagtattttgttatggcagcccaagcagactgagatcataaatcatcacacatttgtaaattgatgatcaggatttttattcattttgtaaagtaaaaataaaactctaaatccccaacttactgaatggctccttcctctctgcccagggaactccaaagtaaacctgaaaaactagttcaggccatgatgggaaggaggtgtcagacatgtctccttatatctccttccctttggaattcaggtgcaacttgccagcattaacattaaaacagagatttttaagagttgcgaaacagactctttgtagcaataagataccagattccaacttgactagcatagcatcatgtgacagatagcagaccctacaagaaataaaaatattgtaccccaaaatatatttgacatattttgaaatggccttattaggctgtctcttgcggaaaatctacattctgtagagaatttccctccctttccagatcttgtcctgatgcaggagagagtaactgagagtctagcacattttggggtctgataagagacatttgccatctattctctctgaagcctgctacctgaaggcttcacttacataataagaaacttgatctccattgtcaggcctctgagcccaagctaagccatcatatcccctgtgacctgcacgtacacatccagatcgacagttcctgccttaactgataacattccaccacaaaagaagtgaaaatggcctgttcctgccttaactgatgacattgtcttgtgaaattccttctcctggctcatcctggctcaaaagctcccccactgagtaccttgtgacccccactcctgcctgccagagaacaacccccccttttgctttacctacccaaatcctataaaacagctccacccctatctcccttcactgactctctttttggactcagcccacctgcacccaggtgaaataaacagctttattgctcacacaaagcctgttggtggtctcttcacacggacgcacatgaaatttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggtaagcagactcttcttactctcttctccaacctctctcactgtccctcaaccactttctcctttccactcttcaatctcttccttctcttaatttcaattcctttcattttctggtagagacaaaggagacacgttttatccgtggacccaaaactctggcgccagtcatggactagggaaggcagccttcccttggtgtttaatcattggagggacacctctctgattattcgtccaggtttcagaggtgtcagaccacgcagggacgcctgccttggtccttcatccttagtggcaagtcccgcttttctggggaaggggcaagtaccccaaccccttctctctgtgtctctacctcttttccacctttctggggggcaagaaacccccaaccccttttccttcaccctgagcagcaagtcccgcttttctagaggaggggcaagtaccccaacctcatatctctgtgcccccatcccttatttccgtgccccaacctcttatatcgctgtaccccaatccattatttctgtgccctaacctcttatatctctgcaccccaatcccttatttccatgccctgaccttgtatctctgtgccccgacccctttcccgcttttctggagggtaagaacccccaaaccccttccctccatgtctctactctcccttttctctgggtttgtctccttcactatgggcaaccttccaccctccattcctccttcttctcccttagtctgtgttcttaagaacttaaaacctcttcaactctcatctaacctaaaatctaagtgtcttattttcttctgcaatgccgcttgaccccaatacaaactcgacagtagttccaaatagccagaaaacggcactttcaatttttccatccttcaagatctaaataattcttgttgtaaaatgggcaaatggtctgaggtgcctgacatccaggcattcttttacacatcagtccctctatagtctctgttcccaatgcaactcatcccaaatcttcctcctttccctcccacctgtcccctcagtcccaaccccaagcatcactgagtctttctactcttccttttctacagacacatctgacctctcccctcctcgccaggccgagctaggtcccaattcttcctcagcctccggtcctccaccctataatccttttatcatctcccctcctcacacccggtccggcttacagtttcattccgtgactagccctcacctgcccagcaatttactcttaaaaaggtggctgaagctaaaggcatagtcaaggttaatgctcctttttctttatcagacctctcccaaatcagtgagcatttagactctttcatcaaatatgaaaaacccagcccagttcatgactcgtttggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaatcaacctcgccttcaaggtgtacaataatagaaaaaagttgcaattccttgcctccactgtgagacaaaccccagccacatctccagcacacaagaacttccaaatgcctgaaccacagcggccaggcattcctccagaacctcctcccccaggagcttgctacaagtgccagaaatctggccaccaggccaaggaatgcctgcagcccaggattcctcctaagccacgtcccatctgtacggaaccccactggaaatcggactgtccaactcacccggcagccactcccagagcccctggaactctggcccaaggctctcagactccttcccagatcttcttggcttagcggctgaagactgacgctgcccaatcgcctcggaagccccctagaccatcatggatgccgagcttcgggtaactctaacagtgaaggataagtctgtccccatcttaatcaataccaaggctactcactccacattaccttcttttcaagggcctgtttcccttgcctccataactgttgtgggtattgatggccaggcttctaaacctcttaaaactccccaactctggtgccaacttagacaatactcttttaagcactccttttaattatccccacctgcccagttccctattaggccgagacactttaactaaattatctgcttccctgactattcctggattacagctacatctcattgctgcccttcttcccaatccaaagcctcctttgcgtgctcctcttgtattcccccaccttaacccacaagtataagatacctctactccctccttggcaaccgatcatgcaccccttaccatctcattaaaacctaatcacccttactccaatcaatgccaatatcccatcccacagcatgctttgaaaggattaaagcctgttatcactcgcctgctacagcatggccatttaaagcctataaactctccttacaattcccccattttacctgtcctaaaaccagacaagccttacaagttagttcaggatctgcgccttatcaaccaaattgttttgcctatccaccccgtggttccaaatccatatactctcctatcctcaatacctccctccacaatccattattctgttctggatctcaaacatgctttctttactattcctttccacccttcatcccagcctctcttggctttcacttggactgaccctgacacccactaggctcagcaaattacctgggctgtactgccgcaaggcttcacagacagcccccattacttcagtcaagcccaaatttcatcctcatctgttacctatctcggcataatctcataaaaacacacgtgctttccctgctgatcgtgtccgattaatctcccaaacctcaatcccttacaaaacaacaactcctttccttcctaggcatggttagtgcggtcagaattcttacacaagagccaggaccacaccctgtagcctttctgtccaaacaacttgaccttactgttttagcctaggcatcatgtctccgtgcagcggctgctgccaccctaatacttttagaggccgtcaaaatcacaaactatgctcaacttactctctacatttctcataacttccaaaatctattttcttcctcatatctgacgcatatactttctgctccccggctccttcagctgtactcactctttgttaagtcccacaattaccattgttcctggcccggacttcaatccagcctcccacattattcctgataccacacccgacctccatgactgtatctgtctgatcctcctgacattcaccccatttccccatatttccttctttcctgttcctcaccctgatcacgcttgatttattgatggcggttccactaggcctaatcgccacacaccagcaaaggcaggctatgctatagtacaagccactatcccgcctctttgaacctctcatttcctttccatcgtggaaatctatcctcaaggaaataacttctcagtgttccatctactattctaccactcctcagggattattcaggccccctcccttccctacacatcaagcttgaggatttggccccacccaggactggcaaattagctttactcaacatgcccggagtcagataactaaaatacctgttagtctaggtagacactttcactggataggtagagtcctttcctacagggtctgagaaggccaccacagtcattttttcccttctgtcagacataattcctcagtttagccttcctacctcaatacagtctgataacagacaagcttttattagtcaaatcagccaagcagtttttcaggctcctagtattcagtgaaacctttatatcccttacggtcctccatcttcaggaaaagtagaacagactaaaggtcttttaaaaacacacctcaccaagctcagccaccaacttaaaaaggactggataatacttttatgactttcccttctcagaagtcagacctgtcctcagaatactacaaggtacagcccatttgagctcctgtatagacgctcctttttattaggccccagtctcattccagacaccagaacttagactgtgccccccaaaaacttgtcatccctactatcttctgtctagtcatactcctattcaccgttctcaactactcatacatgccctgctcttgtttacactgccggtttacagtttctccaagccatcacagctgatatctcctggtgccatccccaaactgccactcttaactcttgaagtaaataaataatctttgctggcaggactatgctgatctccttaggcactctctaagcagatgtcctgagtcatcccaattcttagaccttttatacctgtttttctccttctcttattccgtttagtttttcaattcatacaaaactgtatccaggccatcaccaataattctaaattacaaatgttccttctaacaaccccacaatatcaccccttaccacaaaatcttccttcagcttaatctctcccactctaggttcccacgccccccctaatcccgctcaaagcagccctgagaaacatcgcccattatctctccataccatcccccaaaattttcgctgtcccaacactttaccactatttcattttatttttcttattaatataagaagacaggaatgtcaggcctctgagcccaagctaagccatcatatccctgtgacctgcacgtacacatccagatcgcgggttcctgccttaactgataacattccaccataaaagaagtgaaaatggcctgttcctgccttaactgatgacattgttttgtgaaattccttctcctggctcatcctggctcaaaagcgcccccactgagtacctgtgccccccactcctgcctgccagagaacaacccccctttttcctttacctacccaaatcctataaaacggccccacccctatctcccttcactgactctctttttggactcagcccacctgcacccaggtgaaataaacagctttattgctcacacaaagcctgtttggtggtctcttcacacggacgcgcatgaaatccataactccttatcttaacccagacacacctgtctattgattctgggttgttagataataaactaactcttacttaactttttcaaccagctgtcaatcagaaaatctttgaatctgcctatgatctgcccctcacttcgagtggaaatgccccccatttcgagttgtctcactcttctgaactgaaccaatgtatagggtacatgtattgattattggttttgcctgtaacttttgtccccctaaaatgtgtaaaatcaagctgtaacccattcacctttggcatatgttcttgggacctcttgagatgtgccttgggccttggtcacttatatttggctcagaataaatccattcatttattttacagagtttgattctttttgattggctatctacccatttaatctcttcaatctggttttggaaacctctcccagatgttgccacttggaaatttaaaaggtttaataacatctgaaattgtctccttacaaaaagttttctctgtttgatgattggcattatttactgaatatatgctttctttctgtcatttttttctaaaacattagtctttcctccactgttgtagccttctttggaccagcaaaactttgcagttcttatgagattctcttgaacagacatgtttttacttctaccactagcatacctctcatctcaacgttttctcatatcatgaaaatgttttctttgctacttatttatttcttggattagaggtcactatataccgcataaccttctatatgcagaaatattgaggttatttaacatgacactttttaaagctgatttcctgtagcaacacttctaatatttctcatatttaataactattggggccttaactgtgcaaaatgtgctatgctaagtgctatgaaaggatagatgacttgatccctacctagggccttgttgaagaacaaagatctataaaaaaagtcagaataattttgttcacatcacagtattcatcaaaaaatgctatggtattacaagtaagaagagtagagttcaggtcaaaagattaaggaaatattgtcaaggagttgacatctgaggtaaatcttggaagaggagttagatttaaacagtgggaatttaataagattgttttaaaaaaataaatacagattcatcaggaacttttggccactttaaattagtaaaatgcaatgggcttcacctgtaatgtctcaggaattcaatatctctggcttcaaaaaatgaattctagccaagtgtggcagctcttccttgtagtctcagatgcctgggaggctgttgggaaaggatcacttgaggctggggtttgagaccagcctaggcaatacagcgagaccctgtctctagaaataataaaaaattaaattaagaaatgaattctagttttcaacctaaaataattaaaagtatcataatctaataatttaaagagagtttcttcaagtgcaaactgtgaggatggaccacttggaaacaccaactacaaaggaatgaagtcagtgttccaaagtagagaggttgaggctttatttacatagagaagaactctaagcagttttccaacattatttatacaaggttgttgcatagttacagctatttgattggtgataggcagggtctctttttgacagggtacatttaatatatattttataaagggtataataatcatggttttctgtcatctgttctaagcaaaccaggacaacaaagaggaagttaatctataacaatgtcattagaaggcaagaggttttccctgatgtcatttaattctgtctagccattgcagagaacaagaaaaatatgcaggtgagttaatctataatctgagaagttgtaactctaggtaactcagatcacagtcccatctttctcaaggcttaaagtgttttttgggggttctaaattttaaattttagcttttaaattttactagcctttaaattccagcttttaaattttactgattttacatagttatgctctcatcattgcttttcacctttaaattcaatttactgtttgtagaaaaaatagtgttctgaatggtgaggacctgctaaattgaaaatgtaaagtcaaagaccaataacgagctctgaaatggactgaaatggtcagtaacaagtaccctactgaccaaaaaaagcctgggaccagatagattcacagctgaattctattattaattgatatacaaagaagagctggtaccattccttctaaaattgtgtattagttccttttcatactgctataaagaactgcctgagactgtgtaatttataaaggaaagaggtttaattgactcacagttcagcatagctggggaggcctcaggaaagttacaatcatggtggaaggtgaaaggaaagtaaggcaccttcttttcagggtagcaagaaggagaagtgctgagtgagggagggggcagagccccttataaaactatcaggtcttgtgagaactcactcgtcacaagaacagcctgggggaaactgcccccatgattcaattaattccacctggtctctctcttgacatgtggggattatagggattacaatttaagatgagatttgggtagggacattgagcctaaccacatcagaggcactcctctccaactcattatatgaggccagcatcatcctcataccaaaacttggcagaggcacaacaacaaaaaaagaaaatggcatgccaatgttattgataaacattgatgcaaaaatcctcaacaaaatcttgcaaaccaaatccgtcagcacatcaaaaagctaatcgatcactatcaagtagtcttcatccctgtgatgccaggttggttcaacatatgcaaatcaataaatttgattcatcaaataaatggaaccaaagataaaaaccacatgattatctcaatagatgaagaaaaaggttctgataaaattcaacattcctttatgttaaaaattctcaataaactaggtattgaaggaacatacctcaaaataataagagccatctgtgataaacccacagccaacgtcatactgatggggcaaaatctggaagcatttcccttgaaaaccagcacaagaaaatgatgctctctcctaccactcttcttcaacatagtattggtaatcctgtccaggcaagagaaagaaataaagggcatccaaataggaagatagaaagtcaaactatttctatttgcagatgacatgattctatatttaaaaatatcaatagtcttggcctgaaagctccttaagctgataaacaacttcagcaaaatgtcagaatacaaagtaatgtacaaaaatcagtagcattcctatacaccaacaacagccaagctgacagccaaatcaggaaggcaattacattcacaattgccacacacacgaaaaaaccacctaggagtacatgtaaccagggaggtaaaagatctctacaatgagaattacagaacactgctcaaaggaaacagagaaggcaaaacaaacagaaaaacatcccatgctcacggataaaaataatatcattaaaatggccatactgcccaaggcaatttatagattcagtgctgtttctatcaaactaccagtgacattcttcacagaactagaagaatattttaaaatatgtataaaaccaaaataagggcccaaatagccaagacaatcctaagcaaaaaggaaaaagatggaggcattacattactcaacttcaaaccatactacagggctacagtgagcgaaatagcatggtactcatacaaaaacagtcacatagaccaatggaacagaatatagggcacaaaaataaggccccatacctacgaccctctgatcttcgacaaagctgacaaaaacaagcaatggggaagttatatgtaaactcatgtcacatgactccctactcaataaatgatgctgggataactggctagccatatgcagaagattgaaactggacaacttccttacaccttatacaaaaatcaactcaagatggattaaagacttaaatgtaaaacccaaaactacaaaaaatctggaaaacaacctaggcaatatcatcctggacataggaatgggcaaagatttcatgacaaagataccaaaagcaatagcaacaaaggtaaaaattgacaaacaagatctaattaaactttagagcttctgcacggcaaaggaaactatcaccagaatgaacagacaacatacagaatggaagaaaatttttgcaaactatgtatctgacaaaggtccaatatccagcatctataaataacttaaatttacaagaggacaacaaacaactccattaagaagtgggcaaaggacatgaaaagacacttttcaaaaggagatatacatgcagccaacaagcacatgaagaaagctcaatatcactgatctttagagaaatgcaaatgaaaactacaatgagatactatctcacaccagtcagaatggctatcattaaaaagtcaaaaaataacagatgtgaggccgcaaagaaaagggaacacttatacactgttggtggaagtataaatttgttcaactattgtggaaagcagtatggtgattcctcaaagaactaaaaacagaactcattcaacccagcaatcccatactgggtctatgcttagagaaatagaaattattctaccttaaagacacatgcatgcaaatgttttgcagcattatcaaatagcaaagacatgaaatcaacctaaatgcccaccaatgacggattaaataaagaaaatgtggtacatatacaccatggaatactatgcagccataaaaagaacaagatcatgtcttttgtgggaacatggatggagctgcaggctattatctttaggaaactaatgcaggaacagaaaatgaaatatcgcatgttctcacttataagtgggaactaaatgatgacaactcatgaatgcaaagaagggaacaacagacactggggcctacttgagggtggagggtggcaggagggacaggagcagaaaaaaaataattgttgggtaacgaagcttagtactggggtgatgaaataacctgtacaacaaacccccgtgaaatgaaatctgccttgaccttgcaatttccaagccactagaactgtaagaaataaatgtttcttgttgatagctacctagtttatagtattttgtcaaagcagcctgagcaaatgaaggcacttgctgtgatttgatagcctacttctcaacagtgctaatgttccttcttattttaactcctgtaaattcactttccccctaccttatgaagttggcattttcttttttttttattttattttaagtttggcagtacatgtgcaggtgagttatatgtaaactgatgtcacatgtctcctgacacttttcatgaaagccctaaattgccacccactccatccactgttccattaagtgaatttcactcaatccactgttccattaagtgaatttctttttctagtggtgggactagaaatggaaccagcccttgtttcccagacctccctttcctggcagtagaccttcattgctatggtctgaatgtttgtgtctctccaaaatacacattgaaatcctcattcctaaggtgatggcattaggagttggggccactggggagtgattagggcaggaaggtggagcccatgaatggaattagtgaccttataaaagcggcctgggagagactcctcacccgttccactcaatggaagagtgaatggagtgggtaggtaggaaggagtgccagataatgttaaaataaatagataaataaaataaaaataaaaataaattaaaaaagaaaaaccatacatatgtcaacctcagcagacagactaagtggcaaaaacatcctctgaaattgcattatgataatcatatcccaaaaacctgggagaaaaggtggcaatttagggcattcattaaaagtgtccagagactagtttacattttgtaaacactagaattggtaaaaaacattttaagttaaataatgaatttattatgtttgagctttatctgcccaaatgtctttccacttgaatttctatgaagttcttatttacatgcatgtattttggaacacaaacaatatagcaagagtcaccttttcatgtgattgggaattatgttcttaaagtaatttgggaataacacatataatgccatcagtagtatatacttcctttctctcatttgctctacacatcttgaaagagagatacagtgtaagagtactacacaaaccacatcacagggtgaaatgcaaaatcataattaatgcttttatgtaatgagaatgcaatgtttcatttataccattctagaatgtaggtgtcttccttgagcatcctgaaagagattgtattgtcagtgtcccacaggaaaaataaagaataataatatggaagtgcacttggcagtttcttcatctgatcgataaggcatcatgaggttaagtgacttctatcaggaggcttatggcttattcttctgcatataacctgactctagagccagtctttagatccattatataagcaatccctccttttactctataggaaagagtcgcatggccattaagtgagatccctacttcttttgaggctgattctgtctgacaatcaaaattttgtatgaaatcaaaatgaatagaattaaaaagcaggcctggaaagtgctttacatatcctagctgctctgctccaattctgagataccaactttcaagaggcatagcccatgtcaaattgctcggtaatatttacctctcattttttctgccatatcaataactagctcttgtcatctttaaagtgcttctcaaacattaaataatctcagatcacatactctgttctttgcatttatcttgaccagctgtcagagaaggcaatttattccctctcaattttattcctcttggctctgtgtggcttctgcagtaattttgaatggaaattgaaaggtacaacttaatgtgtttcataacaagggcaacacataattttctttaagaaggatgaccttcagattactttcaaattgcttatagctttggggttgtatactcagaacatattttcagtatctttgagtcatgattaattcttaagtggaaattttgagggtgtgaagattaaaaaaaggacaatgaaaaacataacagtattaatttatcattttcatctatttaaaaattgtaccataattggattggaaggatcattaagtgaatacaaatttagaattcatattatgtcagttgtttagaaaacgtaaaattcatttttaactcagagcttgcatttctgaatatttatactttctcaattttttgatcaaagaaaggaaaatgtgtgtatatatatatatatatatatatatatatataaattcatgttctgttttaaatgtttagcctttttacaatgtgaccaggattcaactcattcatatcaaatctcagtaaaattactccttgagtttcggtatacaaagcaggtatgtgtaatactgtttacagaaatagtctctaatatacaactcaatacagtgaatctgaagtgcaaaagcaaattcttgtgttctctgcttagtggtagtaggaaggcttccagtggttaaaaaactgcagattacaacatatcaactttcaggtgggccagtcctaaacactcataattggtttactttgctgcaaatcattattccaaaggtttgattcacttgtagccccacttgggtcttaaattgcatttcaaagcactcctatcattcatccattttcagaactaccattaggagtgatgtgaatttggcacaataatcaatgagaagatattatatgagtccttttaaaattttccttcttgagcaccacctcaagtgcagtttgtgaaatctgggttttagaagtattttttttatcttgctatcattttcactaagttaagttcaagaacttcggatatgtattccacagttttttttccgaaaagagatttgttgtcactattgttaatttctacctaaagccatttaaacatcttaattaaattattttgctccgatgttccttatcagcttttgaattttttgaaaatatggggctaaatttatcactgttatctaaaaaataactaaaaaactaattttgtttggttaccacctgttagtatgtgctcttgaatgcatttgattttctttcctgattagtcatagaatttcatgttatttatctcatttttgtaaagagaaggatagtattattttatgactaaagaaaccagaagagtaagactttattaactaaagtatttaattttgctggcagtgttatttctttctccaatacttaaaaattatcttataaactgcacttatactacaagcatcctgtgtacatagctgtttgaagggttcaaatattatttttctaatttaaggaattcagttatagtgataatgtttgtaccatgatgaaataactctatttgccatagatcatcttttctaattttgctaatgggataaaacagcctctacttgtacggataaattatactgtatgttcctctttgcctgtattacaagcagtcaattaattgattggaaaggataccaaggaagtcagagaatccttttttgagtccctgaaaatatcttagcctaatgtatgtgcttattaaatggaaacaaatgcctgcatttattgaagagttggtgcttccacctttgtttccgaggttaatcctgcctttctagccttttcttagagtgatatttgtagttgtagtgagagtcatagttgtgctggtagcaatgaaggtgatgtaataaatgaaaatagtggtgatgataataatgattatgatatagctcagtagttgttgtattgtcatttattaaatgactaccatgtaccaggaaatgtgtcaaacaatttgcatgagttatttctccaccatcacacacctgcaaattgagtcttaccaatctcattcatcagatctagatgcttctcactcagagatgtagtgtaatagcgaccttctagccatttgggtaatgcagagagaagccaggagttaattccaatctcttatctatgaagcccaaagcataacttttttgcttgactgtttccatggaaaagctagacatacctgaaaggaagagttgtgatggtagagcaagagactgatggaaagaagcactttaattccaccctgtcttcaaagagcacaaaggctaaaatctttcaattattattggacacattctaaaagaaactacagctactctttccagttgggtaaaactgactttgtgaaaaatgttaaagaaatttgagaatttagattttcttatgtatccatcacatagagatgttgcaattttgagataaatagtaaaattgaaacaatgtaatcatgtattttatattgaatcaaagttttctttcttggcatgtaattcttaaattattatagacaatatggtctgtattttaatacacaaaaatgttttttaactttgcttgtggcaaaaatatttggattggtagagttttattttcccttaagtattcaattacttacttcacatctgtataatttgggatttaaagtgctatgaacatgattttaattttctagtaggtctgcaattgttcttaaatgtaacatgaaatagttgttccagatgatctctcagttacttctagatttaactttctacgagtcaagtgtagcccagataatgagacatgttttctctccatccaggaggctttctagccatacagtagtatcaattttatagaagaagaatgagttacaccattgttagatgtacgttctgtatattaaaatagcattaaaagaaaaggtaaagagtcaccaaaaaaaggcaacataaaggttaaagtgttattatcttacatatgtgtgtatgtatgcaattttataaaccaccaaaaggaggtttacagaaaaatggaggaaaaatccacaagaaaagaaataccaaggaaaaacgaacatacaaacagctcatttctagtaatcaaatattgcaaataaaattcaaatcttctcttattgcaaaaattttaaacatcactgatagtattgtcaaggataaggtaacaaaactactggcatgcacaatttttaaaagatactaactttcaaatacgtgcatgtattctcaaagctataaaagtgattatgttatttgtcccaggaattctatatttaggactttctcctaaagaaataaataataatatgtgctgagaaaatttctgccctatcccaaggtagaaaactttttgattaaattatgcacagccataaaattacatgtcatgaagccacttaaatggtattttgagaaatacagaatggcaataaaacacacttctgatatattgcctagtaaaaaaaagtaaaagacaatgtgctaatgacttgtcaaaaccagataaaccatatttatatatttatatgtatgtacagaaatatacgtgcaaaatattaacagtggttatttctgggtggtgagattaaaactatctgcttatctatttattttatttttatattttttgaattttctctcatgaacatgtggactcttaaaatcaggaataaaagaggtactggatatagtaagactttctaacatcattatcttagatcttctgtgcccctacaaacaaacaaacaaacaaacaaacaaacaaaacatgaatgacctcattagatgacctcactagatgggtcaattatacaattaagttaaaatattcagaagaagttttatccatttgaaccattttatcacttgtgttgattctccctcagaggacttaggagatgagaaacactgattatatgagcgcacgagttttagggagaatagtaaatgctgaggaaaagataatgtgttagtgggcagggaggctttgtcctgccactaaggagttgtgctgctctagaaagcagtataaacaggttcagcactcatatagtcagtgtttctcatcatcaatatttaccatgaatctctaaattatattttcctttctgaatgtttgattaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcaggtaagttccataaaatttggctttaaaattaaaattaattcaaatggaaagaaacagtgtcccctccagttcctgcttggtttctgtttcatcttagtgtgaggaagaaacaccccacaaatgtgcttgaggatcactgaaatctgtttcattcttccctttttcctcctattctctttctttgttggtggtacttattgatttccaatgaaattgatatccttatttgcaagagctgaacaaagcctgaatgttgcagttcataaagataatagttaaaaagcttgggtgaagatttcgtttggaactggtactttatcaagcattaataaggaataatttgtaggttttacacttggcaatataaaaccaaaccaatcaaaacacttttggacaaatggaaaatattttaaagtatttttaagccctgctgtcatctggtcctaagtgtccttgccagacaaactctttgcttctgccaccggccatcctattttgagttcctgaaaataaagagagtttttcacaaaattacatataattgttcattttttgttcaatgatattttacatattttaaactgtatttatttattttgacatatgacaccctctattgactgtgagctccctaaggaaaggaatcagccaagtgctgagtaaatgttacatgactagatgagtgaatttattcttatcacttttttaccataagcgaaacatttcattaatcttttaatgtgttctctcatatgtactctcccctccccttttttctttctccaacaggagtagaatcagtaggacccagacactataaatactagtaattgcattctacatattcagggttctcctatttctcattatggaattttactcattcagcaatcaaatgtgtattctttgtgtcaggagatggctatgccacagacctcaagaagaaatacaatataaaattatgaaaatagaactctgttgtttgggtttattggcataaaggtgtgatatagtttggatatgtgttccctctaatctcatgatgaattataatccccagtgttggacatgggcctagcaggaggtgactggatcacagggatgcattttttagtgagtggtttggcactgtccccttggtgctgtcctcacaatagtgagttctcatgagatctggttgtttaagtgtgtggcacctccctgctccactctctccctcttctctggccatgtgacatgcctgctcctctctcctccttctaccattattgcaagcttcctgaagccctcccagaatccaagaagacaccagcatcatgattcctgtacaacctgtataactgtgagcctattaaacctattttgtttataaattacccagtcttaagtatttctttatagcaatgcaagagctttatagcaatgcaagagcttaatacagaaaattggcaccagtagtggggtattgctataaggataccagaaaatgtggaagcaacttgggaactgggtaatgggcagaagttcaaagagtttggattgctcagaagaagataggaagaggaaggaaagattgaaacttcttagtgactggttaaatggttgagaccaaaatgctgatactgatatgaacagtgaagtccaagctgatgaggtctcagatggaaatgaggaatgtattggagactggatcaaaggtgatgcatgttatgccttagcaaagatcttggctgcattcttttcatgccctagggatctgtagaagtacggacctgagagtaatgacgtagtgtatctgctggaagaaatatctaagcagtaaaacattcaagatgtagcctggctgcctctaccaacctattcaaagatgtgggaacaaaaaaatgacttaaagtggaacttatctttaaaggggatgcagagtataaaaatttggaaaatttgcagcctagccatgtgacaaagaaagaaacagcttttttgagagaggaattcaagcaggctgtggagaaaccacttgctagagaaatttgcgtaactaaaaagaagctacgtgctgatagccaagaaaatgggaaaaaggtcttgaaggcatttcagagacccttgcaacagtctttcccatcataggcccagatgtctaggagttaagaagggtttcctgggtcaggctcagggccccactgccctggccagcctcagaagagtgctgcctatattttggctgctctgggtccagctgtggcttaaaaggccacaggtgcagatcaggctcccactccagagggcacaagccataagccttggtgcctttcatgtgatgttaagcctgcagccatgcagagtgcaagagttaaagaggcttggcagcctccacctagatttcagagaatgtatgggaaattctgggtgcccaggcagaagcttgttgcagtggcagagcccaaacagagaacctctattagggcagtgcagaggggaaatgtgtgtttggaggacccacccacacagattcctcactggggcattgcctagtggagctgtgggaaggaggccactgtcctccagaccccaaaatgatagatccactggcagcttccaccctgcacctagaaaagctgcaggcactcaacaatgtgtgagagcagcctccagggctgaaccctgcaaaaccacaacggtagagctgcccaattccttgggaccccacccctcatatcagtgttcccaggttatgggacacagagtgaaagattattttggaaccttaagatttaatgactgccctgtggggttttcaacttacatggggccttagctcctttcctttggctgatttctcccttttggaacagtaatgtttacccaatgcctataccctcattgtgtcttggaagtaaataacttcttttgattttacaggctcataggtggaaggaatttatttccagatgagactgtggactttggactttggagttaatgctagaatgagttaaggctttgggagactattggtcggggatgattgtattttgcagtgagagaagaaaatgagatttgaggggccagagataaaattatatagtttggatatgtgtcccatataatctcatgtcaaattgtaatccccagtgttcgacgtggggcctcttggaagattattgtttaatagagatggatttttgaagaatggtttagccaattcccttggtactttcctcacaatagtgaatgagatcttgtgagatatgattttttaagtgtgtggcacctcccccgccccccactctctctcttgctcctcctctagccatccatccatgtgacctgcctgctaccccttcccttcaacttccaccatgattgtaaacaccctgaagccttaccagaagctgagtagatgccagcaccatgcttctgtacagactgcagaagtgtgagccaaatgaacttcttttctttataaatgacccagtctcaggtatttctttatagcaatgccggaacaacctaatacaaggtgtgattgagttgactctgccagcataccattggtagctggactaccaatgagttagattctcatctaacaagtagagaaaagtcccgtgatatcaaagaaagcaaaagggctatttatccagagtcataaatgtctaatgtaaataggcaatacatagtttattgtataatagaggcttttaaaatatacacagttgtaatgtctataatgtaaattatgacctagagttttaagtaaaagacacttggttaccttactctacaaaatttcatttcccttgagcttgcattgactgaagtatttccctatcagatgaaatgccagtaacataggcattgcccatagaaattaattgcagctctccaatggaagctctactgtgaactataagtatgccttattttaagtaatctaatctaaaaatctaattataggtagctgtgcattttataaaataagaacaaattcctttcaatgataatttctgtagtacacttgtacattgttaactttacaaatatttgatttatatgcaattcttgaaatatgtgtattataaaaatgaaagaactatataaattatggcttcaataacagtttcaaaatgtaaattatactcacatatttaatgttaattttgatagacacaattcaaacttttgctagggattagtattatcatgatgaatcttttgtaccatgtgataatctttgaaatatataattgttagtatttacaaaacaaggctagtggtaaaagaaataaactggaaatgatttggaaggccagaaagtcagggcaactgtcagttactctctggaagtttagaaaagtaggtaaatgccgtgaagccatgaaaaggttgttcatagagaaatgaaaatctgtttttataagctcatactgtactggattgagaagaataattctcttctgggcaacctttacaattccccctattttcagaattctgtctgatttatgcatatatttgctactagttggggacatgcagaattggcttttatttgtggttcatttagatgatttgggttcgttattcagctctatgaacctacaagctaacatgactaggaacttatcttttcttgtctgtgaaatggggataacatcttgctttctattctgcaaaatttttgactttgattcttcttatcaaatgagacaaattttaaggcaccaaataaacagactggaaaagatatttcacctacaccacacttcttacttaatgtaacatccaaataatattcaaacaatactatgcctatctgtcaatgtttgacacaatagctgaaagcaactctgaattacatagaataagggtttattatatcgtttatgaattcatggtagctgattaatctatgtaaggctgttgcaatgcatctggtgttgagtggaaagtagtcagggtggaaattgggaagggaagatggatagaatgggagggacttgggacaaactgaaactgacaagaacaaagtggaagacttgtttgtctctcaccaccacaaattacaattatgcggatgagctgcaggataaattgacgcctttcccccacggaactgcacgcgcacctggccaggatttggagacgctgaagaagccagcccagtgtgcgctggagatgtggcggctgttgccacacaacaagggcagctagactctctgggatcatgagcgtgagctgcaaaagcacctgccctacaccaaccttcagacaataaataatggcttcattattgccacattcgtgccttccaaaacttgcaaaaatgtcttgtttccaactgttacctgaaaacatacatataagggatttctgggaagacagttccagcttagtgctttgacagtgtgcaaagtcttcatataggacaacaatatcatctaacagctgaaacaggatacttgtgagagtgaaatggggagcaattaagatttacctcaggacatcagacacaaaccaaggtgtatgatcgctctgttatccacattgactttagttctctcctcaaagaagaatgattttggaaaccctaagtgggggatgggaggacagagaaacgttgctctcttagtaattgaggctagaggcttagaaaggctgccggagatcttcccttcaagcttctgcagactcagccagaaagacctccctctcagaaaatgaaggggtgccttgattatgtattctgatcttttggggccagaatttgtaggctttggttgaaatttcttacaaatttcttttgctttatttatgaagtgacaactttctcgctaaacaatcagaagtgcaaacaaataggatttataaagaaatgactacaaactaaggcattagtggatgttgatgattttcttctaggtcagaatgtacagcaatagaatgtggtaactcttttccttcctaagaacaaggatcatcattcattagcatcctcatccattagaggaaaacatcattacatggttgtaccagcgtgtctcaaagcacacttggtaatttttgcaagcattccacaaaatatacttatttcaaaccaattttgtaagaattaaatacaataatctatgtaaaacctacatgcctggcacataggagggactcattaaatgtaacttgaatttgaatcttattaccaggaagtaagatctgtaatctgagaagagagccagcaaagacataatagtaggaagcatcaatttcttatgaaaagtcttgcagacatctcctgatgtgccttttaaatagattttctaatgaggtgtgccatttatctgctgctcttggaaattaattttcctgactttttttcttttcttggcgcttagcccagttaagcaggtgcacggtttgtcaggctatgaatttagcagagtaaaatcatttagggaaggcccaaagtcagtcagaaagtacaaatttaacatttaattttacactcatatacacacacacacacgaatatgttattactttttaggaaacatggaagactgaaacactaaatgcaacatttaggactctatcaactctcatgtgtactgagttttcaaggagcacattttgtgtgtttcttactctgattcaagtcttatctcaaattccatattttctgctcactaccccaggcctatttggtcctcttggtcattacacctaaaaagatgcattttactacccaacttcagtctgtctatgagtacctgaaggaagcaaagagttctataattcaatatttcccagactctaataaaaagtgtatcaattcttcatgaaatgaggaaaaagataaagaaaaaaagtattcatttttaagaagtgttcttaattcttagattatattgttcctacatttttagtcttaaaattctcttttgaaattgtggtaaaaccggatattgtttttattgttgttttaataaaggcaagagcctgaggtgggagaatcacttgagcccagcaggcggatgttgtactgagttgagcttgcgccactgcactccagcctgggtgacagagtgagaccctatcttaaaaacaaaaacaaaaacaaaaacaaacaaaaaagtaaagcttccaaaactaaacctcaacttcattaaacaaatatgtattaaataattagtcagaatatgttaattgctgtattatctcttctccactaatctgttaaatttataatatggtgatccaagtaaatcatccaactggagtagtataatattttgacttttatgccaccagaaaattatttctgttgaatcgtagcttggaaacaaatttatggaaatctataaacctacaaaaaaccatgtgttcccatttcttattatacgcatagattcaaatcttgtttatatttaacatgggctttttttaagaagagaaaagcaaattcaatagtcacaccttttatacatatttattaataaaagtacaatatgatgccctaattttcatctggatacttgacagggataaaagaagccagaagtagttttttattttgctttgaaatataaagtgcccgttatttgacataggtctagctccagttagctggaagtattccaggtttaaacatctgtcgcacaattttgctggtaaagaattggttgattagggtcatattgagtaagagaggtgaaatatacatctatttgcattcagtaatgttccttttgcctcaagaagtaatagttgagtatcagtaaacttagttttacattgccataaacaattatatactgaaataaccacataattgtaagtagggatgtttgtgtttaatttcattaggtcccacacaagtgcacatttctaaactactgaagtaagttaatagtaaagatgagtgtggaaaaatttcagttgagaaagttttttaaagcagagggaaaatgcccatgcctcagatattgaaaagcaaggattggagctacaatatgactattcaaatgtagattagcaaagtgacagtcatttccttctgcagtcaataaaacaattagctcaccaaaagtgcttttaaatcaggatcctagtttttcctttggtttaaaagcatctaaatatccaacaatacttgcagatgcaagtattttattttttcaaaattgcaaatcaaatggattttatcttttagaatccaatgtacttcaggagttttgcatcctaccctttattttattttattttttgcatgtgtctcactctcttagtctcttttggctgatataacaaaataccataaactggatagcttataaacagacattatttctcacaattctggaggctgggaaattccagatcaagttgccagcagttttggtatctgtgagaacctactctgtagctcataggcttcttgctgtgttctcacatcatggaaggggtgaactctcttaggcctcttttataagggcactaattctgtttgtgagggctctgccctcaggacctaattgcctccaaaggccacaactccaaatactatctttcacattttactcatgtccatgtgaagagaccaccaaacatgctttgtgtgagcaacaaggctgtttatttcacctgggtgcaggcgggctgagtctgaaaagagagtcagcgaagggagatagggatgcggccattttataagattcgggtaggtaaaggaaaattacagtcaaaggggggttattctctggcgggcaggggcaggggtcacgaggtgctcagtgggggagcttttgagccaggatgagccaggagaaggaatttcacaaggtaatgtcatcagttaaggcagggaccggacattttcacttcttttgtggtggaatgtcatcagttaaggcaggaactggctatctggatgtgtacatgcaggtcacaggggatatgatggcttagcttgggctcagaggtctgacattcctgtcttcttatattaataagaaaaataacatagtggtaaagtgttggggcgacgaaaattttttggggggtggtatggaaagataatgagcgatgtttcacagggctgcttcgagagggattggggcggcatgggaacctagagtgggagagattaagctgaaggaagatcctgtggtaaggggtgatattgtggggttgttagaagaaacatttgtcatatagaattattggtgatggcctggatacggttttgtatgaattgaaaaactaaatggaataagagaaggagaaaaacaggtattaaaggactgaaaattgggaggacccaggacatccaattagagagtgctcaagggggttgagcataattacttgcttggttggtgagcttttaggctctatccaagtttttggggtgcagttcaagttgggctggtgtctggaatgagactggggcctaataaaaaggagtgtccatgcaggagctcaaatgggctgtaccctgtagcattccgaggacagacccgcctgaatgctgagaagggcaagtggtaaaagtattgtccagtcctttttaagttggtggctgagcttggtgaggtgtgtttttaaaagaccattagtccgttctaccattcctgaagattgaggattgtaaggtatataaatgtttcactgaataccaagagcctgaaaaactgcttgggtgatttggctaataaagaccagtccactatcggactgtatagatatgggaaggccaaaccgaggaattatgtctcacagaagggaagaaatgaccacagtggccttctcagaccctgtgggaaaggcctctacccatccagtgaaagtgtctacctagaccaagagttattttagttttctgactcggggcatgtgagtaaagtcaatttgccagtcctgggcaggggcaaatccctgagcttgatgtgtaggaaagggaggaggcctgaacaatccctgaggagtagtagaatagcagatggaacactgagaagttatttccttgaggatagatttccacgatggaaaggaaatgagaggttctaaaaggcggactagtggcttgtaacctacatggaagaggttatgaaatgatgacagaatagaatgggcctgtgaggctggaaggggatattttctttggtccaaaaaccatttgccttgtgtgggaagagattgatagatggaagtttcagtgagggagtgggtgagagtggccagatgagaaggagaaaatctgcacgagggatagaagttggaatgctagctgcttttttaattaccttatcagcataagcattgtcctgagcgatgggatctgagcccttttgatggctgcttttttagctaccttatcaggataagcgttgtcctgagtgatgggatctgatgccttttgatggcctttgcagtgaatgactccagcttcctttggaagtaaagtggctttgagaagcatttttattaaagaggcattaatgatggaggacccttgcatagtgaggaaatttctttcacctataaaacagcttggtggtgcaggatatggaaggcatatttagagtcagtataaatattgatgtgtagcccctttgtaagagtgagggcccgagttaaggcaatgagtttggcttgctgagaggtagtggagggggcagaaagtatatgcgtccggtgtgagaaagaaaatagattttggaagttatgagaactgtagagagtgagttgagcatagtttgtgattttgagggtctctaaaagtatttaagcagcggcagccgccgcacgcagacataagggctaggctaaaacagtaaggtcaagttgtttggacagaaaggctacagggtgcagtcctggctcttgtgtaagaattctgactagactgaagtcatggggtctgtctgtgaagccttgtggcagtacagcccaggtaattcgctgagcctgatgggtgtcagggtcagtctaagggaaagcagagaggctgggatgaagggtgcaaaggaatagtaaagaaagcatgtttgagatccagaacagaataatggattgtggagggaggtattgaggataggagagtatatgggtttggaaccacagggtggataggcaaaacaatttggttgataaggcgcagatcctgaactaacttgtaaggcttgtctggttttaggacaggtaaaacgggggaattgtaaggagagtttataggctttaaaagccatgctgtagcaggcgagagataacaggctttaatcctttcaaagcatgctgtgggatgggatattggcattgattggggtaagggtgattaggttttaatgagatggtaaggggtgcatgatcggttgccaaggagggagtagaggtatcttattcttgtgggttaagtggggggaatacaagaggagcacgcaaaggaggctttggattgggaagaagggcagcaatgagatgtagctgtaatccaggaatagtcagggaagcagataatttagttaaagtgtctcggcctaatagggaactgggcaggtggggataattaaaaggagtgcttaaaagagtattgtctaatttggcaccagagctggggagttttaagaggtttagaagcctggccatcaatacccacaacagttatggaggcaagggaaacaggcccttgaaaagaaggtaatgtggagtgggtggctttcattttgattaagaaggggacagactcaccctccactgtgagagttacccaaagcatctgtgatggtccaggagccttttgaggtgatcgggcagtgtcagtcttcagccgctaagccaagaagatctgggaaggagtcagtcagagagccttgggccagagttccaggggctctgggagtggctgccgggtgagtccgatttccagtggggtcctgcacagatggcacactgcttaggaggaatcctgggctatgggcatttgttggcccagtggccggatttccggcacttgtggcaaggtcctgggggaggaggttctggaggaatccctggcagctgcagttcaggcgtttggagttcttgtgtgctggagatgtggctggggtttgtctcacagtggaggcaaggaattgcaactcagaaatacattgctacttggctgcctctactctatcattgtacaccttgaaggtgaggttaattaagtcctgttgtggggtttgagggctggaatttaatttttggagtcttatttaatgtcgggagcagattgggtaataaaatgtatattgagaataagatggccttttgacattttagggtatagggctgtaaagcatctcaaggttgctgccaaacaagccatgaactgggctgggtttttcatatttgatgaaaaagagtgtaaatgctgactgatttgggataaagaaaaaggagcattaaccttgactatgcttttagctccagccacctttttaagaggaaattgctgggcaggtgggggagggctagtcacagaatgcaactgtaagccggaccgggtgtgaggaggggaggtgataaaaggattatagggtgcgggagtggaggctgaggaagaattgagacctagctcagcctggcgatgagcagcctggggaggaggggagaggtcattgggtctgtagaaaaggaagattggaaagaggaaagactcagtgatgcttggggttgggactgaggggacaggcgggagggaaagaaggaagtttgggacaagctgcattgggaacagagactagggagggaccgatgtgtaaaagaatgcctggacgtcaggcacctcagaccgtttgcccattttaggacaagaattttttaggtcttgtagggtggaaaagtcgaaagtgctgttttctggctatttggaaccactgtccagtttgtattggggtcaagtggcagtacagaagaaaataaggcatttagattttaggtcaggtgtgagttgaagaggtctttgagaacacaggctaagggagaagagggaggaatggagggtggaaggttgtccatagtgaaggagctaagtccagagaaaagagagggtagagacatggagagaaggggtggggggggtgcttgccccccaggaaagtggagaaggggtagagacatggagggaaggggttggaggtgcttgccccccagaaaagcggtgcttgctgctaagggtgaaggaccaagacaggcgttcccacgtggtcacacacctctgaaacgtgggtgaataatcaggcagttgtccccgcgtgattaaacaccaagggaagactgttttcccgagtccgtgaccggctccggagttttgggttcatggataaaatgcgtctcctttgtctctaccagaaaaggaaaggaactgaaattaagagaagggagagattgaagtgtggcgccaagattgaaaggagaaagaggttgaaggatagtgagagaggttggagaagagagtagaaagaggctgcttacccgatttaaaattggtgaggtgttccttgggctggttagtctgaggaccagaggttgcaggtggatctttgtcacagagcaaagagtaggaggacagaagattgatctcccaagggaggtcccccgatccgagtcacggcaccaaatttcacatttcactcatgtctgtgtgaagagaccaccaaacaggctttgagtgagcaacaaggctgtttatttcacctgggtgcaggcgggctgagtctgaaaagagagtcagtgaagggagatggggtgcggccgttttataagatttgggtaggtaaaggaaaattacagtcaaaggggggttattctctggcgggcaggggtgggggggtcacaaggtgctcagtgggggagcttttgagctaggatgagccaggagaaggaatttcacaaggtaatgtcatcagttaaggcagggaccggccactttcacttcttttgtggtggaatgtcatcagttaaggtgggaactggccatctggatgtgtacatgcaggtcacaggggatatgatggcttagcttggctcagaggcctgacactatcgctttgggatttggatgtcaacatatgaattttgtgagggcgtagacatttagaccatagaactctctagaggagagggacagactggtcattttagtctaatattggtattatccagaagtcataaggagagagagtgagtgagatttagagacagtgagagagaaaagaagaagaagaggaagaggaagaagaagaagaggaagaggaataggaggaagaggaagaagaaggaggaggaggaagaagagaaagaggaggaaatagagaaagagagactgaacaggaaaaaagaacaggaaaaaattatattgcaattagaatttttgtaaaatcaatcctccaagtgaagttaatattagaagcaccatgggaattttattaacccaacttttaatgtcatcatgctttgaggagtgttcattgagctaaagataagagactccagaaaatttcaacctatgtatatggtctctatgttaaaaatctcattgaatgaaaatctattcagacacttagttttgaagttaaatcacttatataattttgatttattgttcaagtgattgtatacaactatttaaatgttctatttttaaaatagaacatttattcctaagtatggcaatagcaaagtattcactcatttgtaaagtaaggcatttaaatatatgaaaatgtggtttcctcatactcttctctttacaaaagcatctgaaaggtgctctatagaagcatctcatgatttattttacaatctgattactcagtctgaaatctaattattcaatatttgtatatcctgctaaagtgttaaataaaaatttattttatcctacatatttagtttcaagaaaattttacagcatagcttttattccacatttctgtccatgtgaggatccttgaaatactcttttatactgtaaacaaaattatcaaatgcaaagattatagcacagtagctggattcaattttcattggcctccacctctgcatttcattattatttttacctttgttcctctcaaattgctatcagttagtcagttcttccccaattattattttagcataaataattttaaaggatcaatataagtgaatataaaaagaggatctcaaaaaatgagcctctcttaaaatgcttctgtgtggaaaatctatttttggaacatggttttaggactataaattattactattttggttacaacaaaagtggcttatcagatgccaaaatatcaagtgttgcttctggaactgaagcaatatatacaaatatagccatccttcctgcatttttcaagaaaaaataataagaaaatatgtaattccagtactatacatttagaaacgtccactggcaggatataaactcatcttaggggttaaatacagaggaataaaggtgttgcaataaacattttttgaatgcttgacttccttggatgttttacttatgtctctaattttgtctttactttcaatttgaaataaaacagaaaataagaacgcaataaattcatgggagaaaaaaaggcatttggctctaagaggttgaaatctcttccaccgtgatgacaaaattaaaaacggcagttctaacatcagtgaagtcaaccaaacatacccaggacaagtggcccaacttatgagaaactgtttggacttaaaaagctttaaagtataatgtcttcagtaaacatcaggtcaatgaagacaccaaatttcactgtgaatgtataagcacatatttttgtttattcgtaaacacctgtgcctagtattgttgatgctgaaaactccaggacccaaagtctcagaagactattaaattcactgtgcaagcttcttgtttccaatggattctgcttagaaataaattaaattagcatttctaccctataaccttaagaaatatttgactattaacaaataatgccagaccttgagcccaaactgtttcataagtctttgtattctctcagctacatttctgagtctaagaaacctattgacttagtggaaagagcattgttttatgcatatactgacccaccacttcagattttaaaaacatttttgttttgtttttcctatctgttttttctttcttcccaacttaggcggtgggatgggaatgaggaaacacatctgaagtttcatttggcattgggaaagttctaaagaaatttgtttaccttcaagacaaagactaagtaatttcacagtaatttaagcaaaaattgacatgtaactcagggcatattaaatgacacataatttgctaaaatttttcttaacttgataaaattttcaccaacagaagcaaaaatattcatatacatatttacagaaagggagaaaaactggtcacttaaaattatttctttaggtctagaaaattatctctatgtattttgaaataactttcctcacataccaaaattagaaccacctagatatcaattatatattacacttagaatattgtacataatcagtgctcaataattgttgtaaaagagaaatctctgctttgcttagccaagctcatattgagtactaccatacagaaggtacatacagcaacatataccaagtttaattgttcctggtttgggtagcattcatgacattaaaaaaaaacctttacctcaatttagttccaaatatttggatctgaatattttctgggaggtcaggggcaaacattagttgtttcatgagttccaatgaaaacagtctttggatttcatggaccttaccaaggttcgctatgagggcgtggtgactaagtgatctcatgctaatatttatagcagcctgcatttatggagcattgtatgtttgaggtaaatggtcatgaaaattaaactgataattatctaacatttattaaaccatattatctgccctctatgctgatatggtttgatagtgtccccacccaaatatcatcttgaattagagctcccatgattcccacatgttgtgggagggccccagtgggagataattgaatcaatggggacagtttctcgcatactgttcttgtggtagtgaataagtctcctgagatctgatggttttataaggggtttcccttttcacttggctctcattttcttttgctggccaccatgtaagacatgcctttcaccttccatcatgattgtgaggcttcttcagcaaagtggaactgtgaatccattatacctctttttctttataaattacccagtctcaggtgtgtctttatcagcagtatggaaacggactaatacacatgctttacaccaaaaagtttacgtacactgtgcttgagtgaacaccagtaagtgtcgtctggtgcaggcagagtcatgggcagaagggcagaagattcctgggacccctgttttcttgccttcctgtggagtggatcagacagatgcagatgggcaaatctagagactccacctcttagttgttctttccttggaaggaaagcataagggtagcattaaggttggggttaatcatttgggtttgagcgctatgcagtcagagtttaggtgctaagtgcatcagggaatgctggaaacaccagttgtgtagcacttgaagagtttgggagaaactgagatcatacacaggcctcctgttgaggggaggggaagctattagttctggctagcaagctgaaaagaacattttggtcattcaacagacaatcttgcttatttcttcacgttgatgtttactaattagcaggcatcgtaccatttgatttgtctatattatctcatgtattacgcataagatccttatgcagtcttattgtcattttatggttcagcaaatggaagcacagagtactttatcctttttcccactaactgaatatgttctaaattggagtacagagagtttgaatagaggaataacaggcactggaaagttgaggtcttgatttggaatagtgactttgggaaagcaaggcattgataaattttatagacatggcaaaagttaatcttctcaatatcatagagctaataggttggggaagtaccaggactagagaaaagtgagttaagtaccatgggtgcaaaattggagtcctccaaaacactcaaaaattgaaacaaataatattttcaggcagagtttaaattttcaaaattaatgcaaaaatatatgatgaagaaaatatcaacattttaaacaaaggcagaatgattattactgtttctccttttgtttcaatatagttggcacagcgctgggtaggaagcttgaacttgaatgctatcagtctgaactcagaacccaagcttgtaaccattgtgtgccaatgtttctcaggatatgaaaaataaagaagggtcaaatattacctacacactctaagactgatggccaaagataacagtgaaactatggtcttgattttttagaagggaagcagagaaaatgattatttttcttgtatagtcccatttagaaacttaagtacacgcatagtttagcttcaaaaccagaggacaaataaaaatcttacttaaacttttcttggcctctcttgtctctcttggcactctttcatcagtgccaagaatccaattactgaccacaagtaacctaaagcagttttcccggcattcagtggtatatttttctggaagaaaccttggatacaattaagaatgacttgaacactgagaaacatttcttatctcatataacagaagtgctgaaggtagagtgatttcaacattggatacttcaaggccttagcaatgtcatcgtggactcatttttttttccagttttaatccttgcctttctcagagagccagctactgttctcatggttacaagatgactgaagcagctgcaagcttttttattcccatgcagtaaagtctttgttcttccttttaagagcaagaaaaccccttctaaaatctccccacccaaaacgagaccttagaatcaattgtgaatttatgttttttgtttgacagcatatagcacaatagttaagaatcttgttttgatggcctaaaatgggtgtaaaacgtggctccatcacttactatgtaacctgaggcatcttatttaaattatctgtgccttagttttcctatgtttttaaaaaaggtataaaataatatacctatgtcattgggttattgagaagaaaatgtgaattaatacctgtaaagtttttataatggtgtctgactgttatttttaagatgattctcacagtcatgtatataattaaacttagggaaacatgaaagctaagaaaatacaattacctaagtatcttcttaaaaaaagacatcaataaaagttttagtttgcgttgaataatattttttccattgatatgatctggatttggatgtgaggtctgaaagacagaataagaatcaacttcaggactactgtcttatttaagtgtgtgtgtgtgtgtgtgtgtgtgtgtgtgtgtgtgtatttaggttttggaagaagtggtccacatggctgaaaatcagaaaatcagaagctgatctcaagctagcaatgataacttcataaaaatagcctgctttggcaattttagaaccaggcaatatatatatatatctgcaaaatacatacagtgcatttaagcataaggataattaaactgatcccaattttgttggattttattgttaagctcttcagttaacacttagaaagaagggaaatggagaaatagtctcaatctattctcatcataaaaatctcatttgcagatttttccattaggtataaaatataccactgctaaaaatgcctttaatggtgccagaacaatccagttccttacatatgattcttttaaaatcctcaattgcaattataaaattccatttcatttcctttgtctaaggtttaatctcaccattcaaacggccatttcttgctcacatgaaactctctggagtgtagtaaaatggggtgcaaagagtgaaagtacattatcaatgaatcatggagacaggcttcccagaaagcagcattttattcctggggtcactgaatggtctgtgtgctccacgaatccctcagaatggaatataaaattaaaaatttccccagaaatcctctcgttcatataatttttccgctctctatgagatcttcccatcagtataaaccatgggatattcttcctatttgaacaatggtaaaaacagaaaaactcactatgatcctagttcctcttctagtattactcaatctctgtcatatgcataaaaatatactcactgcctccaaatttttctattttgtcttgaatgcactccactgaaattgctctttgaaggtcatgagtgacatcctcgtcatccaatccaaaggtccattctcagtcttcaactttcttgacctatccatagcattttccagttgatcactctgtcctcctcaaaaacaatgtattaacctgatatctggtgcattacactttcttggttccttctccctctctctttcttgctcactcctgctctgcctgtcactctctctgtcatctcccctctgaatccattgttggctcctccctatctctctgacttatctccctgacatttgttaaagtgtctctgggtcaacttccttggtgatctcactcattgttatggctttgataccttctgtcttccgttggattctgaagtttctgttttcagttagagcttctcttttgtaaatcatgttgcattacacaaatgtctacatcttgatgtaagtatctaataggcaacccaaattttgaaagtctaaaactcagctacttttctactcccaaccccacccacacccagcaagaatcttgtttctctccagtcctcccccagctcagagcatttccttccttcattctagtttctcacaccaaaaacttagaagttatcctggaattctgtctttctctcacatcacagccacactggaagcttctactattaattctgtcattgaaatacattcagaatctgattgcatctcaccacacacactgttaccaccctgatagaaatcatgatcatctttctcttggatgatttcagttggcttcatactcatctccctgttcccagcctggcaccctttcaaacttcaacacagtaaaggaagtcaaatcacttcatctttctgctcaaatcttccaatgacttactatgttagtcacagtaaaagcctaattagatgtacttaacctttaggtagtataatacattgatataattctcatctcttaaatatatcaaagagagaaaaatctctgaaaagctaaaatagtttttaaaattaaggaaaacacagctctaaaatttaattacagcttgataaaaaatcagatgcaatttataccatatttctagatagatcacctctgtaatcacatcctaaaggctatgcttgcctcttcagagcagttttcatatgattggaagaataaaattttggaaatccctaatatatttgtttgcatttttttatgattcaatctttcatttagcaaacattttatatctcctaggacatagaaaagggaagacttatagattctatccattgaagttactagcagttcaaatacttttttatttcatgtacagggatgactaagataaatccaacctattccaactagagcttgatatgatcactaacttgactattccagattcttcctgtggtatcacaaattagaataaatgggcctatcagtcttaatttagccacaactaccttagtcaacttgcagaacttgatatttgtctgaaaacttacagagtcatcttttctataatgctgtcccatacaatatgtgctgaaattatttcttccattcctgaacatccataacatagggtttatttgcactctgggtaacataaatacacattattttaattcattcctaattttttttccagtgctaactcttatttggattataaacttcccaagggcattttctttcttggcatgcatgcatattatagcaagatgaagtttctatttctgcgcaaaaaattgtagccaggagatatttagaatgttgaaattgacatattctttttgtcaaaacaacaaatcagtaaaaacagcttttcttaagttatttggaaatgatcacaaactttttctttttttttttttaattacttttagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatagtgataaaggtacaaagaacatagagatatatctaactgctaggagcaacattaaatatgtattatagtggcttgcctcagtttaaattcaaatgagcacttgggtcaagctaaaccaaaatgaatacacttctgactgctaaaagcatatcaacaggctgccaaacacagtaaattgttctttatttaattttcatcttatagcttatctaccattatggcaaagatgtcaaaattaaatgttaatattaatgtagcattacagcaaagggagtctcattatgctctgctataaaaccacaatacaaactcacatttatatgcttctttggaaaaaatagttatttttcaagtttatctctaggaagattaaaataaaaacagtaaaactaaaaatacatataagtgttttatacacatatgtcatatttatagtcaaatagcagaaagcaatcttactaaaagtacaatcaaaagagtaaatttattggaccaaatggtggtgtagaatagaaggacacattctaaatgtcctaacaattatgcaactaacctatgtgctctctcatatatattaatgaataaaaggaaatagccatctcaaaccacataaaaactgccattgaatgagtatgaaaagaacaaagcactgtgattccatctattagataacactttttagggtcagtcttagtcatcagaaatcatgtattcagccttgactaccaggaaagcttttattattagagtatttttataacttttcctgaaattatatttgttttggccccagtaagagttcaacatgaacaatagagagttgaaattaatatgatatataacctataatgtataatttggatcactgccacaattttattgaattcataaaaatgaaacaatcttatataaatgtatataaacaaactttatacttaaaaattggaatttgggaagcaaagtaatgtaaagactatgattgttaaaactaatagatttttttaaataaacaaaaggggaaaataatgatgtcatattattctatgctaaaatattttctaactttgtttttcttttaatcttggtctaggagaaatagatgagcctcccttgagaaaaaaaggttagttgttttcacctttgataataattatttttctcttatggtaatattggttttcagcatggttcaaatatattttacttattttaatataaaggttttgtttaataattaggtcaagatttatagtcagaaaaaaaatactcaatttcttttccaatgaaggtgatctcactacttttctgttgattattttttaaatgccttattcagtagatttgtatggattcatttatacacagaccaatatgagctggaatttgaggaatgaggggagaattctgtagccttagaaatggcccagaaaatgacacccatgatttattctcaccatggtcagatttattgattttaaatgtttattcttattcttttccttttattttttttgccatcattattttgcatgttaggtgatgactatgggccaggacaacaagacggtgagggacataacagcctaggaggcaaaggcatatccagttggtatgtgtgatgtgtcactgtcatggagtggagttacctggatgtgcctggatgtgctgtagaggaattacttgcaggaatagataaggtgactgagtgaagtggtcacaacctgaatgataagaacgataaacctaggacaaaggaggacagcaatggggcaggaatttcagaagacagagattttgacaggaaggggtaggaactgcatctggaaggggcactggggagcaggtagtaccatcttgaggtacatttgttgtgagaaaacagccaacattcaagccagacttaaaacaattgcagtgttttagttactgctacacatgggcaggctgttgagggtttacccaggaagataaccctggcttctgttgctctctcctaatacctactgtggattcaaacaatgggatccaaacttacagtttcagccttccctgagaaaatgatgactaccccacactatctggggtaaaatccacttagtgtatgttaaattagaaactttggatttgtaacttacacagcaaaaaagagctaagccagtcaaactcaactatggcaaaggcatccagaaatgaaagtgtttataaagctctgtgaggagaaaggaagggtttatacacctgcaaatccagaatgagaactcaagtactcaagacagacttcagccatcaaattcaggtttagagattctagatttgtctataaacttcaagagatttatagctgatttcccatagagagtgaacatagtcaagctttaagtgagttattagtcattatctggaaataacagcttatgcacgtttattttcattggaaatggaagaagggaaaacagataaataatgtttgctcatttatacttataaactgaattccataagactattataaagccatgtttttcataaattgatatttactatttaataaaaaatcttttcttttgatttaaatttttctttgaaattattttaaaattaagcttcatatagtaattagtataaactgcaaattcatacaaagctgttttactattgtttcttaaattatttccttgattcagcaaatcaaatttttgccagaaaaactattaaatagttgtttagggtacttttaaaaaatgttagaaatgtttattagtcaaaaatagtctaagggatatatgtccttcaacacatgtgcactaatgtccttaaagattacatactcagaattaggagaattgactttaaatcacctgaatatattttcttaatagtattattcacacagttacatgaaaaaaattgacatttaagtaaaaatctcagatgctctatcttgggtacagaggctatgtaataataaaccttagttgaaagtgaattcaagaagatctatttcattgtaattattattttttatgtgtaagcttttctttcatggaagtatagaggcaatgagagctttaaagcagtaggtaatattttataaaacatttataatacatattctacattttaagtatacttttaacattattattggggagaaattctataaattattcttgtcttataagttattttactcatgtttacatttacaaatgttggtttaagaaggaatttgggggcaatgtagaatgatagtcttttaaaacatttgatttttacacatctaaatgactcttcattaatacccttctcaattcatatatattcaataatatttagtcattttttattgcctaaattatcaggctgtagcatttttttattcaactgccctatatctacctaaaacattttatttgaatacacttagttttatttgttgagttactgctattcttaacaaaataaaaattcagccagtttgttatttatggttgaagtttgcagtttttaatttggtatggaataatggtgtagtcgactaatctcagggttgcagtattgattattaaacagattattaatatggatgaaatatttgattctgctagcctgtggaatctgttgttatatataaatatagcttcagggtattacatgtagtacctagtgtctttatattcttcatgcatatttttcaacttgtcaaaattttaaaatactaagttctattactaaacacttcatgatgagaccccaaggcactgaatctttagaaaatactatattttattacatagttgtctaaaaattataagtatgaaaaccaaatactgttataaatcacattttcggaaaaaattatttgttgtgtatagtggtatactttgcacatctggaagtgtgcttttaagcaatatttttcacaccagggtatacatcatggatctgttagcacctcactttctaaggggtataaaactgcagagagatttaaaggaattgaatgtcatttgaatgttttcctaaaattgatctgcttgagagcatgcccggtttataaccgtactatttccacttcaaatataaataaatttgttgttggttctttgtggtattcaacgttacttggaaggagacaaaaaaattaagtaacattgccccaataagactgtgtgtgtgtgtgtgtgtgtgtgtgtgtgtgtgtatgtacagatgtgcataaggcttctcaatacttgtatctttaaaagtaaaatatagggttagatttattgatgaacgctgtctcattctaactgtaaaatacattaatccacagataggtgattttaaagctccattcattcgatggcattctaaaaaaaattcatttttcaggtttaataataacttatgaagatttgcaatatattaacctttagattcttagattcttatagtctaaaggttaatatattacaggatgtgaaatcacagaatatggaggaaatttaaaattttcaatatgtacacttttttccttagagaatcataatgtagctcttgggtaaaattttcgtgagagaggtggaatgaaaatatgaattcaaagagaaaagagaaagatgaaaaccttccaaatgttaagaaataattttttgataaatattttaagttgataatgacatctaaaaatattatagtgtttggagtccatcaactcagtttttaaaagggatatggcaactttatttttaaatgtcaacatttacaataatctataaattatatcacttgtaatccttcaacttatgatgaaaaattttagaacttgtaggaagggatgcagagttttgcaaaatttctaagaaatataaaagggaaaaaattgagcatgattgtaatagaaaataaacattttgctttctgggtaactcctaggtttctgagtgagagcaaagcacagaggtctaagattcacgacggtacaatgtatatccttagctaatcactaatacagaattcggacatgttttatgccttctgggattaaactcaatcaacaaatgtatttttttcaattaatctttttcaagtgttttctatgagccaagcaatgagctggtggaagagaacatgtactatttgcttaccacattcccaaagactaatgatgaacatttattaaataaaatagtaaatgacagtaatggagttttgatgtggtattgctagcatcaggatcaatgcaacatgttattttatagcttacgtaattgcaaaggtgtaaaagatcaccttacttagtaaaatgtcctgcaaataccacagttaaaaatttaatgaatacatgatcaaataaggcagtaaataagctagaatagttggggcattgtatatttgataaagaagagggtaaatctttatatgatgttattaataaattgaactgaaagcatatgaaaatgtgaataatagtaatgatatctattttttagaaatataaattaattttaattcccttaattattcataaagacccaaagttaaagttaaaaccagggccagacgcagtgacagacagacagacacacacacacacacacacacacacacacgcaaacatgcacacactcagagagaaagaaaaagggagggagagaaagagagagagcgaaaacccaaaagtcttaaagcaaagttaaaaaatatatgtttttttcagcataggtatcttagtgtttttctctatttatgttcaaaaataaaatactggtttatgactggtttattttactaataaaatactggtattaacacttttaagtgcaacttaacagatacacctatctctatctcctttttacagtttattctcacttaaacctccatctataatatatctgtatataagaataataattacagcatttatatcctttggaatatgtaattttagaagataataataggctcctaacaaggaattaggttttgtaatgtcttttcctgacatctagctttaaagttaagaaagaataatcgtagtcattcagagttatgcatatttagttttttggacaggagaaactgatctttaattttaggaccatggtggccttatgggctataggtttatctcttgccttagaggaaaacaccagaagccaatctacattatgtttaatttcctttcttgctaactactttctctttgaaataagaaattgtccttaaggataagctagacccaatatagaggatgatgttctatgagattgtacttgatgcatgtcaatggcagaggaagagattcctcacttacagcaaaacaaattacaattccccctatagtcgcatgtttaaatttccctaaagctctgcaagttgaaaagagctgcctggtaaattttaactcagttctttcgttgtgtatttttcttactttattacaatccacaatagctcttgcagtctgagcgaatgagaaagagccagaaaatttaagcatcataaatattcaagactttaggattaggccattcagaaggttgtatcatgtcatcgggagtaagatggatagacgtatgtgtgtgtcagagctttcattgcatccatctttgccagcagattcagtggtttacaccaggctgaacattaagtgtctgaaaaatacggtgcatgaaaaaaggaaggagaatggaaagatgactaaacttgttaaaattcatagcctcagaatattggttactaggtagccctagtaacattgttaagtatacatttatctttggatgtctcctctaaataaatctagatcaaagctcatctccataactgcaccatcgcatatcgctctcaggctgcatgaggagcttagagctttatcttctacctgtctttcccaagcatggagcagacctgtgatgggggtgagagggggacaaagcccagagagaatagacagtaggtatggaggttggctcaaaatgaaaaaggctgaggagggcgagatcaaaggagatttaggatccagtcacttctccaggtagttgctaagaagtaaactctgagcccactgactcaggcagctgtagtacttcgtgctactaaaagagctcatctttgtcaaggcacgcaaagtgacccaggatgaaacaaataatggtgggtcaaaccagagcctgaattaataggccaaggaaagcaagagatcaggttttggtgccaacatcagaaggaattaaaagagtctctgaggcaactcaactcaggcccaaccattttatgtagttcttctggagcaagaataatttcattggtgttatatttctacctgtacctgagatgagtaatagagaaaaggatgtgagggggaagctgctaggtctaatgtatttcagaatcttctctctgcagttctgtatgtttcctgtttcaaattcaagagaaactaatgtgctagttgactgcagatggcttaaagttttacctattttaaattatagattttcatttagaaagggtctgttgaaaaataaaataaacaacaacaaaaaaagcataacagaaagcttaccaatggttctcaactttgtgtgtcagattcaagtgatgtcttaattagaactcttttgctcatgagagaccaaaatccaactcacattggcggtggctcatgcctgtaatcctagcactttgggaggccgaggcgggcagatcacgaggtcaggaaatggaggccatcctggctaacaaggtgaaaccccgtcttcaccaaaaatacaaaaaattagccaggcgtcgtggcgggcgcttgtagtcccagctactcggaggctgaggcgggagaatggcgtgaagccacgaggcggagcctgcggtgagcccaggtggcgccactgcactccagtctgggtgacagagcgagactcaaacaaacaaacaagcaaacaaaaaaacactttttctgttcaagtgattaaaaggcataaatagagttggcttctgaaatgacttgatatagttttttttttttaatcatgttattagtaaatcctctttcttcacttctggaacctgctttccttcctctgtttcatttgtttcagtctcaggcaggcttttctctcctagcagctagtatgggaccagaaagttggggccaaaattatcttaccttagcaactcagtagaagagcctgttctcttcctcaatgcctctgcgaaagcatctggttcactcccattaatctggatttagtagcatatccctgttggagccaatcagttggacagagagatgaaatatgcactttatcaaggcctatgaaatgggcccccgcccttggaaatgaagggtgggttagcatggggaaaaaagtggttcccaaaattaagaggaatattatcaggaatactggattctagcaggaatgccacaaacgtctacatcatctaatttttgtttctaattcagaattctagattacctcccatctccgatttgctaaataacaatctgtaggggtcaagccttaaatagttgaatttgtaacatctccacaatggtattctaactcacaatcagagtgagagccattgcaacccaaaagagtaatgctataaatagggaattttatgcatcctgaggccagtgagttagacagtcaaagataaatgaataactgcataatttgtttacacacaatggctaatgtatataaatctactgttaacaaaatcccaaaacatgaatgataggatgcaaactaagttaatatatatatcactgtcgcattgacctaagccattggaataactattgatagttgatgctcatcatctgaacatatcaaaattttaaacatgacagataagcttgaatgaatgcaacaaggaggtattggtattgtttccctttctgctgttaaccagctatggtcaagtcacttcagtggctctcagttctcacacctgtaaaacaaaactgccagatttactgatgtccaggtcttttctagctatgatattttacgattctatgattaaactgtgatgccatacattgataattttatcaagagtttcatctggactagagctttgaaattcaaagcatggcccatggaccagcaatgttagcatcatatgggacctatttagaaatgcagaatctaggctccatctagacataatgaattaaaatctgccttttaagatccctaatgactcttatgcacattaaaatttgagaaacattgatcaagacagtagtttcactttggactgtggttctgaaattacctgagagtttatttaaattgtagatctctaaaaatttccttgccatgagagacaaattaataacatttgagtagtagctcaggaatatgttttaaaatctccccagataattctcatgtacagacacatcagtcttatctagcacatcatcaaatatgaaacatgctaacacagccaaaatcttactcaaatctccaaatctgcaaacttcaccattgataatctataaaaggtattatttgcaatcatttgtacttctgtctggtttatgtacacatgggaaatgatatctcatttatagatggagaaaataaaattcgaagagaaaaaatgaattaacctgagataacaaatttaatggcaaaaatgagattaggtagatatcatcttagtatatttattttgaaaatttttaaggatcattagtatacagtgttgaatctattattttttctggaaaaagttcagcttatcttaccaagtaatcaaacacgataaaataaagatccaaaataatttacatttatgggcttcaacatctctgaaagaaactgttcttaatatcttcttatcactgtatctggagtggttgcccattaagtcatacacatactaggtgcttcaagggggagagagtattcctttttatagtcttcattaatggtgagtagtacgctttccccagaaatatttgtttaccaatcaaacataaaaagttttagaaaatcaaagaatatacagatatttacggataatctggaatatttatcttaaatattaataattcagcaaacagctgtgtttggcattatttaattagccactaaatagataacaagatttgcttgttcatctgttacaattaatctgttgtgctctaataacaattggcagattcttataaagattctatgtttaagtgaataaataatttgtttttttaatattaaaatgggaaataatgtaagaaggcattttattttatctggtgcttgtgaggtatctagagaaaacataatgagaggcattctttgaaatacacaacccttataataatttaataaagagaattgtcatcttaaaagaatcaggatgattgccttgatgacagagattattcttttaacttcctgaatctgccatttgaaaatcttcaattgataacattttgaatttattaacagtttgccatattaatagagaaaaattgcatgctttaaactggccatgtaagtcttagacaaaattacaaactatctgtctactcaacagcaagctttggtatgatcataagtagataaaaacgatcataagcaaaacacatgtaatataacaaaacaatttagaaatacgtcactacaaaatcagctcattcacaggaatcactgatacaatctattttcactgatttttgttccattggttgctgctactaccagccttctcattttgaatgcctgtggcctttcttcccagttacatatggaagttgagctcagagagtctggggaaaatgtattggcctgatgattaccattggcactgtggtagacatagaccttatgtaaacattttgacagaattaaacggcctcatgaggaggaagaaaaactaatgaagtgaatcttcacttggagtttggtgaagttttagagattacaccctttgagtaattgtatgttcctatgggacattcagcacacgtcatgagaacaagaaaattctccattatacttgaaaactctaacttggactaccaagaggatcattaaaatctatccttgtcctctcaaatgtccagcataaatatatttagtaaatggctaaattttgtaatttctgcatgtagaataccataaatatagagacaagtgttataagacaaaatagaatgtagattatcctaccctaatcattaataaggaatgctagagaaatgtaataatattaaatctgcagaacaaagggaatagaaatttaaagttccttcctttaagctcggttttaaatcttgctctcaatttttttctgttgaaatagttatattttattaacattttattataggcataatatacttacttatagtttatctagtttttgtatgagcatctataaattttgaaataaagcaatgttaaaaacatgcttaatgtccttaatataattacaatttagcttttcagtgctctagaaaaaacagtacatgaaaaaatttctgaaatataaaaaactttcaattgttgcagttgtttttctgttttctcttttattgttctatttattttgagacagggtcttactctgctgcccaggcggaaatgcagtgtcaccatcatggctcactgcagcctcaacctcctgggctcaagggatcctcctgtctcagcctcccaagtagccggactacagttgtgcaccaccacacccagctcatttttatttatttatttatttatttatttatttatttatttatttatttatttattgtagagatggagtttcaccctgttgcccaggttggtcttgaattcctggattcaagcaatctgcccaactcagctttccaaattgctggaattacaggtgtgagatactgcacctggccaatcgttgcagtttataagtaactttggcatatcttatttccataagtagtaaaatcttgcaactttcccttgtatttctaacagaaatttaaaatatttagaaataaaatattttttcaaattttcaagtataatcattttagtagttaaatagtattttgaaagttgtatcataaaaaacaagtaaaatatgatccatcaccaccttctaaaatatgcaagaattgataactcataatcatggttgaatattttttcaagtagtatgcatttctcaagtggctagtatattccagtcatcatgttaggcattgaaaatttaatgtggaacaaaatagacataattcttgccctcatcaaatttagttatttagtgagagagacaaataataataatagttggcattcacatgatgcttacttgacacaaatgatgctctaaatgttttacattttaacatattttaatccccatataatcctatctggtagacactactgttaatcttattttatggatgaggaaatgaagttcacacagctagtaagtatggaaatcagatttgaattgagcagattgactcccgtgttaattatcttcaacattaagctgtattttaatggatgtcagagatgcacatatttttgtatagatcttttaatagttttatctatgtctacattttcctatcaaaatgcatgatattttaattatattagtatactatagatttataacatctttcatatgaggattattaaaataattaaaataattctttacagatcatcggaatcctgaaataaagaataatctaaaaatgtgactagtttttatttattctcaacaccataataaattattataactcctcctctgtttggcattgtactttggaaaaacagtctgtgtgaggaagatatatttcattgctatcgccattgaatgataaaccatgaaagtcagagtttaaattctctgagttccttaatgaaagaaagttgtaaatgcatttaaagcccagtatgataatgttttctttggatttcaaaagcttttagtcttggagtgagagatgaatagcgataaggatctaagaggagatactactttttcctcccttatcttcactcatacctccctaccagccaccagaaaagtgttaggggaaagtcaggagtagtaaaagaagtagaaatacacttcctacattctttgaaattaatttgcccttctcttaaatccttcagtgcccttgaaaccattactgacaccggcaactttagtggagtgctaattctttcttattaggcaaagctaccagtgactcagtagaataaagggatttccctttgttgcctcctaacacattaagataattgtaactttttttccgtgtctttttcccttcttcccttctcaaaattcaaatagaaactcatacctttaagaatttatgggcagactcacacgtggattaagatactttgacctctgtgctttctaagacacaaaacaatttttaagatttaccggttacaaatatggcttatgattccaactagcatctggtgctgagacttaacaccttttcagagacattggacatccacctaattgcaaaggacatatatgtggaggtaaataatgactgccttgcctttcttctaagtctcttgtatccaggtttggttcaggtttaagtgaagtgatcctcaaaaggtgtcatgatgtttaagtaaaattttatgctattatacattatttcatgttatattaagtggagacattcacctatctttgcaaattattaaataaccagaagctagtattaacataatatagaaaacttaattttatttgaagattgttggacaataaatttctacctttaatgactcgaatcttttaaatttgattttgcaatttatacaaatatagccttagctggaaagagcaatcaaaggtaacaaatcaggcattgcctccctatgagaaaaatacctttccaaagtctaaattagtaacatgttactgaattggacaggagcttgaatagcatcatttcctggctaaagtgtaaggagacagaactggcacgccatgtggaggctttactggattctcctgacaacagatatcaacagtcagtgacaccagtgatggaatccagtccccaaagagaacgcaaagttgcaataaaacatgcaaagaaacatttaatttctccttaagtctgaatcatcagaaataattttttgtcttcctgagcaaataaatgtaggtgtgtgtatgtctttactagttctgctgtgttttgccatgcttgcctctgtagaaatattaatatttcagttaaaaatagttgataatgtacctgtaaaacaaaaatctgcctatgtaagtttgtatactttattgtgagctctagagactttactgtgtgtgtatctttttaaaaatggttgacctctgcttgcaaaacaactgcctgcatctgcccacagcagtgaggttgtcttagtttgttctaaggctgaagtgcagaatcaggaaaataaaaaatgaggctttccctgtgagactgatctaagttgtagaactgggttgcatctactctgcttaccatagagtaaaaaataactgctctgaaataaattgccattttttagtctaattttcctttatttatttttatttttgcttaagtaaaacttattatgaagcatatccaacatgcaagtacttacctttcactttagagttacctccctttcatgtatttgggaaagggagataatacatttaccctagcatttcccttctcctgagtggtggtcttgaccctagtctttgagatttgtctttatttctttttttcaggatggtcccttgctcatttcagttactgctactacctagcactcatttcctttgtcaggatatgtctgagtacacaagagctaagaggagcaaggtagctcctgctagtacttctttcatctgttttctgatgtgcaaacttacacctaccttgcaggaaaccctactatgatcaacaaggaccgtctttctagtccccaaaaccaccacaactctgtccagtcttttctgcaaaatctaagttagagtaggaggctctgacaggattttttcaggcaagatggccttcagcactggattctatggaagagtctaacccacgtcttattctcccgtgtgagctccagaatcccttctttattcttttgaatggtcagctggtatctgtggaagacatacatgtatatatacacacatatgcacacacccctacctctaaaaaaaatattattctaaatgacaattttaaggcctccccattacatggtgaatgtagcattccatgcaatttttcaattttaaaaatttcatgccatctctatattccaattaatacctactaggagtaaggaatgatctcttaaaggcaactcccttagtacgtccaaagaccagtctaaatctttgatattttacttgctttatggacctgaattaaacaaatcaccaatcttcttcacagcatctgttggcttggagacgagggagcaagcaaaacagtattgacaggagagaatatcaagtttgttttttcagttcatttgaaatcagtttgtctctgtggatgacctaaagttttgtaaaggtcctttgctccccctgggattagacgtgccttagacctgtctagtagtaatataataggagtcacatatgtaatttaagattttctagtagccacatttaaaatagtaaaaagaaaaatataaaactaattttaatcatatatcttattgaattcaatgtatcagtcagggattaaacagagaagtagaaccagtagaagattatggagatacttttatacttttaaaaaattattacaaggaattggattatgcgattgtgggaactggccaggcatttttgaacccatatgacaggaagtcaggaagggaggatcacaggcaagttgagcctagaagctgtcaaccaaagttgtcattcacaggcagaatttctccttttgccctgggcaatctcaggcctgtttttaaggctttccaaagaaatcagagaagcccatccaaattatacaaaatctgcaaaatcatcttacttaaagtcaactaattagtgattttaattacatctgcaatatacctgcaagcgactctaggttagtattcgataaaataacttgggataatagcctagccaaactgagccaataataaaactatcacacccaatatgaccaaaatatcatttcaaaatgtaattcatataaaaattattaatgaggtattttacttatattttattctaagtttttgtaatctagtgtatattttatacttacagcacatctcaatttggattaaccatatatcatgtccttaatatgcacaaatgtctagtggctactgcattggatagtataggtctagacagtgatagtgattactctggttatcatgtaagtttagagcagtggttctcaactaggattcattttgccctgtaggagacatttggcaaagtctctggacatgtttcattgtcaagattgggaggtggatatgggggctactggcatctaaaaggtagaggctaggaatgctgctgaatatcctaaaatgcacaaaatagcccctccccaaaataatgcttcacccaattcagaatgtcaaaagtgctaatgtaagaaaccctgctgtagagtaaaatttggagactagagaagaaataaacaaaatggtgagagagacaggaagatgggcatttcctatgtcatttggagatatttccttacattttggagaattgttttcagggacaagaatgagtgccttacctgttcatatcttcatcaccatattcaaagtcacagttgagataagagtagattagtgaccctgtaaatagtaagataactgattaatgagaaaaattaggaagaaaaccttcacaatggtggttacctccttaacaggtgaatgaaagctagtagctgtcttttctgaagatatttagggtgttgccatggttgatcttaatttagtagacttttggaaaaactacaaaaatgcaaatgcagatttacaaatggagaatttaaaatgtgtacagtaattaacaccatctcagaccatctgtggaataaagttgtgataaataaataagtaaacctcattagcatttttctaagaaaaaacactatatttaagattaagtcacttttcaaaggtagcaatcatatttgtaaactctaatctcaaattcacttctatccaaattaactgtaaattcagaattaactccattttcttagccttggtaatgtatgtatactgaagctagcagaaaattgaatatatttgctaaaacctgatgtttagaaaaaaagtacaactaacttattctatgaaatgtgtcatatctgcttgcagtaattattggttaaatgtaatgccaaatgctgattataaacatagcttagagtcaatacttctgaaatatatttcctattagatagttgttacagttcatttcacaaattcttaatttaatatgtaaaaactaaatcttcctaaatctaaatgacattcttattaaggattcttaatttgtattgagagtaattgaaataaaaataattatagtttgtgaccaattttagcactgaaaatggtgacaacatagctctgtctattaaatgtttaagcttttccaaataactctaattttgagataactccaatttttcccttatttcaataaataagtgatttgtttagcaaaatgttacaaagactcttttagactccaataaacttgttagtaactgtataataatttaaactttgtggtaggtttataaagtttaggtcatagctatggcttaaattttatacattttcagagttttaaaattataaattctattttttcttagaaatacacaaagataagactgaaaaacaagagaaacctgaaaggaaaatacaaactaaaggtaaacatttcattttatgtttattcttcatttagatatacatttttgtgtattcatatgcgagaaaaaatttcatgtttagtgtttttgtaacatttttgatattaaataactaaatttactctcagttatataatgtatatcagttaatttcagttataaatgtataaataacataaataatatttaatagatggaatcaaagtaacttcaaaatgtgtaataatttttaaattatttacaattactaagagagtagctcaaatacatattgatttactgaggaaataattttttttcttttaagaagttagtgtaacaagtcagagtttatttttttttaacctgaattccttctgtcatgcaatatctttacaatctttggtgtagaaatgcagagtcattatatgacctcatggcagaggtcatgtaagaaagccccacggctctcctgcacagcctcaagaggtagatggacagtgacagcatgatgattaatatcactttcagctgaactgaatccagtaatggcaatcttgcagcagaagcaaattaagaaaggccagcattgtcttgcttatcttataagaataacttttctgtgggtgacagagatagtcataaaactttaaagaaactaataggaagcaagacattcaaaaatatattcttctaagcgtgcccaggttttcccaatggtcagtttcacatgattttgaatgagccagggcaaaaataaagatctcataataactatatttgtataatgcagacagaaaatgagataatttatttctgagataaaaatggaattttatccagtatttactatgtcataaaccagctaatgcaaaattatctgtagtaaataccacagttgcagctagtaaattttcaaataataaaagtatcaattaaattatactagcacgtgaatttatattaatacaatgccatgttgttgctgttgtttttaaaatatacttcatgtgctttctttttgggaagggctcaaatcattctacagatattatgtctttaatcctaatgtttgaattcattctagattggtcagccaattcttcaacaatcagaacattgaagctcactcagttgaaacctatttatatttgtacttaggaaactaatgtctccttactgttctctttccttttttcggttcttaattcctttgatcacagaagttggacacagctcttgagtacggattgactaagcgaaccatgactgaactggctctgtgtttctatctgctgaaggttaaacagaaactcaactggttccacaccatttgggtccctgctgtttttttcttgcagactgtgctattaatttaataacagtgctgctggagtggcggtagtaatgtagatggcaccatttgcattttggacctggctatattagaattctgatgtcaaagaccgagcagtgggctgtagagtaggtttattaaactagcaagtcttccataattaagacagtgaatttggctgaagtctaaaataaatttctcaaagactgagctggagattatcaacctgaatatatttcttgagtagaccaaatatgttttgtaaaagtaactatttcttaagaaagtgaaagtagagcttcagttgctccacactgagctggaaatcagagagagcttatgttttccacagtttttctgtgtgaatatgaacaaaagatttcactttattgcttagtttcccgtctgtaaatggggtagactaatgcctgctctttattctcaaatagttcagtgaaaataaatgttttgctttacaactgctcttgtatgtggataaatactgttttctgtatgccatgttccatgtcagttatggttgtatgtgatggatagttaggaatttaagttattatcaaagcattttgaacccttagaagaaaagatacagtatttgaaaggtagtagtagtctgtgatgattataaatgagtcaataaatatctgagaccaaaaagattcattatgctcaagctggtgtgttttgtgggatgacaaaagatattcgttatggtggaagctagatcacattctatttctctatagtttttttccccttcaagggacaatatgatattctgaaaggttttagaagcatggaactcatcgggagagccttgggagtctacacctatataattgacccatcaagaaggatgcaaaaaaaaaatcacacagaatatgtaatcccacaggatatatatttctaaaacaattctatattaatattctaactaattgattttatagtgtcaaataatgagtttcaattctgactctttttcttaagaaattagatacttttataggcaaccacattaaataattttactttatcatatcaagctaacttttatttctactttgtccctctgtttattttgttcgatattttcctcagggaagaatgcagcagtttatggagctaaagaatatgccttttaaatgataaccaggcaatgaatacttattatgtttttaggacacaagctctgacatgttagttaaggtttaccttaaactaagttaaccttggattttttcccataaaagaggtagaaatttattttattttataaatataatcagaatactgtatgtgaccttgtattggtcacatacagtacctcataaaagaggtagaaatttattttattttataaatataatcagaatactgtatgtgaccttgttctgaatttatatagtaatatagcggaacattacatttgcttagaaaaaacttccaaccataatttaacattttttgggttaccacatatcattaactaaattgtgactcatataaatggcccctggggaacaggcagaatgagttaaccacaatggagtagttttgagtaccaagcagagtgctctagtacaagttacctccaagaacgctgattccacattagggtgatggtttcaaattaaagtttttataggtcaaaatgatcttgcggaatataatcatatttaaaactatatccaacaatggatacccatggtccacatgttgaatgataagaaatgttaaccagtcttctctagcagtcaacagtctgagtttcctttgtaatcataaataactctgcccacagatgttttaaataaaaagatatatacagactaacttcaaagaattaaagagaatgttatttgtcataaataaaaggtccaagtcatgattattaaagaacatttcctttacccgtggtaaatactcagatattctaattaataaataaactaaagcatggtgtgtgattttcataaagggtgatgttaccataacctttttctacttttagaaaggtctttaattaaattatctgggttagaatccaaatttggtaacttctggctatgtgtccttgggcaagataattaatctttctttgcctttatttcatcatctgtaaaatggggataatagagttgtcataagaattaaataattatgaaatgtacttgtaaaattcttaaaataattattgactaattttaaacagtaactatcagttaattaattaatcatcttaaccacctctaactggatgagagtcccttacagttttcttatctgaattccttttttctctatctttagtatcatttgatatctgtctcatcataggctgaacaaatataagatgtgtcatcccaagttcctgtaacaaccctaaactacttttactgccttgtcagttctatatttgtgtttcccttcttaaaaatttaatattgtatgagtgtttatctactatggatgaaatactgtatataattttttatgtctaatatttcacttaatcttcatagaacaatctaacacagtagatataattccatttaaactaagaatacgtaggtttacctggattcaatcattgtgtcaagtttagtaatttgtagagccacatttttgcctgttatctctaacgtaagaacatgtggcttttccagtatatcctatatccaattttctttcttctttttgttctttggtgcctgctgagtctgtagcaccagaatttgctcatagccataggatctagaatttgtctctgaaaccctgtggttagaaccttgcttcctgctggttgacctcactgatctgcttgcatttgtacatatctatcagttcctagataccatctctgttctcttcccatcagtctgtgtgccacgtagcctgatgtgggcttacctaattctaatagcttacctgtatagtagacaccatataaagatgcatagactgtatgcatctttaaatcccctttctactattttcagtcttaacacaactgagaaatgagatgtggcagtacttatcttggtagatgtgtcagatggcttgtcataggtgtactagttttctgtggctgctgtaacaaattaccacaaactgggcccacctgaataatccaagataatctcaccatctcaagatccttgacttaatcacattgcaaagtccatatatatatgtaacattcgcagattccagagactaggatatagttatactttagagggccattatttggcctattccactgtcttttcaataaataaacttcaaatcaccagatctaattacttaaacagcatcgtggagtcaaaggattacttaaaggccccatttagaaagaagtcttgacaagcatgcatgccagtcagtcagagtttagagggactgataattaaatataaaaatacaagttttttttaaaaaacttttagattcaagggatacatgtgcatgtttgttacttgggtatgtttcataatgatggggattgagctcttctagtgtgtccatcacccaaatattcaacataatactcaataggtaatttttcaagcctcagttcccattccaatctccccattttttgagatccctagtgtctgttatttccgtctttatgtctatgtgtagcaattgtaagtgagaacatgcaatatttgattttctatttctgagttagttcacttaggataatggcctcccgctctatccatgttgctgcagaggacataattccattcttttttatgactgaatagtattccatggtgtatatataccacattttctttacccaatcagccactgatggacacttatgtttggttccatgactttgccactgcgaatagtgctgtgatgaacatgtgagtgcaggtgtcttttttatataatgattttttttcatttgagcagatacctcatagtggcattgctgggtcaaatggtagttttatttttacttctttaagatatccccatactgttttccatagaggtcgaatgaatttacatctccattaacagtgtataagtgttctctattttatgcatccatgacatctgttgtttttgactttttaatagtaaccattctgaatgatgtaagatgatatctcaatgtggttgtgagttgcatttctctgatggttactgatgttaagcaatttttcatgtttgtgaatagaaagataaaagtatttaaagatagaaaccacaaaatggcaaatattaccaagtttacagttcatggtagaaaaatagcagcattatcacaaagacttttgtatatcttcaggtatcagcatagcaaaagtaagatgtaaagttactatgcttatggaactcaggtttatgaacatttctgaaatttcaaaatttcattatttgagagatcagaacaaatcagaataactactatttttgctttttccttaggcagcaagatgagttcttttgttttttggtggtattaaaattttgttttgtttttgttttgcttttcttactatatgtgaagagcttagtcaccttgacaataggacacagtttgtgtatggccaatgtagtgccatcattcccttaagatataaattcctcattaaaaatgcatctttaatgtgcacatatcttaaataaaatcttaagaatgtcgtgaatatcctgagtattttcttaattggataatcccttagcattctatttaagccatcaactaatttaggagcccaagtggttaattaattttgatatttgaaaaggctgaaagtatagaatataaagtctctgagccttcttataaaattcccacctgactttacacaggtaactaacagacttctttcatctaatgtattcaagcccatattaacatctattgcagaaaatgtctgcacctgtctgtattctttgtcctaatgactgacatcactgtccacccaaattattcatgctaaacatctagaagccattgttgccaggggtggtactcaaccctgactgcactttagatcaccaggatagcttttaaatatgtatctatgtgcgtactccagcctggagccattaatgtttgagaagtaatgccagggtttgggcctagctgccctaatgattcaaatgagtagccagggttagaatcactgtctgttgaactcatggcttagagttcaaatatatcccacagtggtttcttttgacgagccagtgttttagataatgagtaactggatgcctttaagtggggcctgcaccctctgtttacgacagtctccaccactccctctttcaccactggggtacctgttaatttacctgtctcatctatgaaggcatttgaattttagttcctgccatagacttcttgttctctttcaacaccaaagcttgtccctgccatagacctttttgtctctttcagcagtagagctcaaccctacttagctcctccgtactataatttagtctactttctctcttctccaactgctatcttctccacaatcatctctcaattaaattgtgacagtcacttcttaactgatttcccagcattaacccctcaggtccatgctaatccagtcacttacgggcttaaatccatttgttggtgccccagtgctaagagataaaagtgacattttccaacctggcatatgatcactgctacccctacagcgttccagcttcgtagtttatcatgtcttccctgttctgctacctccttaccaagctttctcacagatacagcctcctcctccctgccacccttagcactccagaccccactgatgccccctgtactgcaggcaggctgagctgttgagtagtccctgaacaggcattgtcactgtctcataactgtgcactttttttgtatgctctcttctctccagccatcaagcccttcctgtgtagtcccttggcaaaagcctgcttatttctttgattctcatacggagtgtcagttcctttaagaagtccccactgctgttcttcactgggggcatttaagcactttgtccatgctgttccaccccagcttttgctcttccaagcactttgacaacatattttaattgtgggtatatgtcgatctaactaactgagggagggaactatgtttgtcttcatgtatgttctagggcagccttgccactcccttttatgattctgttttgttatccatgaacaaagggatatgggctcatagtcttctcaggttttcaccagctctgaatttgtatgcttatatcaaattaaaaatcattctaacatctaacagtacccaacacactcaataaatactgaaataacgatttaatttgtgaacgaagtattcttctgttttgttaatctctactggattcctacagacaactttgcatttgacattcctacagacaactttccatttagctttaattaagccactgtaatttaagtcaaatgtctgtggttagtggcaacaaacaatttcatactaaaacaaaaactttctgtaatatgtaatctgaaaacacccacactgaaacaactaaaattataatagtacagataaatatggatgatttggaaaatgcaaaaaaaaaaaaaaaaaaaaaagaggaaccgcacccccacaatccaattaactggagaaaaatagtaatgtatttctaattttcctctggctttcccccccatgtagttgtttgtttattgtatattgccttatttttttgcaattgtgaattttattggtgatattagataagatttcggcttctatttaactaatagacatgtcaatttacttgtagaacagaacaaatcagaaaagacaggaacccagtggtaaatatataactaaatatgtgaactttttccaagaaggctcctagacaataggatggcccggtaggcggcagaacagtaggtttctgctacatccacctgtattgtcaggtggttgggtgaaaaagtgacctcagaaatggagaagtttacttaacagaaatgtatactggagagacagcatatggtcagcttcagagtgggctagacagcgggaatagggtgtattctggcaggcagatagtgtaaatggaaaaagtggtcacagccactaggtgataatacacattcacttattcacagtacctactttgtgccaaacaccatactgggcactacaaattccacgatgaataagatccagttaatgataaatttgaaaaagtaaatacacaattataccacatgtagtaagtacttcacagagatgtcctcgaggagagatgtagtttggggtttggcaacctcagttgttgagtaagtctgtctgcagttttctggaaggacctcagaggaattagtggtttttggttcaggtgtggactctgaagcttaacagggaagacacaaaagctaagctgacatcagtcctcaaggaaccaggtgggaacttggttcaagggctgcaacagaagtctaattattactattattcttaacattagccttaatattaccttattgaggctggaagtccaaagtcaaggtttccacaggatgagtttttttctgagggctgtgacgaagaatctgttccatgcctctctcctggcctctggaggtttgcgggcaagctttggggccttgtagatgaagttctccaattcctgccttcatcttcaaatgatgctctccctgtgtctctgtcttttcacaggatatgcattccctctgtgcatatccttctctggacccaaatttctctttttataaggacatcagtcctattggattagggactagcctcatgacttaaacttggattgtctctgtaaaaaccttatttccaaataaagtcacattcttaggctctggggctaatgacttcaacatatatttttggggagacacaattcaacccataacaatatcatatgcacaaaaaacaaaggattgtttttaaaaagggtgattcagaataataacactgatttgtctagaactccttcagtttttgggaaacaattgcaggattggagtcataggctgacaagggatttagctgatggtgaggctcaaaagtcaaaatgcaatcaaatacattaaaatatatttaaatatcctgaagccctttataaaaatgctcttaaagcccacaaattcatttagtcttcctgtactgtataaacttttatttttgtcttctcttagctgcacttcattaactccttaaagtacaaaatatattttctttccctctctggcaatcatgaaaaataaacctggacaaggaaaccagaagagtgtgcacaaagctatgcatcacagtgtccatagtgaatgttcacttatgagaaagcgattacagttcttactatggctatgtagccccaggagaaggggaaattgtccatacatttaaattgaatttgaaaataaaactaatattttagaattataaaatatcttttgtgatttaacgcgtaagtatcagattagctttacaactttgggtaatttgcctgatcttcactttaataggtaaatgaaagtacttttattatgaaaaagaagtatgtgcattattggaaggtagatcacagataatgtgcttggagaattcggtcagcacattttggcttatgagaacaagtttatagtctgcacagaacctggaacagacatggctgcgtagttttgaaggagagtcctggtttagcaattagataactacattcttttcctggtctgtcacggactcttatgagcatattttcttatccacagacaaagaagttcagggtagttacttcttatattcctatcagctctgaaattgcatgcttatattaaagttaaaataataaattcttcctttaggaaaaatggataatataatatttaagaagatttttaactcaatattgcatttctattaagttcatgattttctcttaaaaagcatagagatcatcttgccttaccacagaactgaacttctacaaattagctaccaaaaataaaaaagaaacatacacacaaagacatacacactaaccaagagatctggccttattgtttaatggtggctgaaacagaatttttttaagggtttaaaatgaatgtgtatcatgctctttcataaaacattacaaattaaaatatagatatatatgaattttatgaagctgtttgaaatgttcacctacttaaagtctatagagtattttagcactaatacctaacaaaaaagcacaagaaatgtgaaaatgagaggaattagttaaaagaaaaatcagtaaaatttattacaggtaatgatgctcctcaaagattttttctgttaataatgaaaagatataatgcttacctgattatccatctgattttttttttttggttgggtactcaagattagtcctatgcagtagtctaaagtcaagtatgttctagagtttggttgaattgatttgctagccatcaattgaagaatgtagtagcctatacaaatcagtactttacaaattttggcattacaatttttgattttcaacctaagaacaggacgattaagtaaagaactctgataacctggctcccatgatttgaccccaagggagtgttttccctgtttaaaaaaaaaaaaaaaaaaccacagggtcaggcagattatgagctctgatatacttgagaaaaagacatagtctgcctggtgactgccagggtcaaaaacaaaaacacagagcacagcttggggagggctggaaaggggccagatgggagggtgagagatgtgcttgggtccagttgagctgaatgttctggtcagggaaaggtcagagtctgggcaagggcaggaacagcaggcccatgccaactcagatgccagacatcagggccattccaactggtggattccatttgtttttaattatcagcataccgaagggacttttgtttcttgtaaataaggatgacaaacaaattaaactctagcaggtgcaagaagcttattctgtcctgagctaaaaactgtcctggctaagatataacttgccaaatagggctggtgacaaggaggtactcttcttccatatgaaaactcctggttgtgggctctaagcagagacgctcaagcgaatgcagctgctctataggtgatttttattttagagtgattaccaaggcagttgctgattgttgcattgctgtgttgaaagtcatttcaaaacttggtatttgagcacagtcttgccaaagtttgaagtttctgtccaaggagcttcagtggctgtctgccattatgaacagctccctagggcccaagggtccagctgcttcactaagaagtgttgtgatgccatttctgagggggataataaaatgctagcatacagtacagggtctgtaaatcaacacttcaactgggaggaactggatttctccctagggtaacaggaatgaggcattaatatgctaatttcagtccgaattcagtccctttgctcttttgattttgtgttaattctcccatttatgcctttgcacacgtcaatctgaaaatcctttagtggaatggacaaccagctgtccaaggtgggtgagtcctcattccttacagagacagagacacagattaggtgttcccctgtgggtctttccaatcagggctctgaaagcacagcttatctcacacaaacttggttccccctcagagaaactttaaaagacgctttgtttttgccaagattttctcttggttttctgcttaattaatagggattcaaaggaaccaaaataaaccatttgtggtcagtatgaatagtgatttccttgccttattttgtgagctatttatattgaactgagtagcgaataaacaactaaaagaaccattaaatgtggaaaaaaataatatctcaatgttttaaggtgagtttttttctcctttttctcattaggttttgattatttgagaaatttcaataaattgtcaaaagtttcacataattggaagcaagcagtgtctattatagctctaccacatcatcatccataaatagaatttaactagacgataaaactagctcttaacatattttagaatttcacttattcaaaaatattacagagtccactatgtgactgagaccttgtgatgacttggaaatgtaaaaaaataaaataaatatgatgtagcccctaaggatttcatttactgagtagagatattaacaatatcaatattattattgaattgctgaaatataattatgtacatggtgcaattggtgaatggaataaatagagatcaaagaaaatgttacagagaaggaggcatttgaaccaagaggaaagagtgcatggaatagggaaaggaaaacgaatgaatgtgggtgtggtaattctaggtggaagacacatacaggcagagacataaaggcatcatgagggcatgtggtgtgcttgtggagctactagcatttagttataatgagaatataaagttcaaggagaaattctttgtagatgacattgggttggtaaacatggggttggtaagaaaatgtcagatcactagagcagtaaaatatttttattttgatatagcacccactatgtgacagataccatactaagcagtgaggaggcactaatatttgtaacagaggagtcaatgatatcgaattttcatgttagaaaggttaatatgagacataaaaatataaaatctaaaggttcaaaagagaagtcagggtattataatattatgataggtataataatatgcccaaaagagacatcctgcttcaacttctgaactggaaattggtctcttccccttttccctcctaatctcttactaggctaatttcttctcatttctcatactcttaaatgtcatttctgccaagggctcttcccctaacaaacagattagattaggtcatttcatacatcaacattccaccttacatattttcttcatagcagttcgactccctgcagttacccacctttgtaattatttgcttagcatccactagtcattagcttattgacatcatggcgacaggaatgaactctatcttgttgaggagagtctttagcacatagcaagtgttctttctatattcttgtataaataaatgatagttagggaaaataatattggataaaagaaaatgaggaagaggaatatcaaaaagacatgattgaaagagcgtggtgaatgaacgaaaaggaaaaatataagagaaagacaaattgggatgagtctcatgtttctagcatggataatgaataagaattatgactaaggtatggggtaagattatgacttaaattttagtcctgttgtaataattgatgagatcactgctcatattaaattaaattttatttttgttggaaagatttggtattttatagtcttattccagtatattttttaaaacatttagtgtagaatgtttctgtagacgattaacacatactgtttaagttgatagttctttgcttcaagatcagaaaattatgtctctatattttcatcctcatatttcaagcattcatccaatatcaaagccgggctcctttggcatatggcataataattttttaaaattttccaattatttcaattaaagattcggaaaagctgacgggggtattcttatctttgcaatcagacttggtttgggtactagtttgtgcttggatatgaaataaaatagaaataggaaataaatctgtaattatcttgaagtttaaacctctaactacataaaatctgaatccagttaaagaaagatttctaaaaacagaagataaattttgacatcaaagactgccgtgcaaacatctcctcatttattcctgttatttaaatgaaaactatttatctgtttcttttcagttacacacaaagaaaaagaaaaaggaaaagaaaaagtaagagaaaaagaaaaacctgaaaagaaaggtatgaagttacttttattactgtttaacacactgagtcctttcccattgacttcctactctttacattcagattttagatgaccacgcagttttacaaattagattaggattattttctcagaatagaatctgaaaaaaggaatttctggattgagagaaataaaatacttcagactgttaagaactgttgaactggaaagtggtaactttccagaaatgttgcgtcagtttttcctctggcagttttgagactgccttagccagcagtgaggatattatatcagaaatacttgtcagtttgataggtaagaaagtagatctcattattataacttgcatattttgattatctattagattgctttaatttctaattgttatttatttatgtagaatagataataagttctaattgctcaacacataaagatactttgtgaaaaccttcctctcaccttgctcccagcctactggctcccatttcatgccaaacccacatacagtagaccactcatgtgaattttacatgcatccttccagagctttattgtatgttttccagataatccatgttattttcctccctatttttacacaaaatctagtatgtcctataatctgacttttacaatttaacaatatatcctgaaatcttctcatatcactaaatattgtcctcattctctttaaaaagctgcatagtgtttaaatgagaatgttcttccactgtaatttttcctgataatctagttaattgttaaagttaatttaatttttattttattcattaagttcttcatttctaggatttctgtttgggtctttcttatgatatctatctctttactgaatttcacattcagatcatgaattatttttctccttcctttgtattttttatttgtgttctctttttttctctctgagtttccttaagattattattttgaaaggcatttcatagatttcccttttttggaggcctgttactggcgtgttattgtgttcctttgaaggtgtcatgttttcttagtttttctttcttttttttaaattttactttaagttctgggatacatgtccaggtttgttacataggtatacatgtgccatggtggtttgctgcacctatcaacctgtcatctaggttttaagccttgcgtgcattaggtatttgtcctaatgctctccctccccttgcccccaaacccctgacaagccccagtgtgtgatgttacccccgagtccatgtgttctcattgttcactcccacttatgagtgagaacatgcagtgtttggttttctgttcctgtgttagtttgctgagaatgatggcttccagcttcatccatgtctctgcaaagtatttttaactgcttactatttataagttgaaagattcaaatatggtttttagcaatgtatatatcatgtgtaactgttcacactcactgcccatttctcctaatgatatgtgtgtgtgtgtgtgtgtgtgtgtgtgtgtgttttgggtatgtatacccttcatctataacttattttcaaatatttttctgaatttgtttcacagttaatattatgctttctgtctttgtgaacggacatgtgtgagttcatgtatgtatgtatgcatgtgtgcatatgtttagattcttgaatttttaggtggttagatatgctgacattttcttgtggtctttctggctttgaatcttcattcaagaattaattcaatagccaccaatattttcctcaagtttaaaaaagattgtttttttgttttgagacagagtctcactctgccacccagactggagtgcagtggtgcaatcttggctcactgcaacctctgcctctggggttcaagagattctcatgcctcagcatgagaactacagacatgtgccaccacacccagctaatttttgtgtttttagtagagatgggtttttgccatgttggccaggctggtctcatactcctgaactcaagtgatctgctcacctcagcctcccaaagtgctgggattacaggtgtgagccacagcacccatccaaaaaagattgtttcacattttaaatttaactttaattcctcaaaaatccatctcagtgtatgatacgaagtaagattctaacttaatttttgccattgttttagggtggattgtgtctaggatagctgggccagatttcagctgatttatgcatccagagtatgcatagtctgctgaagttttttgttttgttaaacactccagttaggtagaacacattatgacatttaggaatcagataagttgaaatatgcttcaatattttttatggtatatttacacttgaaaataccaaaatctcaccaatcaccactaaaaagcttactcatgtaaccaaataccacctggaccccaataacctacagaaaaaaaagaaaatttcaattaaataattgttattttcttcatgtttattttcttattttcttatcttattttcttcatgttcaatttccatgaacttcaatatagccatctcctttctctgttctagaaataggtgaccatttcttgtctgatattgggttaagcagaattattagcactaggctctgtgtattctgactcaatgaaataatctgctatttcttgtgattttttttccaaactttacagtagctaaatgttttctgttaaaaaaaaagttaggaatttttgcccttaaattataagtgctgcagaaaaaaatgtattcaaattgaaaagcagaaataaaatgctgcattgtaagtgctcttttatttaccttatgccaattaaaggatgtttgctttttaggagatatgttattataatgtagtcctgtgaccttgtttgaatagtgccttgcttagcctagcataatgctccttttgttaacattgtctaatctattacccataatcccaagtggtagtggaggtacctgtgggcaggcctgagtggtggagaggctgaaactctggaggaggaggcacctggtctctcagcagctctgcatgtgttagggacacttgctcttcaactgaatattaggctttctgaggcttaaatcatctctccaagattctggaggacactgtttatcaactgtatttaaaaataatggatttttaaatacatattttaagcatttcttaatgatgtaagtaaagctgatgtacattattactattcttgttggaagtaggagaaatggaaatatgtggaactaattttttcctctaacaaatcagtgcatacactttgttaactgcccaattaaatctcatattttactacttaattttcgtagtttaattaccattgttattcttgaaaaaatagtatgtaaatattgaaaaatgtatgatgatttgggaaactaccaaacaacacaatttaatataattcaaatttaaaaatacacataatgacatattttttgacaaattcttatagaaaattttccctttcagtttgtcttccctgaaagctttacctgtttgaaataatgacttgagaaagagtagatctgattttcaacaagcttgctaagtcttaatgcctagactttaacattgaattcaatacaactgttattacactggtaactctttatttctgaattagacttattaatgtcatacattttcaaaatattacagattaggttttagcacttatgaaactgaggtcaaaagaaagcttggttttgaaatctattaaaaatgtgtactaatgtaaaattttctgtttaagcaactcacaaggaaaaaattgagaaaaaagaaaaaccagaaacaaagacactggcgaaaggtaacttttcaatttattatttccataactaaattctttttactctgaaagattaatttttgggtaacagatagttggatatttgtaaacttttatcatttatattaaaaagttaatttggtcttacctttaaaatttaatatctaaaagaataattaaactgaacacttaatagagaatctcataatgtgagaggaaaatgaagagctccatcatatgtggtagacagaattttgagccccataaccctcattcaccccttggtgtcatccctatggctatgttatattacatggcaaaaaaaaaaaaaaaattgcagaggcagtgaagattgttctaaaatagggaggttatcctggattatccaggtgggctcaatgtaatatcatgagtctttaaatgtagacagattcagcagagaacaaagagatttgaagtatgagtacttttgcccattggctgtcttgaaaacgtgagaagaatatgaattctgcctccaagttcaataagcattaaagccaattctttcctctagcctctagtaaaacacaaagcctaggtgacaacttgatttcagcctcgtgggccctaagcagagaattcagtagagccatgctgagccaacactttggaatcataaaaactggaagataataaatgggtgttattttaagtggctaagtttgttttaatttgttaccacagcaataaaaaaactaaaataacatatttggttcacaatttttgaccagtattataccttgaatttgattttaaaatctcaaattcagaattttctttttaaaaaattatttattttcaatatttataggtacatagttgttgtacatatttatggggtacatgtgatgttttgatacaagcatataatatataatgatcaaatcagggtaattgggatgtccatcacctcaaacatttattatttctttgcattgggaacattccaaattcactctctagttattttaaaatatacaataaattattgttaactatagtcattctattttgctactgagcaccaataacatatattgaggaaaggacagtctcttcaataaattgtactaggaaaactgtatatgtagaagaatgaaactagacctctatctctcaccatatacaaaaatcaaatcaaactgaattaaagacttaaacgtaagacctgaaactatgaaactacttgaagaaaacattggggaaacactttaggacattggtatggacaaagatttcttgagtaagacctcaaaagcataggtaaccaaagcaaaaatagacaaatagacaacttctgcaccataaatgattttcttgcatcaaaaagaaataattggctgggcacagtggctcacctctgtaataccagcactctgggaggccaaggccggtgaatcacttgaggtcaggaattcaaaaccagcctggacaacatggtgaaatcctgtctctagtaaaaattaaaaaattagccaggtgtggtggcacacacttgtaatcccagctactcagaaggctgagataggagaataccttgaaacctggacgcagaggttgcagtgagctgagattgcgccactgcactccggcctgggcaacagagtgagactgtctaaataaaaaaaaaaaaaaaagtggtcatgcataaatcttgatcaatatttttactttaaaagtttgagaactgaaagtaccataataatatgccaaatatatttattagtatatcactttaatattagatattttggcatattgaataacaaagtttttctgtattaaatttatctgccaattactagaaaaaatggattttatttggtaatttaatcttattccctacatttaaatttcttccttatcttttaaaatatacattttaggcaattagctagaagcctcaattcagtatttttaagaaactacccatttaggtaaaactcagaagcatttttaagatttagtttagctactaaatgtaaaataatgagatatttgaagcagatatattttcaataaatcttccgttagataaccaaatatcattttattaaagttaatatggatgaattgtaaactgaaacatttttagaagataacatgaatttactttcaagattaaattaaaataaataaatgtaattttattttgtttctcctgtttcataaatgcaagtgaaaataaattttgtatatatataaaatttgttttcattacatatacatgaaatcatatgtgatagatgtatgaaatctagtggacattttaaagatcatctaaattaattacctcgtttaacagatgaagaaagtgacctctagagagagagaaaaacatttttgccaggtcataaaactggtatatgatttggttaagactaaaaacccaggtgcagtcagtatacattgagtattcttcacaaaaataattaaatacaggtcttcaagcatcttttttttttcaaaaaatttgttgaatactgcattagttacttattgctttgtaaagcattaccacaaaatctgaggcttaaatcaatgcacatttattatctcacagtttctgtggatcaagaatctgggcatggcttagctcaggcctctgtttcacaatcttacaaggtggcaaacaaagtgttaactaggacttcagtctcatctttagtttcaactgaggaagcaccatttgcaagttcactatatggttgttggtgagattcagttcctcaaggactactagccaatcagttcctggctggctgttggctatggaccatcttcagttccttgacacatgagtctcatcaacatgacagctggcttcattaaacctattgagagagaaacaggaagacagaaattacaatcttatctagactaatcatggaagtcatattcaatcacctttagtatacactatgggttagctgcaaattcctagggcaacccatattgaagggaagatgattgcacaaggatatgaatgccacaagttgggagtcactgggagccatcttgagtctgcttgccataaatactttccatttaaatatttacatcattcttctgggggaggtgcacacacacacatacacatacacacacaaacatacatatatatgtgtgtatatatatgtatgcataagtatatatgtgcctgtttaaaacatatatatgtgtgtatatatgtatgcatatgtatatatgtgtctgtttaaaacatatatatgtatgtgtatatgtgtatacatgtttgtatacagtatatgctttttatttttattttatatgtgtatgtattatgttattataagaaattaatagaaagtgttctttatgtaataggtggtttctggtaaaacaaaataagataaaaagtcataagccttctatgtgacattaaagatagaaaatatcataaagtatctttgaaaggtgtgaccagttaaagtagaatctccctttgaagagctgtgatttctggaggcacttgcatagaacacagcatgtttcttgctctgttgcatactgcttgctgaaaggcagccattggttagaacacttcagggattcctcctggggaagagtagacctttaatgtctaccttgatacatatgtaggaccccatatccactgagaaatctagcctatttctgtagttcattaaaaacaacagagacaaggtagaagaaaaagaagaaaacaatgatgaaaagagaagttgagtgaggtgagccaagtttgggccaggctgtctaattgatgtggatgtcagtgtgaccttcagatgtctgtgtgtttgatgatgtggcagaggttattgctgccttggtcactttcaggaagacattttatcactttcacatcgttcatgtatatttatatctgcccttatatgtcttaaaatacagtttttgtatcatctttttaggttaatattaatacgtgtgcaattcactgtgattagaaattgggttagtcattctgattctactctttctactcctaactcatttagttgcaccatctttgataaatggctttttgatacttagatttttcaaatgtaaaataataatgaaatagtaattcctgctgtacattaaactgtggataagttctagggaaactccaagagctctagacatgcagattatgcagatataatattagaaatgtttacatacttattttgcagaattcaaagttattttgctcagtgttactcatctccacagcttccatagaggaagaggcagttacagtggcgattctttttttttaacgcaaagaaactgaagcagagaaaaaagttaagcagtttgcagttctttatggaatgagagagaaaatttgttattttctaactcccaacatgtgtagtatgtttcttgagggatactattctatttaatactttggcatcagacattctgaatctgatgcagtagctaatggatcacgctaattccaagattgaatcaaatatgctgatgtcattttttttgattaggccattttgttttccatttgacaaaagtcatgaataaaatgccttcctaaataaaactgggtgatttgaatacccatggcaatactttttgtttttttcattccttaataaatttcatcacttaaattattttagggaaaaatcaggaaaaatattttggcacaaaattgaagaatgtgtactcaaaagtaaatagaagttgggtgttgctttagtttcatgatattttctttattatagccacatcattgtttagttgtcactcatttttttctactatgaggcaaagttatctatttccagagtgaatgtgattgaagagtgtctaaaatagtagaaaatattttattatttttatacttaaagtcaatgattataatgagttggctatatatgtggttctacctcttagaaaataatcattgcccacttataaattataatggcattaaaaagaaatctgaatttcacacgtctatagttccatactataaagttaaggttaaatcaactgtaacttacaaggagtagatagctgtcatttagagtaagcaaatataacaatttcatacaaattagtataaacaaaaaaaaaagttggcaagtttaacaggtttagacaagtttatttctaaacacatatttacataatgcagtctctatatcactatattatacatatgatctgagtatagtggaatatttactctctccatcaaaattgctaatccagtatacatttatcctctgttttctctgaaagaagcattgtgctagacactatggtgatacaaaaataataatagaattcctgcccctaagcactgtctgtctggtagggaagacagatagatcaaactatctatatttcaagatatataataaagaataaaatgtataatttaataaaaattcagaaaaatggaagctcatgggaagacattattaattcaaatgggagagccatttttttgcatgtgaattgaccatgaagaaatttaatcccagcactttgggaggccgaggcgggtggatcgcctgaggtcaggagttcaagaccagcctggccaacatggtgaaaccccatctctactaaaaatacaaaaattagctgatgttggtggtgcacacctgaaatcccagctactcgggaggctgatgcaggagaattgcttgaacccgggaggcagaggttgcagtgagccaagattgcaccattgcactccagcctggcaacagagccaagagtctatctaaacaaaaaaacaaaaagacaaaaataaataaaaaagaaataaagaaatttaaatatgtggaaaaatatagaaaatatagagaatgcagtctgacaacagttgacacatggaaaaatacataaaatattcaaaagaaagaaagcagtccagtagaggaataaatttttggaaaagtgctgtaacatgggagataggaggaagccagatattgcacggttttaattttgctgtgctaaaatttattcaggtagttttattattatgctgatttttagagctccagcaactagctgtgagcccaggtcaacatagactctctagaagtgttttttaggtgaatgagttgcatgagattgaggtgctgttgaccactccagtgaaactttctttccagacagacactaataaacattccagtgtggaattctggaatgatttcaatttaaagtcatccgcagaaagctgctggtttcagtcacagaaacgtatgagtttactgcaggaaagagcagaaaccagcaaaggaggtttagaaatgatttataggaagaagaaaatcccctgagtgtagttacagaagccacaaagatgttgaaagtttatggacatgtgaaaccccatctctactaacaatacaaaattaactgggcttggtgataggcgcgtgtaatcccagctacttgggaggctgaggcaggagaattccttgaaactgagaggcagaggttgcagtgagccgagatcgtgccactgcactacagcctggatgacaaagcaagacttcatctcaaaaaaaaaaaaaagtttatagagtaattgagtaatatttgtatgagaattttatgattaaacaatattgaataatgtgtgtatcataattccccttcttaaaaattctcaatacacttcagctttgagaaagtccaagctaaacgaccaggttagcttattgttgccaaatgaatttggccatgagaatattctccaatacctaatacagtatcaacatcttcctgtaaatatctgaagtatctgagaaacagtgttttgggaagtgctggcgtagtcaattaagtgcaataccacagatgatttttggtttgcaagctaaccagcatctggcattatcattttcattctctcaatgggaccttctgatattatcttggcttagcctgaaatcatcatttagggtaccaaagtcaagaaacttgattacattttttcattaaattcttttttttttttttttttttttttttgagacagagttttgctcttgttgcccaagttgtggtgcaatggcgcaatctcggctcactgcaacctccgcttccctggttcaaatgattctcctgcctcagcctcctgagtagctgggattacaggcatgcaccaccacgcccagctaatttttgcatttttagtagagatggggtttcaccctgttagccaggatggtcttgatctgctgacctcatgacccgcccgccttggtctcccaaagtgctgggattacaggcatgagccgccatgcccggccttcatcaaattctttaacatgagtgacaataaaggctacacagtgcattagcaaatgacatagaggattccaacattgcagtagagttgctgtggtgtatagtggttatgtgtagtcacatacaaaaaggaatgtccaatattcagcatctattatgaacaattttccacaaattatgtgctacattattactgctttttaaaagatgcttgaatgatccacagactagttatttgcatcacagttccctcttccaaaatacggataatatcaaattaagaatatatgtgtgtaatatatatatgttctaatttatatatctattcatatatatttttatttatagccctttgaatttcccatgatatgtttaagggctttaaaaactagtagaattatcgctgacttaagataaacaggagccaatatctgaatttcttcactttcagtttttctaaggccaaatcattagactataggtctttcagttatcttctaatggatttcattgttttatttctgttagtcaacaccaatgcgataattttacacttgcattactaattgttgtctttaaaaaagactttgttggcatttcagtttcttgaatgacccttaagatctttcagttatcaagcaaaatgatcatgtgcttataaaaggagactacttcactgggctgtttggtatggaaattgtctttcacagaaattcctgtacatccatcccctgcatgctacaaatgcctccttgttgacatgctaagttactattgccttaaaaaatagtgttttcatgtacaaattaaaagccataacacttttagtagtctatctaatatagcacttcataaactgtataaaactctggtaagtcacaagtgtttatgttaagaacagtatttttcattgttttcctgaaaaatactgttcttaacataaacacttgtgacttacctttcttccctctttcttttccaattttccttaatgacatagtacagatgaaacattatgtttgtaaataaacaaaagtatttcaacatcttttaactttatacagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaaggtaaacattcagagcaggaggctgccggaggttctaagagaatattgggcaagaagcacatgcagtgaaattaaaagttgaaaaagaccaaaatcagacttcaaatgggggtaaaagacattaaagtaaatatatcagaaaagaaatacagtaaattgggaattaatatttatttataaaaatactaaaatgtgttcacagatctaaaggggcattttgaagtatttttaaaaggggtttggaggtagcatccgaaatcatataaagattggggataaatgttgaatttttgagatatggaatgtctattaagaggtggaataaagattgtatgtgtcatactctttggaggaaagtggtcccccaaaatgacagcaattcctaaggagtttgtgaaggggtacatgttggaatcatatagagtaaatatcataaaaactatccatacattactgttgcattggcaagagcacatcatttagaatatacatccaattattaaatttatttaataggcaagatgttatagagaagacagttctcaagattctttttcagtttccattgactaaatttctaactttagaaagctctgaatgtgacatatttcgccattcttcagcaagagtgatgtcaaacttacatccccactttgcaaaaatatatcacttcaatggaggtggcatataaacctgaatttttattttatggaaggttgctatgtgaatatacagagctgaaggtttaggagggcaactaagggtcttatcgtaccacatctctggcccttattgaatgtttcttttcctaagtccattcctgactccagtttgctgtataatcctgagactcctttacagaatacggggatctaacatgtagagactattcctgtaattggtgtttcttggagacattgcaaaaccaaatttttctttactttgtagcacttttgactaatgttatctaaggactgtatcaaagaattggtttctattagattttagtttaagaaatcttacaattttattacagagcaggctatttggaggatgaaactgaaattaatttttcctcataaggcacaagaaatgaaatttgcaatgcactcgtactgtattttcatcttttttctcttgaatttgcatttgtaaactttgattcacatgtagtatttgtcaactctgatttatatgacaaaagatacatattttaaaaatatatattttaaaaaggaaagattttttctttttttagtgatctacaaacctttaaatttagataattttaatttattattttaagatataagtcatattaaaacttaggagctctaaaactttttccaattttcaaggtgattatatcaccatgaaaaaaatttaaaagttaattattacttccatcaaaattatgtcattaatgaaatattttggtagacaaaaaggatgaagtaagtaaagagaaaatacgttgaatataatattttactgtggtaaaaaaacagcagaaataatctttggattcactggtatgattacttagatcctgaaatcctttacactttagattgctgttcaaaaagaaaaataatcacatgaaatcagtgaaaacctacaaagtacattctaatttttaaccataaatacagagtgtaaaaattgatgccagttatatttggaaatgtcaaaatacttatctaacaactaggaatgtgaatgtattttttgatgttaatttttcatatctttggggatttgggagccacattttattgataaaaactcatcaccggaacactttaaaataatgtttattttccaggccacaaatattgtatttcatttctatcagtaatcagatttattaaagacagcattatattaccatattccttttcagtctactatttttatttctacacaaagagttatttatctattaaaaggacattcaaatatcatttagagtttaaaacaaaagcacaaatgtgattttatcagctaaataattgcaattgctaaagcaagtctcagtattgagaacaattgccatcaattatataaatgtatcattaggtaagtattcaaaacttaacctctaatggcagatcagacatataaatatgtcattttatttttcattttttgttactaagcaaagatttaattaagagcatttttaaattaaagaaaactaattacattatgattttagctaagcaagataaagatatagttttttttaatttctgaggctttggttttgaaaattttatatgatgacttagttgagttagctcaactaagctaactgttgagttagctttttgggcaagagaatactcattcacatagttaagttagacctaatatgtttgaggcattcttttcatatagatttctaaatacttctttttaaagaaataaggctcataggtcctttactcacttggaaacagattttcacatgggacacatatttattagtaattatttaattacatagtatacatatgaatatattcaatgtagttactctcaatattgtatatggaaataatacatctctttttctgcttaaagcattagggataagatgcatatgtatatacacacctaccataaacacacacacacacacagacacacacacacacccatcaaataatctagtttttatgaacccatctaaatctgtttgtagagtaggaagagttggcatagtcagacattgctccctagttttctgatgacctctaggaggtctgtggggaaggagaaacgaattttccagctgccacacactttgctccttcactcattctttcttttaaaacaactatttgatatttgtggcaggcagagaaagtatagctaatgtgaatctgttatagagtactggaccacatgtgccccatcctcattacaggtttcttaaaaattttttgttgttcttgacattctgcacccagaatgtattttccctttgttactattccacagggaacaccaactaggtatcatttgaatgacatctatcactgcttcctgagaatcaagaaggagagaaatggacagcatgtgttattccaagaaggatgtttatttggggaaaaagtacttacaatgatgagcaaattaacattatataaattattatctcagaactatgaaagttagaatggcaggacaatttagattttctttgtgaaaaattttctgctataatatttaagttgggtttaaagaaacatttttagaacacaaatctttcaaaatcaggaaggcttggtttttctgtattcttagataggttaagcagataaactggagacttcccaacacatacctacctagaattcttatacgttgttaaggtcattgccaaggacaggtggaaatgggcatcctaacttaaaatatttgaaaattcctatcagctttgataggaataaaaacatctttctcatattcctattgatatattggtgccattagaatacaagatcacagcactatttacatataacaaaaccttctaagtgttgtaacaaataattttctaagttaaaaaacatcctctgaattcataagaaatttcctttttgcaattagaagttcattgggctgttggtgtattaattaaatgaatgatttttggatctaggaaatataagaaatataagtaaggtacagttgtcccacagtatctgtgggggataggtttcaggattccctgcaggtaccaaaatccacagatgttcaagtcttttatataaaagggactaatatttgcatataacctatacacatcctcttgtatacattaaatcatctctagattaccaatactacctaatgtatttaataaatgctttgtaaatactggttatactgtattgtttagtaaataatgataaggaaaaaaagtctgtatatgttcagtacagacccaaccatggtagctgtaactatatatatatatatatatatatatttttttttttttttttgagccagaatctcactatgttgcccaggctggagtgcagtggcacaatctcagctcactgcaacctctgcctcccgggttcaagcagttctcctgcctcagcctccggagtagctgggattacaggtgccctccaccatgcccagctaatttttgtagttttagtagagatggggtttcactatgctggctaggctggccttgaactcctgacctcaaatgatcctcccgcctcagcctccgaaagttctgggattacaggcgtgtggtttgttgaatgctccaatgtggaacccagggaaatggagggctgactgtactttgataatatttcaacatacaagctgaaaagtttcattacattgtcagcattcagctaaagaagactctctgaagcgtgaagattttaattaattcagtacactcttcaacatgttatgtatataactatcccatcacaacatggggcagataatatttcatttggaggggatgttatattaaaaatactccctgcattctaaacttccaacatacataaaaacaaacactcttatttgctgtcatgggagtctatagtgcctctaagagtaattattttgggaaaaaggaatgaaaggttttagatcagtgattctgtaaatgcagtctaattagattcatctaaggagtttgtataaaatgcatattcctagggtccagatccatggcattttaattttttttggatgatggagcccaaaaatctgtattttgacaactcctctctctttctcgtgtttaagttgccctttgagaactactcctagagtataggcagaacaaatctaaaaagagtacagtcacttaaggtactgaaataaagggaacatactgccgatttcagaaagtccacactggtctgacttcaaacttttcatttaagggaaatgtactttttcatcttgctttgtcttagagtcaaattgccagttctacagttttgttcaggaaaacaatctcatgtctagaaaagagaaaataccttctaccttaaccttatgtctttcccaatcatagggttcccaggtcctgggatcagaaactccagctattactgccagtacatcaaagggcaaatcaatgcatggaatgacctgaggactagcctccttcccattccctacctctcctgtgggaaaatgtgctccaatttcaacaactaaaatacatctaaatttttggaactttatgagttttggcctgcccttatttaggtattaatgaaaaagattatatttttatatcttcttcaataactatatttattttttaaagacctaacagaatttcataataaaatggattcctctaaaaatgctgttactactctaaaaagaacgagatttacaaaaatccttagaggtgtatctgtttagtaacaagctttgttatttcatatgtttgatatgcataatttggagcaattaagaatgtaacatgttgcttaaattcaataaactctcttggtcctaaagctgccttcggatttggtggattaataaaatgcatatttcaggaatattgaaatgtaaattatttcataatatgtatgctttaaagcagatacggtaaagattcatcaattgagctttgagttggattgacctcaggagaatctaaagttctgtgaggatttaaagttaagtgcaatgtctttaatctagagggaatagaaaaaaaaccaactcctgaagaccaggtctgcccaaaatgatgtttacatactatgttttttttgtttgtttgtttactttcaccataggccataaactagtcaagatcataagatgatcttaagaagattactcatttgattagtttaacaacaatatcatttggttctgttactctgttcttgatttactctcccaattaaagagcatttttattcagaggccacctaacaggttgcaaagaggttagttctcctgatagtcttttggaaaagacattctgctgctccatagagacaattagcagaagggctggaactgagtatttgataaaacactccaagttggaaacaatttcctcttgtgaaacttctgtttcattattgaaagtttataaaatgacaaatgggaaaaattgctttaatatgatgacttttgtaatcaattatttgacaaaataggtttttattttgaaaacaaccactataagattaccctgaactagtgcttttcaatttttgaggttatttttgtatggaagaaatgaagcattatatttgtcgtctttctttccttctgtattttcatataagtgcaaattattttttttacagaaaatattgtagtaaccaaaatagaattgtgctattttgtttgctttgttaaattatttctctgtagaaaaatgaagtgttgatgacattttttcattgctctttttctttctactctgtcagatcagtatgcattctgtcgatatatgattgacatatttgtccatggggatttaaaaccaggtattccaagcaattcttgtacttgtctgttttaatagtctttgtttctaagattgtgggctttttatgtacctaactgtattttcattttttaaaaattgcataatgcatgtgtagatctagaataaaaccaataaaaagcggtaataactggcattaaggtcttaattttactttcagtcactgcatggcctattgcaaatgaagtcagttgaaatgtaaaatatgtgctaatatctctctatataaggaatgctaaaatctttaataatgtcttgaagtgaagcagtgaatcatcttattttattcttggtaaacttagaagaaaagacccacgacaatgaaaatatctttcttttcttagtagtgaacacaattcatattaaaatcatcacatttcaaatatttatactttgttttccaaaactttaaaattttctcccttatgcatgaacttggtttagccactccaaagaactattgttggagatagataatcttggaattaatattcaaaacaatggggaaggattttgagttaaaggaatatatctaccttgtcttgtatctttaattgttgcccagagtataaaaaggtattttttactaacatctgaactaagcatgagtaacttgattgcttgtactatgccttttgcagatttaaaaactgacagaactatgttcatgtttgggaaaacttttccaagaagacagtattgttaaggaaggagctcatttatattagaataaatgaagctaattgcttaaagacagctatatttttattttcttaactatttttgtgaaagcctttcaaaaatatataattataatttatgtgtatgtcatcaaagagacatctcatttctaaaacaaataggtaacacatctaggctctagaaaactagacaatgagaacctttgcactccggaaaatgttgttgatcccagtaatttattctagttaaataatttcctcctcctccccttttccttcttctacattttcagtaagaaatttaaatgagggggaaaatcactaaatatatattataatttataaatatatattatatataataattatatatattatatattaatatattatattaatattaataatattaatgatatatattattaataatatattaataatatcgatgtttgtgtatagtatcatagcataattggaaataaaccttcaggaaggtagtgtgatatggtggaaagacaaggctttggacagaaatacagtgataattcttaactccatccttttctagtattaggtcttgagcaaataattgaactctacctcatttttagtgttcttacatttaaaataaagatcacagtcacaaccttgcattgttgacaaatcatctagtgactacaaacaaaatgttataactttaatttgttcatttcaccactgcctgcctggtgagttccctacatgaagagaacctctcaacacttacaagtttcagtctatatatatcaaaaattcaatgttagggctgggtgtggtggcttatacctgtcatcacagcactttaggaagctgaggcaggaggatcacttcagcccaggagtttgagaccagcctgggcaacatatggagaccacatctgtacaaattttttatttttttattttttttgagacagagcctcactctcgtcactcaggctggagtgcaatggtgtgatctcggctcactgcaacctctgcctcctgggttcaagcgattctcctgcctcagcctcctgagtagctgggattacaggcccctgccaacatactcggctaatttttgtatttttagtagagacggggtttcaccatgttagccaggctggtctcaaactcctgaccttaggttatctgcccgactcggcctcccaaggtgctgggattacaggcatgagccactgcaactggcaaaaaaaattataaaaattatctgggcatggcggtatgcacccattgtcccagctacttggtagggtgaggtgggaggactgcttgggcccaggaggttggggctgcaggggtgtgtgagctatgatggcactatcacattccattctgggctacagggtgagaccctgtctcaaaataaataaataatttaaaagttcaatctggccgggccaggtgggtcatgcctataatgcaagcattttgggaggctgaggcgggcggatcacctgaggtcaggagtttgagaccagcctggccaacatggtgaaaccccgtctctactaaaaatacaaaaattagccaggtttggtggtgggtgcctgtaatcccagccacttgggaggctgaggcaggagaattgcttgaacctgggagagagaatttgcagtgagccgagatctcgccactgtactccagcctgggccacagagcaagactccatctcaaaaaaacaaaaagttcaattttaggtcaaaggagtgctaaccatttgttcacctgtgttggttcaagaaattcatactctacacataatttttgtaaagtcaactaggtgtttacttacatatgagatgagacgaatctatgttgttgatgagcatgaattaataaatgactaacatgcattattttcttcatattctattagttttaaaatttctttacttgaagaaaattatctgttttctgtcccactgaaatcattcatagtagttatttgttgatcataaaatataattcctaagaaagtctcaagacacagagaaccatgcactaagaaattcagcgagggatgctagtagtttaatagtcgcaataccaatcatttctttctgaaaaatctaacaacagagtaaggttagaaggaataataaaatcatctatgcatgaattaaagatgattttgttaacgaccgcacagagagagcccttctaaaggcatatgcaaacatactctaaaaagtcctaagttcagacctacaacattatagagtattccaacccctgaagataattcctagttctataggattagatttctttgtaccattaattgacttactaattgaattcttaatttatttcatctacctacattcattattttgaaggtttaagaaatgaaagaaatacttgaaaagcgagtatttcttgtccaggagttgaaaaggaagaagggagagaaggaaagcctatgtaatatgcctgttgtttcatttaataaactatatgatgttatgtaaatgtacctaaacaaaattcaggaatattatctttgtcagtgtggcaatacaaaacatggagtgagaaagcattaaatatgacttgcatttttgaaaataaggaatgagaaacacagatttaatctgggcatattaatttagagacaatgtaagtggtgagacattgactctgactggcaattatagaataagacaattcttgccaagtttattgctctgcatgtatccactacttataaaacatttgcgcttccatctgtttctgtttgggattagtgtaacacctgtattgtttagctagagttcactattaattattggtaatgagtttttaaaactataatttgatttttccctctgggattcagtttttcctttgtactgtcacaccctcaaaagtaacccaaattgcagttctaatttgaaaacgcttgctgatgaaatgtgctgacactatgacataagtcccaagttttgccttttatcccatcaaataaaatgcttctaagatattcttaaaatttttagctaagatttcgtctataaacctgaagattaattgaattgctctttctgattttctgttgtgaatggtgaatatgcactatcctagggtcagggataatcctcacttcaattatagggaccatcttaataaaccagtataaattataaagatctgctcatttggttgtattgaatcaaaattctcttgtactgacttactctatattaagttgaaacatgaagaaaattatatttaaatctaggaagtgaatgcatgctatcaacactggtcctatgggcaactggcatagacctgtatgtacattttgtaattttaggtatattatgaacaccgaagatctcccctctccagagatactttctccatttaatgacctaacatcttcatattgagatctttggttgtgccgatggtcagcgttatacaggatgtgttttaataactcataacctgccttagggaagacagagagaggagagtcggggagagattgagacagaaagaaagagattgattcgtcttatggtagctgtcttgaaactgattaacctccactttttttcctagggcttaaagtagtctacttgtcacttactcataagagaactattaaaactggtcaagacagacattatttgcaacatcaaaacacaatttatgggtttttttctttttctttttttggaaattgatagtacggatggtcaaggtatattccgccagatttatttatctttatcaaccttccagtaattccaatttccttttcaattttgtgtggcttagcacatttttcttaagtgacagctatactgataattttattcatttaggtagactatttttaagaaaacacatcaggatcttgcttggcattttcatattccttcttcaccaacttctatctgggcttaataaattgcatgggtttctgggcagagtcacccaagttaaagagacaaatttctgtaaggaagaaatcacatggttcacagacctctttatattcactaaagataaagaaaccaatttaaatgtccactacaagtaccagggctagtgtgcttgtgcttagtaattttaataattttttttagctttcatctctgtaactattatgattaaagtttaatacaagttaaagtttatcccttagaagttattccactattaaaatttcagctactgtctgacttttacttgagccaagaattatgtcacggtaatttattctgctttttgtgtcatttgttttctttaaattgagggtactcacctatcaaaatcttctctgattgtaataaggcattctttggcagcctgcattccaattcaatgggttttaagtccatagctagaaagagcctcaaggaataagttagtactctcattttattaagatccttttcttgaactttagtggtgcttaactatatttttggttaaatctcgctgagaagaggtcaaatgtaattgcattatagtcactgttatttaatggtttaatgtatttcagagctcactgcttgtattagacaagactaggtaccatttagctttgctttagacttctgaaaaaaatcctgctccaaggtaggcatagttccataaaaacatattcactctaattccaatcatttaattattttcacacaacaaaagtttcgggaattttaatgtttattcagtaagtagttgttgaatcctctcagcaagctggtggtccagaaaagaggtaagctaagacataaataattgtattaaaaaggataacttgataagtatacaatgaagacatagaaaatatacattctaatctcagtataccaggaatgagtaattttctctatcaacctcttggagttttaattattaaaaaaaattatttagtttttctaatagtttacaggagtagaaataaagggaaagtgaaagttttgataagaatttaaatatagtaaaacaaaatgtttctatcttatattccctgttttcaaagatgtatatacttcaaatgggaaatatcttcagaaagaaacaaacagctcatcagttatcatctatgagccttcagtgtattcatcttgcagataccaatttcaaattttgaatatatctttaataagttctattatatattatcacttctggtttttctagaatgtgcatcatcaaaatgtagtactttaatttttataatccttgatggtccataattttgttgaaaagaaaatgtcatcttcatttcataataaaacatttccttccttccttccttccttccttccttctttcgttccttctttattttttttttttgagatgtagtctcactctgtcgccaggctggagtgcagtggtgccatctcggctcactgcaacctctgcctcccgggttcaagcaattctcctgcctcagccttgcgagtagctgggactacaggtgcacgccaccgtgcccatctaattttttttctatttttagtagagacgggatttcaccatgttggccaggatggccttgatctcttgacctcgtgatccgcccacctcggcctctcaaagtgctgggattacaggcgtgagccactgtgcctgggcaggttttcatttttgtatttacaaacatagattacaataatgcattcaattatttttaaattcacattgtccatttcttttggatgcctgcctttctctttctttagcatttgtgcagttagaaaccacagattttggcacatgaattttataaagaaagagtactgtgacatgctcttttagcaaaatgaaatggttcaggttcttgtcacaaaatataacaggataaattccttcctgttaaagggctaactagatgagaatacagtcgtgtcctcttatccatgattttgctatttgcagtttcagtaacccacagtcaaccacagtctgaaaatatcaaatggaaaattcctgaaataaacaactcacaagttttaaattggacaccattctgagtagcatgtcatgttatcacgctctattccaccaagtatgtgaatcatccctttgtccgatgtatccacgctctctaagctacctgtctgtgagacacttattaggtatctcggttttcagatcaagaaaacacagcatacatagaattcagcattattcattgtttcaggtatctactggatatcttggaatacattttttatggataagagggaactactatagtatatttccttttttctctttgaaatgcattgttcactcattgattctatagtttaagaaaattcattgtcttatgaagactcatagtctgagatttcacttgtataatcaatttcaattttaccctaatcattagagtctagcttactgctctctgtctttctgcattcatcttctgattcatttaataattttgaaatatcttcctctgtcacttttcttctatttgaagttatggatggaaaaaataattctgaattataaactgtgttcagtgaaacaaagtaggctgtaaaaatggtgtctcaaaaaaaaaaagatgtctccaggcttcttttatatcttcttgaatgatgatgtaatacttcagtcaacactataaacaatcatagtgatgatggggcaataatgatatattttacagttgcatcatctttctaggcaatttcattattctgcttcttcattgttttagttttaagcattgttaggaacgattgatgagtaatgatgaaacagttcctatgttgatgaaatagaaaatgcttaatataagaaaaaaaagatcatgaagtttccataaagtgccttacatgtttaaaattgtccaatgctgtcacatggtaattacaagatataatgggttttgttctgtttaagaaataggtaaatttccttttgtttcttggaagacctataagaaaacaaataagtcaagaaatattaatttttataaacagaactgcttaacaaaagaaactaaaaaaactctgattgactccagtggaccctgatagtgtaatgagaaccaatgggaaaaatataaactcggtggtcacgcaagccaagatttaaatccttcacttgtgttttttgtttttttgaatctcagtttatttataagatttattacttaagattgtttaaatgattaaaagatatatatgtacatgttctcccaaatcccttttttgctttctcttttattatgaatatttattgcaaaaaaaatagtactcgtagtgtgaaagaccaaagaagatggtatggaagacataacaattgaaatagaccttgagatattggtaggatatgtctgtgtgaaatttagaataaaaatttacaaggctaaggtgataatattaaagcacagaatcacaaaatgttaagtgatttctgtgagtaccagttgctaaatatttactctccaccaggctatggaaatcttatataatcctaatacaaacttaaaaggagtatattatcatccatgttttacagatgaaagaattgagacacaaagagcttaagtggtttgccaaggtggcacaaagcagcagacaggagattcaaatccaagactgccgaattccacagtcttcagtattatctttataccaaatctatctgtttcccagacatagatagggaattgcaaatgaggtcactttggttagtactcaggaaatctagaaaaaaaaaaaaaaaacaagattggaaatgttgtacaagatcgtttggagagaatgaaattaaaaagatcaacaaggaaaagtccaacgaaaggaaataaagcctgatcatagaatatgtgatggagaaaattaagatacttttagagctatcacagagatagagtcatgggatttatagatatcaaaagataggaaagtaaaagattatttagaagctgttggtctgtaaaaactaaaaggataccttaagaagggagtataggaatacagtggggtcaatgctcactggactggacagggccgggagaagtgggagactttgaactcaccacatattattcaagccacagatggtatctagctgcaaaagggaagtatgtgaagattctagtccaaatatcatttgtttagcatctgccaaataccaagggtcattaccatttttttgcatacttatctcattaattctcacagcaaactgtgacatctatatagtgcaatgataattcacagcacttctaactgaagtaagcagctagataatcaagtgtggagttttggagaaaggtcagaggtgaagaaggggtcactaggacagtgagtaaaataagttagagtataaatattaaatatcttctgcatgctcagcagtcccaggctcagcatagtagaggatataagaatactaaaaggtgatccctgactggagcaagtgaaatgagtaattatttaaaagagaaaaaataaatagtagaataagtttagacttaggcattagattgtataatacgaactctaaatgttttaagattcagaggagaaacatctgtgattcctgctgtcaaaaaagatggagtggatctagaacttgaaagatggataatatttgactaagtgctgagaaatatattgggattgctttgtttgtatgtgaatgaaggagaaaatgaatgcgaacattatagtgcatgtgaaattgatgtgtttataagacaatgaggatatcagactgaaaagaggataaactaaaattggcaaacatcagacaataatacgttgtatatgttttgatgacagattatagaacacttggtcaatcagaaagaggtgatatttggcataaagggaagtctttgaaggactttaagcagaacaatgaaggaaagcagcatttcatgaagcatgatgggtagtagtctgtttatgggatcggaaatgagaaaaaaattgtagaatatggccaaaactggtgtgtctaaagcatagaattgaaggaaggaagggtaaactttaggaagccattattcatgggtggtgatgagcactatgtgtgacttaagaaattaatgttgcaactcaaaattctacaaagtatcctgacaattttatttcacatatgtggtggatacttaaatgagatctagacttaaaggaggaccaacagtgacatgtgcatgactatccactaaaaatataatgcagtaaggaagctgctagaacttgacctgtttataacctgaaatggagcaatatatctttctttcctcctttggctgagtcctttttttttgtatttctggtcaaagtgcatttacagcacatggctctctgagtgttggctcttatttactgcttgagcacatatataatgactattacaagtagaattttgataatgacagaaaaatattttttcagaaccacatcaacaaataacataccagactcattttgcccatagtagccatctgatgtctcctagcctttgttctactatctactgcataacatgggtaataatattacataatttgtagtgttatgaggatcatatggacaaattctgtagtccctgcagaatttaggcaaatgtggtttgtcttctgaattctaggaacagtactagtaagttcctagtagatgtagatatagcaataaacaaaatatgtatggtacctgccctcatgaagccaaggtagaatttatgtagaacttattgctagccatcaagcatacacaaacatccagaaaaaaattattattattaaagtagaggaatgattaatatgattaatgcctatagttgtagatctgcttatatttttgataaggttatgtaattggccctattaaatatgataaaaataaaatgctctatttggtttatacaaacttgaaatgtgattctgtgagacagaacattatgccaagtgcttcaggtaatgtttacaacattaactcttttagttgaaggatcaacgggaatacaataaaagtgtcttattataattgaattaaaattatcagctaaacggcaacttctatagtataatgaatttattgaataagactgcaaaaatagattggcatctttacacagaggagatattctagatctccaaattgagggaaaatacccgataagcctatcatcaatcttactattcaacagtggttaaaaaaaaaaaaagaagttacaccaagagaacccaaaacccaagatgttataagacgtttagatatacaacatttttctaagagtaaaatctttcagaaaatatgtttggatccatttcatttaccgtaatttaagtcatcttatgcctctgttggaactgcacttgtatgccctttaaatttaataatggaagattttgactatttattagactcactacagtctggaaaaatggagcttcttcttaatttgctatgaatgaaagcccaggtccttgggttcctcagttacctgataacaaaaccactagtgatacaacattcacagaatgagctgcacaaggatttcaggagcaaataaaagagaaaatggttgaagccatggaatgaataggagagaaaaaaattaaatagaataattagtgtcataaaaagaattaattatataagaaaaacttcaaatgaacatgggcaagttacttaactttctgagcctctttcctcatctataaaatgagataactttatagggttaatgtatattttaagcaatgagcatatacatacacataaaaccctcttgactataataaccataataagcattatttaagtgtttggtgtggatggtggttcccatatatagcagaattgtgattttctacccatttctaatagctttctgatttaatattcacgtagcattattattctctccctagaacatctttttctgctgcttatatataccttcaataaatatttgtctttaaatctccactgcctcataccttgccagaaacctgatatgtttgttgaattaagttcagggtgtagaatatttatttcaatgaaaaaaaatttgatgatcatcccagagcagcaatttttattcatttgtagaaataatcttgttattttaaaagatgacagatttctaaacattgcaaatagacctgtgtaaagatttcttaaaggagttattggttatatctctagagacagaagctcagaattaacaaagacaggtttgctgcatgcatgagtagactgcaggcagcatacagaattaggctacaatgagagaagaaatgagagcgagcctaggcttaattatggaagcacacagttcctggacttgccataccctcatgagagttgctttctgattatatgaagtctatggaagctattcaagataaatgtatcagattgtcatatttgtcaaaatcaatccattaaacattctagtcactgtaagtaactggaatacacacagaaatagatccatgtacttctgagtggaggtttcctctgaagctgttaccactctctcagtcagtttcattgtgataaaatgcttcaggtttttggagaaggctagtgaataagactactttgcccttaatacagtgttcatattactttacatcctctatgtccagaaaagaaaacaaaatgaaggcttaagctttttcatttttcttacaattttagaattttgtctcctagtcttgcgaaagaggaggcaggttctgtaggtatatctttgctttgagagaactttccttaaagtggcttttttggtctagctttgtcactattaatggcatggacttgctgtcagacaagaataaattccttctcaggtaacccactgggactattaaaagcatgttctaatatagtctgaaaaggaagaaataatacagagtaatttgaattgctgcatgagaaacaaggaaaattaaggtttaatcaaagaattattgaaataattatgtgttatttattaatgcaccatgtattttaataatcttatctgttagtttatatgcacaagtgaagattgaaaaagaactctagaaaattacatgaatatattcttccagtgctgttctaaggtttatttgtgtggcctagtggatacaaaatagagaataggactctttctaaccatttccataaatgcatagttcttaccccttttcttaagcggacatatttttaaatatggaaataataaatatgcccatacctaaaattttgatataaataattggctattttcagagagagctatttgataaacaatatctcttttctatagctttttttttctgcagaggatgcttttgtatttgcaaaagatgaagacaaaaatgaattttgcaatattaacattaacgttactgattgtagcattgatgattatactgattgtactgattatagactattcaacccgttgctcaacagtttttagtcaattctatgacttttattctagcttagtatatctcatattttggtttctaaagtatcatacattaagacataataatactgttattcttgcatagcactaataattgttccacaattgaaagacagtatatttttctgtttacatcttcatcaacatctgagttgctatgctcaaagttgttctattaatcaatctcagcagttattgaatctctagtatgtacttaatgctagcagtcataacaagagtttcaaaccagaaggagataacaatccagtcagagattatgaataaaacaatgaataatataaggcagctgtgggagaaaaatagaagaaggtgctaattaagcactaaatcatatgatgcagattatattctctacaaaattccagagagagggccacagtggttagaacaggccttatcaaggcgtgttttatcaatgcttatcttcagctttattgtggttgttattattaattgcttgcaatgagtttagtattgtttcctatttatttggccatttttttcatcccaaataggggaggaagtggtaataaaattagatgtagtttttaaaaattaataatactggccgggcgcagtggctcacgcctgtaatctcagcgccttgggaagacaaggcgggtggatcacaaggtcaggagaccgagaccatcctggctaacacggtgaaaccccgtctctactaaaaatacaaaaaattagcctggcatggtggcacacgcctgtagtcccagctactaggaaggctgaggcaggagaatggcgtgaacctgggaggcggagcttgtagtgagccgagatcgtgccacttcactccagtctgggcgacagggcgagactcggtctcaaataataataataataataataataataataataataataataataataataataaatgagaaatcaatccagggtaaaaactgaacaaaacattgcaccatatagatgtgatctgtaccactgtgttctcttccaaattagaccattcatacttgtgtctgtccttagttattcacacgtgattattgatattctgtcttacaaatgcccactgccctatttgattctgtatttctgctttgtgattaacatgctgctttcctgagggaaaaagtgtcacctataaaccactttctattgtaaccatccacagtgtttgggtaatgagctcttgtttagtagaaaagacttgtttgcacaattccaattccaatttcttataggaagtgagtgcaaatagatatgaaaaaagtacaatattgtcatattgaaactccctgttagaaacaaattgatgatttaatattctcttatatattggttgcattaagatgtagaccttttccattttctataattcatgacaatgtttacattaataatgattttctcccaaaggaatattatttttatgtgattataaatagcctcttggcagacactggataagcagtgtgtactgttttaaatgacaacatagtatcaattatacacaatataaagcaggaagagagattggatgacttccaaatgtgtcattcaagtgagaatatatttgtgaatttaattgttgtgttaagcctattaaataacaattattaacatgcttccattttatcctctatctacaaaatatttcagtttatgttacatgcctgtagttgaaaatgtgtgaagttttctcatctttattaaagcaccctgtagaaaattttctgctaaagtaaaacctcaagttcttttttctccttctgaggtaaactccaaaaccagatttctttttaattggctgtatagctctgctttacgcttttcatgtctctttgaatttcttgtgaacacagaatatttgaatgtgtaggagccaaaaaacagaaaaaaacgaaagacattttcccacaggtggaaacaaagcggaagggaggtattacagttgcaacattccttccttttgccaaatatcaagtagtatggaaatagtttaacagagtgattaaaaagtgccaaattgattttattttctaggaattagatctctaaataacagagaagcaaccctttttcacatgccatgtgatagcttttaaaaattatccccttgcatttaaggataatgagaaaggaaatttacaaagagcctggcctagcgtgctaagtggaattggaggaaaactcaggtagttctcaagatattgttctgcttctactctttaaggatttttgaagttttggagattgtttgtcagagatgatcacgatgacaacatgaggacaataaaagtagatgtaacacgtgtggtactgagtgctaatggtatgtcaggtactgtgctaagttctaggtatggatcatcttatgtatttctcacaaagccctgtgaagtgggttataacctcttcaactcagaaattaggaaattgaaccaggggaaattatagaattttttcaaatggctatatattttctccaggacttagggaggattacaaatatgttttcaaaaacagagggtccctgccacttaggttttttttttttttttcctttttcttcactctgtttcctaagtactataatttaagacaaatatataatcactgtttcccttataatttaaatatgacatacacacccaaaccttgtcaatataattgacaaagcagataattggctgatagcttttagctgcctttgttggttggtgagtgaaaggaatctggcatagaaaccacaagcagagttgtctgtgatctcatacttcacagcacaaatggtttatcaccaaaattgttgagagagtcttggatatggtttacttttaaatttcgtgagtatccattaagctgactgtaaggcctgataaaatatcatccagttccatgattagatttttaagtgtaaattgtattcttaatggttagagtgacaacaaattgagatgaaagagaacacagagtaaatttatctctggagttgttggtgggtcttaaggttgtttaaaatgaaaacaacagattctaggagtctgggaattgatttagcaatcaactatgccagctgctctctgtcaataacctttttagtagaatcctaaaatcaaacaaccagcaaagataggagataggaggcattatttattttctatgtttaggtagtttacaaaaatgtcaagcctcctatctcttgagaagcaaatttgttactctatttataaattattttaatacattttgtaaatgtaatcattttacctctgggaaccatttttcctcttatttcttctcctttctggttgcccctcacattcccaaaaatcaataattaaatgtgactcgattttcagtcttttagtgagtcattaatacatgttggatctctggaaagtaatactgaatataaaacctaaactattacattttaacttgagaggctatgacgtattcaatgtacccatattcaggaatatgcattgtgaaaacttcgttggtaaacaaccgccttatgagaactgatatctcttctgtattcatagcagggatcgattaaattaaatgaataaagttattatttatttattagtgagtcagtatgttaacatgtgagaggtgaagggcatgccgagggatataaattaagcgtgagattttagcttgaagttttacttaaagttttgtgttttttcttgaaagtcattcttttttttttttttttggaaacggagtgtcactctgttatgaaagtcagtcatttttaatgatatttaattatggacctaaacaatttatacataaatctaatattttaaatatttgccataaagaaaaatggatttctaatgaaatgaatgatatttattctatagccacttctaccattcaacacctcagagaataggcatctctattttgataaaaaatgttaaatatttttgacattgaaaaaagatatctcagaaacttgagttcattataactttgaatattgcgttaccataactgatggttgaaaatatgtgttctttgtattttaagttatcctcaaataaaacaagggttaaaatgcccctcaataatgtcttcctactgtactatggaatattacatttaaattgttttctttattattctaaaattatataaactagaattctgaaacataatatggcaatataatatctatctgtaattaattgaaattgttttgcacttttctaaaattgtatcttatgttttgttcattccctgtcccctatgctcttttgaaaatgcctgcaaatgcaagctcaaagacaggatactgttgtataagagcactgcactgggactccgcatacttgggtcctagttgtaagtcagttggatgaatttggcaagtcatccattttgtttgtgtttcaatgttctcagtgaactctgctggcgctaaaacactcttcaagtttaatatgtgagtgcagaattcattaggctgaaagataacacaatagataattgacatagtctttccacttgtggggaattatagatattcagaatatattacaagtgctatatgttagtagagctgtttaaataatgaagctatctttcttcatcttgaagctttagttcactttttcccactaatcatggaaaaatgtataactttctttgaaagattagtgttctactcataaattagtaaacttcccccagaaagaaaataaatactttggtctagaactataaatgattggggaaaaaaaccacaaatatataagttaaagttttgttgtatatctttggtactatttcacattttaccaagcactctaaaaatactataattcagtctgttcacattaaaacactccagaagcagtaaaacagagtgacatttagaattattcatttgtttactcactcatttaagcaataattttcacttttaataatgctctttcctttactaaatatgtattgcctaatatggtccatattttggctttaagttgtttattgtctactgaagatttaaaaaaacaaacaaacttgtaaataaacaaatgtattgagaaccacagaagcagtggataaagcatacactgggtcctctgagagcataaagtgttttcaggggaatgggtagaggggagtccaagaagggctaaaagagctaagctttgaggattgactgaaattagccaagttctaggcagttttatcactgaaaatttgaaatcccatgtattgaacatttcactggatgattccatggcaagttaggacattgcatgctgggtacattaaatagatttattatttttatttgagaatttaatccatccactttgcctcattaatctctttccctatcagctttggtctttgtactaaaataaaaacgcaattcgtatttacctatttacctatatcttctgtcttcaccatctcccattttccttacctatacgcaaatatgattttctgtggagttgatagaaatattgttcagataactaaaagaaattatttttaaaaaatgaagacttagtaattctgaaagtttaaaaaatatcccagttggtactctatctagaactgcagaaattggtcagctaacatggagactggtctttaagtactgggcctcttctgtgggatatatcaagtccattcaacgtctaactaaggttaaacagaaaatgaccatgtaaaaaatgtgtgatttttctttcccttaggaagtgaatacctatagatttgtcaatggttatgagtcatttattgtaacaggtaaaataattggcatttatcttgactgtccaaatagttgattaaataggaaaataaaatggaggtaaaaaatttaatcttatattaggttttttttttttggtgaacatttttctttttttttattattatactttaagttttagggtacatgtgcacattgtgcaggttagttacatacgtatacatgtgcatgctggtgcgctgcacccactaactcgtcatctagcgttaggtatatctcccaatgctatcccttccccctcccccgaccccacaacagtccccagagtgtgatattccccttcctgtgtccatgtgatctcatcgttcaattcccacctatgagtgagaatatgcggtgtttggttttttgttcttgcgatagtttactgagaatgatgatttccaatttcatccatgtccctacaaaggacatgaactcatcattttttatggtgcatagtattccatggtgtatatgtgccacattttcttaatccagtctatcattgttggacatttgggttggttccaagtctttgctactgtgaataatgccacaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctccccagcacctgttgtttcctgactttttaatgattgccattctaactggtgtgagatggtatctcattgtggttttgatttgtatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtagttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataagttgtaaggaaggcatccagtttcagctttctacatatggctagccagttttcccagcaccatttattaaatagggaatcctttccccattgcttgtttttctcaggtttgtcaaagatcagatagttatagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtaggctcttttttggttccatatgaactttaaagtagttttttccaattctgtgaagaaagtcattggtagcttgatggggatggcattgaatctgtaaattaccttgggtagtatggccattttcaggatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttggtctgagacaatggggttttctagatatacaatcatgtcatctgcaaacagggacaatttcacttcctcttttcctaattgaataccatttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacggcccatcaatacctaatttattgagagtttttagcatgacgggttgctgaatttcgttgaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgttgaggaatttatccatttcttctagattttctagtttatttgtgtagaggtgtttgtagtattctctgatggtagtttgtatttctgtgggatcggtggtgatatcccctttatcattttttattgcgtctatttgattcttctctctttttttctttattagtcttgctagtggtctatcaattttgttgatcctttcaaaaaaccagctcctggattcattaattttttgaagggttttttgtatctctatttccttcagttctgctctgattttagttatttcttgccttctgctagcttttgaatatgtttgctcttgcttttctagttcttttaattgtgatgttagggtgtcaattttggatctttcctgctttctcttaaatttccctctacacactgctttgaatgcgtcccagagattctggtatgttgtgtctttgttctcgttggtttcaaagaacatctttattactgccttcatttcgttatgtacccagtagtcattcaggagcaggttgttcagtttccatgtagttgagcggttttgagtgagattcttaatcctgagttctagtttgattgtactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctttagatgtctattaggtcggcttggtgcagagctgagttcaattcctgggtatccttgttgactttctgtctgttgatctgtctaatgttgacagtggggtgttaaagtctcccattattaatgtgtgggagtctaagtctctttgtaggtcactcaggacttgctttatgaatcttggtactcctgtattgggtgcatatatatttaggatagttagctccctttaccattatgtaatggccttctttgtctcttttgatctttgttggtttaaagtctgttttatcagagactaggattgcaatccctgcctttttttgttttccatttgcttggtagatcttcctccatccttttattttgagcctatgtgtgtctctgcatatgagatgggtttcctgaatacagcacactgatgggtcttgactctatccaatttgccagtctgtgtcttttaattggagcatttagtccattgacatttaaagttaatattgttatgtgtgaatttgatcctatcattatgatgttagctggttattttgctcgttagttgatgcagtttcttcctagtctcgatggtctttacgttttggcatgattttgcagtggctggtactggttgttcctttccatatttagctcttccttcaggagctcttttagggcaggcctggtggtgacaaaatctctcagcatctgcttgtctgtaaagtattttatttctcgttcgcttatgaagcttagtttggctggatatgaaattctgggttgaaaattcttttctttaagaatgttgaatattggcccctactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggccttctctgtatttcctgaatctgaacgttggcctgccttgctagattggggaagttctcctggataatatcctgcagtgtgttttccaacttggttccattctccccatcactttcaggtacaccaatcagacgtagatttggtcttttcacatagtcccatatttcttggaggctttgctcacttctttttattcttttttctctaaacttcccttctcgcttcatttcattcatttcatcttccattgctgataccctttcttccagttgatcgcatcggctcctgaggcttctgcattcttcatgtagttctcaagccttggttttcagctccatcagctcctttaagcacttctctgtattggttattctagttatacattcttctaaatttttttcaaagttttcaacttctttgcgtttggtttgaatgtcctcctgtagctcagagtaatttgatcgtctgaagccttcttctctcagcttgtcaaagtcattctccatccagctttgttccattgctggtgaggaactgcgttcctttggaggaggagaggcgctctggtttttagagtttccagtttttctgttctgttttttccccatctttgtggttttatctactgttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggttgcctcccagttaggctgctcgggggtcaggggtcagggacccacttgagaaggcagtctgcccgttctctgcccgttctcagatctccagctgcgtgctgggagagccactgctctcttcaaagctgtcagacagggacatttaagtctgcagaggttactgctgtctttttgtttgtctgtgccctgcccccagaggtggagcctacagaggcagtcaggcctccttgagctgtggtgggctccacccagttcgagcttcccggctgctttgttttcctaagaaagcctgggcaatggcgggcgcccctcccccagccttgctgccgccttacagtttgatctcagactgctgtgctagcaatcagcgagattccgtgggcgtaggaccctccgagccaggtgtgggatataatcttgtggtgcgccgttttttaagcctgtcggaaaagcgcagtattcgggtgggagtgacccgattttccaggtgctgtccgtcacccctttctttgactcggaaggggaactccctgaccccttgcacttcccgactgaggcaatgcctccccctgctttggcttgcgcacggtgcgcgcacccactgacctgcgcccactgtctggcattccctagtgagatgaacccggtacctcagatggaaatgcagaaatcacccgtcttctgcgtcgctcacgctgggagctgtagactggagctgttcctattcggccatcttggctcatattaggtttgttctcaatgcatgacctttgttagactatttatccttccggagaccattttttgtctatcttaaaaattagggtattagaatggctgatttcaaaagtcttttacattcttaaactctatgattctatgcatctatttttgttatatcccaaacatcaggtattctgtcacagacagggtacaaggataaatggaacaatgatatgatctgaatttatcatatttcttttctttagttggccattccatggaaaattatttccacttcataaattggaggtgagaaagaaaaaaacactaatattacctttatcatttttaatcaaaagaatgcatgaaatatgtatttggctgctattcttgctttccatcaaagtgaatacgaaaatatgtaataacacgtggaaatatattagggaagcttttaatcaggaagcaaagaaaccgttccagtggaaacattttggcctggaggatgtcctttgatctaagaagtttaagctgttggtgttttaaacaccttatagtagggtcacatagccaattcatgttaaataattcatttgcttaaaccttttctaaaattgtgaaaaaaaacccttgagagttaattaacaataagatgtattattgggatgaccaaataaaccatctctggcttcttcactggtgatcttctatacaagtactccagcaaagtgaaaactacataatgcaagaggcaataaagactaagcaaatgagttcataagttgctgagtgaatggaaaattttctgcccttattatggcactgtacttgtttgttcccagatactcaagtcaaattataaaagtcatcatccttgatgtatttttctcacttgccacatcaaattcattaagtcttattaggtctactttaaaacgtactgtgaatttatccacttctctacaacttctgattttcattgaccatacatttaagatcactacccattactccgaaagtcattccttataacatttccctgataaacttttatagggtactcaattccttttaacttatttagttgctatttttttgtctctgctcactggagtctccatgaattcggggatttttttctatattgttcactgctataactccatgtcctagaaaagggtctggtactgagtaggcactcaataagtatttcttgcatgaatgaatgagtttacactactcctatgtagtccaagccagcttgggttatttcagtagtctccagctgatctgatacagctaatatccttttctttacaacattatttttgttcacacagcagccagtgatcttttaaaatcctatcatgctaaagcagttcaaaggcttactattgcccttaggacaaatccaaagtcacatgagcagcctaaaatgttctacgtgtgttcatgtgatttgcacaaaactccatatagtttagtggggtcctgctcttcctttactatccagtttaacatagtctctttctccagtcattctctgcctcactgctctatgcttgccattcatttacgaaatctgaaatattgacttgcttttgtatctcccatctccttccatcactagtgtaagctccatgatatggccctatcttcaccattgtccctcagtaatttcatttgtactattatctccacaaacactcacaacatcccagccaacacagatgttattattcttattttaccttgaaacaacagacctaagttaggtgataattgcctgtttcctgtctgtcccctcacaagaccaagtctcttcaaggcacttttacgtatcttgtccatcatatacattattgtatcctcagaggaagtcctatatatgttgtatgttaatgactcaagaaatacatactaataaaagaagagaaaatagaaaaaaatacacactaaaagatttaataaataaaagaataagggtacggaatagacatctgaaatcccagtccctagacctgtgcaacataccatatccagaacaaaaggcttagcatcataaattttaaaagtgcctctctaatattaaagatgaacctttgtcgttaagcctttgccactaactgaaagagcaaattattagttgtagaaaattgagagtctgaaaaagtactgagctcatactgttctggaacagaacaaggcagaagttgtagtgctgagaacgtttttgttttctttctttcttccttccttattttctcattgaatctctgtctctctacgcatctgccttctctgtctgtgttttccattctctgcctttctctcttgtcctctggctctggctctggctcactggctctgtctttgttttttcatccaggcctctttcacactgctgtatctttctttgtataggactttatggttgccttggggttgagaagcccctggaaggaagaaaagaaacgcaaagtacagtggtgacatttagcaacacacaaatggaaggtataaggatgtctgtttgaagtaaaaacatcctgtgcctgcccacctcacacaaactcctgaacttcttcagattattcccagttggagaggtctttgtttaataggcaaatttgaacatctctgattattatatgagtggcaattcaattatttttaatagatggggttgggaaagggaggagtggttagcaccccatatctctagggtctcctctttccatccctaagtggtccaaaagtacaagacagaagcaagtgatagtaaggaagcatgaaggtcaaggtgtccctattaacacacaaccttagcacaatcacatgtctcagcctaaaatataaaaccatcttttcatttaattttagtatttgttaaattccaaactttcaaaatattccacatcttacaaaagtagtctaggaaacttataccaatacataagtaatattattgctttaataaacttgactatcatttccttattaaactcacatcttctcactttacttttagtcatagatttacaaatgccttctatgaacctgaaagaacaaattgacacagggatttgtaatgatttcatatattgtgtgtttttaatgtaaaggaattttaactcaatggttacttggaggtcctcatacctttccagtcccaggatttattgccattcattgtttgcaggattggggtccttccaaaatgttcagagttctctggatgtaactctccgtacttccaggaaaatccaatgagggtctatgacataaaatctctattagatggtagagaaaaaaacagccttaacatttgttacaagacagagggagtaggcttcagttgttcagaaatggttttcaatcagggaatctcgttcataaagaaactagatagattaaacttcagtgtagtgaattgcttttttccatcatgcaatcataattcagctcatagcctcctaccttgacaagatttttagtaatctcattcatcatttctaggaaagtaaagaaaacatcagtaacttagatcattagaatgaatgcacactgtacactagccccaaaagaatttgactaaatcaaaaacaaccaaattgacttgtatggaaaagaactcagaacaataaagtattagcaatttgccaacctaccattcaggtattatggaaataagccagcccaaatcactcaaggaacagaaatgaagccaacttactgtgtttgaatgtcagagggattttcaggtaatagcttgtaaaatgaagggcacctttagagttcgaatgtaaatttcaacagcctaaatctttccttcagagaataacaatcttcaggaattccaaaagaatatattcctaataaaattataagcctcttttctacaaatgagttctgctatttctgtcatgttcaattttctttgtttttgtttttcttcaaaagtcagcttcaaatcttcttgtgaaattagatgggatttaaattgtaaatacattatcgggaaaagaattaatattttgagtatctgccatgcactgggtgcttcatcacttaatctctataacacccctacaactatccacattttataaacaccttaactgaagcttggagatgttatgagattttcaaatgtacacagcttctaagtgacagatctgaagctatcgcttaatacccatgtgactcctaagcatgcagtctttatactaaacaactctgattttgttgtagagctgtattataaatataatatcacatttaatataattcattatgtattattatatatgttatataatgtattcattcacctaacaaaacgatttgtgatttcaataagattctctgacattactgattatatgagtcaggaccaaagtcgtgtgtcatgttcaagtatgacccatctgatttgttttggtgcaccctatcacaacaaaaacttgtcctgagttagtaattccctgccagggctagtatcactgtcaccatggagacaggcagccagctggcttctcctttctttttttaatttttttttgcttgtggtcctactttcccattgttacccattgtgtccactgccttacaaccatgccatcagccatgttagagagcagaataaaaagagcattatagttgtgcagaatttctgatatcaactgcatattgcactttatgccgcagaagcaccagtttgtgtgttctaataaatatatatatattggcatccaggcttttttttttttttaatttaccacataccttccacctggaatccctccgtcttccccatccttccttacctggcaggctccttttaggctgttaacctactctctttcaagactctttctgcagtatatcctttgtatatacgattttccttcaacacactatcatgtaatgatctgtctagaggtctgtttcagccagtatgttgggaacttcttgaaggcagggttggggtttaataattcttcggtgctggtatataataagtatgcaataaagttgttttaaataaagtaataactttatatttccttcagataaatctaaatataggtaatagtgtaaattatgtgaaatttacagggaaataattttatatatagtataataagttcctcaataactcaagactataaaagactataattatacacccactactattcaccgaggtatatgacagggtagaaagcagctgagactcaacaggcaccattctatgaagatatcgatctatcttagtatttagaaacaattgatgtatatttatggacactcatattttaaaagtttggtcatttaactgactccttctttgtccttgtagcttattttcaaagctacaaaataccaccgtaccttaaaattattttttcaagaatggccctcaaacaaggttggggaatagatctttccaagtatatatccctttgacccaccgagaaagtagaaacctagagtagaggcttcactcctctgtccctcgtcagctatagtcatggactcctgatagatgacccttctgttaagcataggcaatctgagaggaactttaagaattgcaacttgggaacctgcattgaaatccaattccacttattagcagctgagaagcctaaactctggttaacctcagttttaaaaactataaaatgagactaatatgcacatcccaaagagcttgtgaagattaaatgacttaatgcaggaaaaccatttggatcattcttggcacatagtaaacactatgtaattgttagctagggaaagaaagataatgtggatcaaccttctttttagtgttcccagccttattttttctttgctaatgaaaaaataaacttccatgttatattatgtttaagtcaatctttacttccataatgaaagaaattaacaatattatgaatggatatttttctagacatacggcctgtaagttatgaaacagtatgtttggcttctatacatacttaaacatgctcagtaatcaacctgtatgggtgtaacagctacaagaaccatatatgatgaacagagctccatgtggcatgagggcctaggcccgaaatgtggtgtttgtgcaactctaattactttgcttgctaaaccatattacaccatagataactaattttggtgaattctaaaaaaggaaaactttcagtaaggcaggtctgctgacatttgataatatctagttgtcagtgagattttagaagttacacatgcccatgttgcatgttgatttctggataaaaaacacacagcagaagtttatggaatgaaaagtagtgataaaatgttttgcaagcaatttatatgggatcatatgatagctaatgttgagagttcatggcctggatggtattggttaattaaagaaatcacttgggataaagaagtacttggaaatgattgtgggttttctttctttctctctctctctcttttttttttttttttttttttgcagttcataataagctcagacagagacttgagagaagctttcaaagttctataaaactgaatatattttctctttggctcattatttacttaactacaggtcatttattatggtagggaaaaatgtatctgttcaatatcaaaggcctatgaatttcaaccttcttttattgcctatattatatcatttgagaatttttagttaaatggaaaaaatagtgattaattttatattaagattccccctcagcttctgagattttagtttccataacttagtgtgtatattaaaaataaattgcttaatttgagtacatgtacattttccattaatgaagtccagtagatatatttaacattgcatatccatctatggaaaataatatattcagaaatggctctgaagataactgaatccgcgaaggtgtcttcttaaagatctcccttaataatagctttctttttgcataataatatgatttatacttggcttggtattatgaattatgcatgtaggggacagatctagctttttagttgtggatattagatttgttaatacttttttttttccaattcctacttctacattgtgtaggacaaagcccagccattccacctcccttaccgacagaacaagcttccagacccactccggcatcacctgcccttgaaggcaagtacttttttttttcttaaagatctctattgtagataaaatagaatgtagaggaacagcaacaacaaaaatagtcacaaagaaacagcaaaatccaatattttcttaaatacttttagtatgtctaaactatacttttcctaaaattgcaatttgcttcttttagaaaaccaaaaatgtccccttaagattctatattggtgaccctcagcttccagaaggatgcccactctagcactttgggaatcaagcaaaaaaatatagggacaaatagataaggctatgccttgcaactctgggagttttaccacaacttgatcaatttagtctctgaagaggctggtgccagatttgctgggtttgaatctgagctccaccttttcctagctttgtaaatttggaaagttatttaaattaactcttcatgagttttgccatctctaagatgatataagcagagcactgatctcctagcgttattgtgaggattgaaatatatatatacacacacactcacacacacacaaatactgttttatgtatatgtatagtttataagtactatatacaactggtggttaatactactaataattcttgaaaatatgatgtctcaagatcagctttgtaataaattttgctggaacgttaaagtcatttctttaagtcttcattcatttcttaaacttttattaaatcccaaacatgggatcatttcagatattgtccaaaatactggggattcagagatgaatagaaaacagttccttctctgtcaagactcaatttgcctatataaaacaccagtaattaaagctaaatcattaattttttacaacagtacaaatggaggtcttcctcagatcacagccaccctagaaaggggtagaaacacctagctcagtcccaaattggaaaagatcttctgtgtgcaatgtggacactccagcctgcttgttcaagatcttcccactcagctcaacaactgcccattggctttggccatcccttgagactaagtgatgacactcatgaggattcatccaggaagaggttactattgtatatcacttacctagagagtaaacaagtgatttacaaacaaccagtccaaaaaaaaaaaaacagaaagaaaatagaccaaaaaaatcagaattacatttattttggcatttggactataatagttcacatgacttaagagaatttgacacaaaactatctcactcgccaaaatgttcattggacaagacaacccctataaataatagcgttgccttaatttttcatgggattctaattctgttgttgtttccagatggacataaagcaacgaattcagatttcccaacttgagggagactttgatagtcagattattcaagtgtttgatgccaagttatctcctagcagaggctcataaaacaccaagtagcaaatattttgcttagcaatctgtcacttggaaaaggatgtgtcatttgttaagtaggacgcttaggttctgttattgtatttatttatttatttatttatttatttattatttattttttttttttcttgagacggagtcttgctctgctgcccaggctggaagtgcagtggcaccatctcggctcactgcaagctccgcctcccgggttcacgccattctcctgcctcagcctcccgagtagctgggactacaggcgcccgccaccatgcctggctaattttttgtatttttagtagagacggggtttcaccgtgttagccaggatggtctcaatctcctgacctcgtgatccaccctccttggcctcccaaagtgctgggattacaggcatgagctcctgttattttatttaaagagcaatgtaatttgacagttcatcccagaacctagtaataggctgtggtgaataaaataacaaggtttgaggatcacaagcctttgtcagtgtcttctctgaaagcttgaaggctgctaaccctgagcagctcggggagtctatattatcaggcaatgctgagatcatgggctttgtcagggcttgcagatgtgctgcctatgacttcgttaacataattgattaggagctaggacatatttagtattaatcaggctgtttttagtgaggctgattatgccagtcctcttgatgcactattttagtctggaacttccttagaaccaagctgcaaaaagaaaaaaaaaaaaaggctttatgtaaaaaggaggaactttcatgtggcactaaagtatgctgttatatttgaggaatacaattatatcaggtcaaaatgtaggagaatgtacatatttcaattttaatgttttttaaaagtagagctcatatagagactagattattaaatttgttcacaggagactagaaacaaataaaacttcattagtagaaatctaaaaaaaatgtggctctgtatgggtaaaagaatactacaaatctgtaaagccaatactacacgtctttaaagcccataaaagccttctttgtgctttcatagcatttaagaaacaaaacttgcacagtacttactttgttctgggaagtatctgtgtacttcttgtctcagtccacttatttagtgccttgaaattggtcttgcctttcttggatttctgtgttgtccccacattgcgtgctttgtctgccataatgaagcttttattactttgaattttttgatacaaagggactaattatatattaaatcatttatttcctttgactcttattttatgttttagaatttgtttggccaggaaaaattggctacaataggttttgaaaagatcttgtacaataaccacttcacatcatcattgtggtcattgttgtaaatttgtatttaattatggatataactgaaactaatttaaaatgaacctaatgtaaatataatattaattctcatcttttaagcaattttgaattcccgtgtctattgggagctcttactagggctgaaacgcctacaagttcaaagggacactgtagttatccatttctttcaaaaattgggctgacttatgtgaggtttttcctcaaatcaaatagtatcttataatattaacattataggtgattttagctcttagcatgaaaggtcctttatcatcaaatgtttttcagcatctctgctaacctgttacctcaagaactgtatttctcagaatcctcagcggttaaacagaacaacttcaggcaatgttgcccgccctcttcccgattaccaaggaaggcagaaaagttgtttcataaaatccttgtataagcaaaattaccatatatgattccattcatctttaatcaacaataccagataatttctttcccactactttcacccacatgtaattattgggcatttagtataaaattaccaggactcctctgttgtggcaaagatgtggaaggaagaagttaagttatacttaaattacttttaatatttcattaaacagctgcaatttacatgaatgaagtcgaatagagaaaggtgaattactatcaagtaccctatatcttgttgaataaatatataactagtacttagtcttgcaattataaataatattataaatgctaacacttgtatgtgaacaagagaactctagagagaagaccagagtcctgcccaatctcagctttgatactaatgagttgcatggtctttgacaaatcaattgacttcttagggcctcaatttcttcacctatgaaccaaacttaaatagtctctaaagtccctctatgcttttatacccaaagatttcacacctgtatttttcaggctggtagattggtaataaactgccagaagaacagagtgaaccctacatagctttgcccagtggttaaatagcaactgtagatatgatagagatgttaaagttgttgggacaatggataatactatgaagcattatttactgaaacacaaaaataagttacataaatcataaaggctgtaaaaggaggaagatgagatataaatgaggcaaggttatcaagtgaaacctcaagtctttcattgagccataaagagtaagttagttgaatttgtatagatacagaggagaaaagaacattatataaaatttattataggataattttttaccataggatgcatctgaagacaatattctacaggagctagtaaggttttatttacaattctattaaaccaagaactttattaccttagctcctcagtgagatatatcctgagaagtaaaaaaataaaataaaataataaaatagaaatttggcctcaatttttatttcattaactccatgacacaatagattttattgaacttcaggtcaatataatatttttctttgttttgtggagaaataaagtcatatcttttggtgatttttaataggattgccctttagttacaaattatgataaaatatataaaccaaactacttttaccacctatttaacttaaagagttgctaataacaatatagcacattttctagcacagttagatactcaaccattggttgctgttaatattttttacatcaggaaatttcttatacatataaaaaccattaattttatggtagctctttattggtatccacagaagctagtaaggtgattgctttcatgacattggtcagtatacataaaactctaatataatttttcaatacaggactggaaccatatcttggaatgttttgtatacacagctaaagcttttacatgtcctgatagactgtgtggtactgcttaagcaattgagcagagagtagtatgattaactttgttttcaagattatgtgtcaactatagaaaggatgaattggtgagtggtgagcttaagagttgggagtataagacaaatttaggagaatactgcccatgggaaaacttatgctacttttcttttaaacaatcacattttactctcaaaacaactacaagtagtgaatatgatttatgtcattttaaagagaagatcggagaaatcaagtaaattgcctaagataacacagctctaaaaatggtataactggaattgaaagccaggtgtctcctaccaaggctcagtctatttccattatcctaaaatggcaattaagtgttagagctgagtataattgctaaagttcttatctgatttggttaattgaatggcattaagaataagaacaggttttgagagataataatgagttacatttggggcttgctgggtgtattggggtccctggaacacttgcatgagtgattaaaagagtttaatgaatatagtacttttaaaggtttgcagggttatggtggagccccaagagctagccaaagtaggaagcctttatcactcctatgcctgaagaggcaagagaatagaatggtttagacatccagaaagccttatagctttagggaagagatgtccaatcagaacatctgaaggtcatgtccttcagtaggggaccacaaccaccaaccaacactctgtaaaatgatgtatgtaaaattctcagtgagcctgggaggaaactagagaatagatgcccagatctctctctttgtcttactgtattatctctggatgttgctctcataggccaaaacagcccacattcagaggacatggggcttgattaatgtaacccataagggtcggggtggagagggacctggagagaacatggagaccacatgtcaggcaggatgctgagcttgatccacataagtggtaatctgcagtggacaactgaatatatgagtcaggagtttacaaatgagggagatatagatattgaagtcataagttagccctggcacagcatttcttggaatatgttatgagaaactctagttctatgatattatttgttaaaaacagttttcatgacaaaacacttttgggcagcttaatatattatattttttcttttgcatttacaatgcacacacacatatatcaaaggatccaaaaattctgtatgttaaggaaatctgtttaacttttttaaaccagtgttcccctttttttttaatcacagaaatatttctatttctgataatactcatcaatttcctaaagagcaaatgatctcaaaaacactgtcatacaaaggttagcttcaaacataactaaagagcaggtcagccatgaatctgaggctgtttagaacacagcatagacccaagaaaggaaatgtagaacacattgatttagtcagcattctccagagaaacaaaaccagtaggagacatctatctctctatctatttattgagaaaatattatttatgttaaaggattggctgatgcagctgcaggggctagtaagtccaaaatctgcagggcatgcaggcagtctgagggcccagggaatagtttgttttgcagtcttgagtctgaaggcagtctgaaagaagacttccttcctccttgggggacttcagtcttttctctttaaggccttcaactgattagacaaggcccatcccacattacagagggtaatctgctttattcaaagtctatgatttaaatgtgaattacatctaaaaactacctttgtagaaacatctagacttatctttgatcaaataagtgttaccaaagcctacccgaattgatgcataaaattagctatcacaaatatcattagaatacaaactgataaagccaaagatgagagaatatgaaagagaaaagggtataacaggccccagtgctccagagagatggataacacaaagactggccaggaaaatttacatttgtcaattagaaaattatgctcatctactcttgactctaaattttctctctgctacatataaatgaggatgcagtagtcatgagtttgaactaaaggatcaactgtaagatttttattagttcccttaatctctgaaagactgggtttcctcatctgccagatgatatttactagtaggatttagtagtgctttcggaagaaaaaagaattttggagagaaagctgtgatggcggaggcttgggaaactagattacgaatggaatctttagaatattttgttttggatcatatgatgttgactatttgagatatttcaataaagatttaaacatattttcaattttttcttagaattttagactcttgttttttatttttttaactgaaacactgtactagggcttggcctgaggtaacataggtatctttcagttaatatgttaaaacaagtataattcagcttagtgtcatggaaaagtaggtaagtattaataactgttgagtaaattttcttaaaaacacaaaaacaaataggtgacaaagcatcaaaagaaaaaaaaaggaaaatgaaaagggaaagaaatgagagttccccatgaattatgagctataaatatattttaatagacaagaaacttgtatctctaaacttacaactttcttcttttgttatattggttttgatttcctgttattgattattaaaaagaccttttgtgaaaacaattaactttttctcactgtcctatccataagaggaagcagttttgtttttcttaccctctacagctgccaagatagataggggcatctgtctgtcttgactgttcagtatcaagaggtatttactctgaagaccaggaatgttcccccatgatgcgggaaacaggaaaagggccttctgttgagatcagggccagtttcctgcttcacagccctttcctaactgttaatgctagtataaaagaaatggttttttacttgcattttgacttgtaaaagaccaaagaagaaggatgacacagtttgtgaatttgagcgaatttgatctaatctctttcttgttatggaattctaagtgaaacttccttgtgtcagcaaattttctcataaaacattttataaaaaagaatgtttcctccaatgctcttgcttacaagtaccaatttttccttataaaacatttgtttgcgatctggtctgtttgacataaatatttcttcctattataccagcttgttacaattccaaatggcgtcatcctttccctctctagaatgagtgagaaaagtggctgcatcttcaagaccaagtgtattttacatagatggagtaaacagtcttggaaattgctcatttaataaaggataaggaatgctgtaatccccaacactttgggaggccaaggtgggtggatcgcttcagctcaggagttaaagaccagcctgggcaacatggcgaaaccctatctctacaaaaaatataaaaattagccgggcatggaggcatatgcctgtagtcccagctactcaggaagatgaggtgggaggatcacttgagcctgggaaacagaggttgcagtgagccgagatcccacgactgcactctagcctgggtaacaaagtgaggccctgtctcaaaaaaagaaaaaaaaaatgcctgcttcaattaaatgagaattttatataaaaacatttgtaatttactagaataaaacttatattaagaagtagaagacataatgtgttactagtttgttttaatccataagagacggtaaaatctctcatgtagtgcatcagttcaaataagcctgaactcagcatattgaaatgattacaacttaaaaagttgtggtctttatatgggcacttgcttctattttaagaatggatatccattaggcaaatttaaaaaattgaaaggcttcatttgaaaatcagacttacacatgtgtcccatatactagtaattttttattttaaagtcaaatcatattttaaaatagctattgggtcttattaatttatttaataaatcaagtccaaaactgttataaaaatagcagtatctttgaaatagtactttaaggtaatgtatgttttggttttgagttgcaaccaactttttcttgtactgataatttagtcatgaaaagaaaaagctcaattttctaacgtttctaggcatccttgacattttaaatgtaatgaaatattcttgcaatccatttccaattacagaaaaatgtagaaaaacatatagataaaatatggaaacagtaattttatgtaagtaacatgatattgtaaatgaaaagttgttagaaaagaaacttatatttatgttttctttactatttctacaagacactttaggaaagcttacaataaaacatcttgagtaagcaatgattctgcataaaaatttaaaagagttttttaggaatttccaaaagtcagcaacaccaaacaaacaaacaaaagcatttgtaatttatggagttatctaaagagataagtgcatgtgaattgagcttctcctctgagtccaagtcagtaaactttgagcatttgccttctgaaatgcaaaagcactgagtggaaaaataaaatatagcatctccttttccttctcccgtctcgctcctcttttcttctctctttgtttctctaacacacacagacacacacacacacacacacacacacacacacagtggttgccttttttgtttcactctatatagaaagtgagaaagaacagacatggcacccctcagctatataaacacaacccattttaaataaatgcaatcactcatgtaaaaagctttatcattttcaaaaggtttgggagaaatctaccttatccattttaaatgctaagtttaattaacatagaaacatttttgcaatttgaaatgtattgaataatctttctcgttacctttccttttgcatactaaattcagaaatatgaaaaaaaaatcgtgaagtcaaataactttggttgtgagacagttgaaagataagtttggcattgatgaagtaaaaggtggcacttcttttctgcccatgactcaatcagcttgaaagtttttcacagagtatatctatctcaagcttcattatccatgttgcaggagagaaacagggtttgtgatcatctttagatttaaattttgttctgtcacttacatcagcattcctcaacctttttggcaccaggaacctggttcctggaagacaattttcccggggacaggggtgagaggagggatggtttcaggatgaaactgttccacttcagatcatcaggcattagattctcataaggagcatgcaacctagatcccttgcatgtgcagttcacaagagggtttgctctcctatgagaatctaatgcagctgctgatccgacaggaggcggagctcaggcagtaatgctcatttgcactctgctcacctcctgctgtgcaccctagttcctaacagggcactgaccaatactggcttgcagcacaggggttggggaccctgactcatatgacctgtgaagttggccacattcgtcatctttcctgagcccatttcctcacaggttataagatgtgtagacttttacctgagaatgaagtatattctagtgcatacaagctcatgtgctttattctaatagtataatttcttattgtcttgaaattactgtggttccaacccaaactaaaacatatttttttaccttgtttgaccatgtaaaataaagtgattattaaaatcctttcatcacacctttcggaggctcaaagggaaaaaggtagtatgatatcattttttaacatttttccgtcagttattgagtacaggtggtatttggttacatgagtaaattttttagtggtgatttgtgagattttggtgcacccatcatccgagaagtatacactgcaccgtatttgtagtcttttgtccctcgtccccctcccactcttcccccaagtccgcaaagttcattgtatcattcttatgtctttgtgtccttatagcttagctcccacaaattagtgagaacacccgatgtttggttttccattcctgagttacttcacttagaataatagtctccaatctcatccaggtcactgcaaatgctgttaattcattcctttttatggctgagttgtattccatcatgtatatatatacatacacacacacacacacacacacaccacagtttctttatccactcattgactgatgggcatttggtttggtttcacaattttgtaattgtgaattgtgctgctataaacatgcgtgttcaatctttttcaaataatggcttcttttcctttgggtagatactcagtagtgggattgctggatcaaatggtagttctacttttagttcttcaaagaatctccacactgttttccatagtggctgtactagtttacatccccaccagcagtgtagaagtgttccctaatcaccacatacatgccactactgtttttttattttttttattatggccattcttgcaggagtaaggtggtgtttcattgtggttttgatttgcatttccttgatcattagtgatgttgagcattttttcatatttttgttggccatttgtatatcttcttttgagaattgtctattcatgtccttagcccactttttgatgagattgtctgttttttttcttactgtcttgtttgagtttgttgtagattctggatattagtcctttgtcagatgtatagattgtgaagattttctcccactctgtgggttgtctgtttactctgccaactgttccttttgctgtgcaaaagctctttagtttaattaggtcccagctatttatctttgtttttattgcatttgcttttgggttattggtcatgaaatctttgcctaaggcaatgaatgtctagaagggtttttccaatgttatcttctagaatttttatagtttcatgtcttaggtttaaatcctttatccatcttgggttgatttctgtataaggtgagagatgaagatccagtttcattctcctacatgtggctagccaattatcccagcaccatttgttgaaaagggtgtcctttccctactttatgtttttgtttgctttttcgaagatcagttggctgtaagtattcgggtttatttatgggttctctattttgttccattgatctatgtgcctatttttataacagtaccatgatattttggtgactatggccttatagtatagttggaaatcaggtagtgtgatgcgtccagatttgtactttttgcttagtcttgttttggttatgtgggctcttttgtggttccatatgaattttagaattgttttttctaactctgcgaagaattacggtggtattttgttggggattgcattgaatttgcagattgcttttggcagtatggtcattttcccaagattgattatatccatccataagcgtgggatgtgtttccatttgtttgtgttgtctataattgctttcagcagtgttttgtagttttccttgtagaggtctttcgactccttggttaggcatattcctaactatcttacgttttttttttgcaactattgtaaaaggaattgagctcttgatttaattttctgcttggttgttgctgatgtatagaagaactgctgatatgtgtacattaatcttgtatctggaaactgtgctgaattattttatcagttctaggagctttctagaggagtctttaggtttttcaaggtaaaagatcatatcgtcagcaaatagtgacagtttgacttcctctttcccgatctgaatgctctttatttctttctcttgtctaattgctctggctaggacttctagtactatgttgaagagaagtggtgagagtggacatccttgtcttgttccagctctcagagggaatgctttcaacttttacccattcaatatatgttggctgtgggtttttcatggaaagcttttattacattaaggtatgtcccttgaatgctgattttgctgagagttttaatcacaaagtgatgctggattttgtctcatgctttttctgcatcaattgagatgatcatatgattttcgtttttaattctgtttatgtggtgtattgaatttattgacttgcatatgttaaaccatcccttcatccctggtatgaaacccacttgatcatggtggattatctttttgatatgttattggattccgttagctagtattttgttaaggattttaacatttatgttcatcaaggatattggtctgtagttttcatttttcattatgtcctttcctgattttggtattcaggtaatactgacttcataaaatgaattggggagaattccttatttctctatcttgtggaatagtgtcaaaagtattggcaccaattcttcttggaatgtctggtagaattctgtgaatccaactggtcctggacttttttttgttggtaatttttaaattatgatttcagtcttgctgcttgttattggtctgcttagggtatctaattcttcctgatttaaactaggagggatgtatttttctaggaatttatccatctcttctaggtttttagtttatgtgggtaaaggtgttcataatagccttgagtgatcttttttatttcagtggtgtcaattgtaatgtctcctgtttcatttcttagtgaagttatttgtattttctctcttctcttcttggttaatcttgctaatggtctatcaattttatttatcttttcaaagaaccagctttttatttcatttatcttttgtatttttttgttgttgtttcaattttatttatttctgctctgatcttggttatttctttcttctgctgggtttgggtttggtttgctcttgtttctctagttctatgaggtgtgaccttagaagtcaatttttgcttttttagtctttttgatgtaggcatttagggccatgaactttcctctcagcactgcctttgctgaatcccagaggttttggtaggttggttattattgtcattcagttcaaataatttttaaatttccttcttgattttgtttttgagccagtgctcatttgggagcaggttatttaatttccatgtatttgcatggttttgaagattccttttgcagttgatttccagttttattccactgtggtctgagagagtgcttgatataatttcagttttcttaaatttattgaggctcattttatggcctaccatatgatctatcttggagaaagttccgtgcactattgaatagaatgtgtattctgtggttgttggatgaaatgttctgtatatatctgttaagtccagttgttccaagatatagtttaaatccattgtttctttgttgattttctgtcttgatgatcagtttagtgctgtcagtggagtattaaagtcccccactatttttgtgttgctatctatctaatttcttaggtctgttagtaattgttttataactttgggagctccagtgttaggtgcatatatatttaggattgcaatattttcctgttggacaagaccttttaccattatataatgtccctctttgtctctttttactgctgttggtttaaggtttttcttgtctgtttttcttgtctgatataagaatagctacctctgcttgcttttggtgtctatttgcatgaaatgcctttttctacccctttcctttaagtttatgtgtgtccttaagtcttaggtgagtctcctaaaggcagcagatagttggttggtgatttcttagccattctgtggttctgtatcttttaagtggagcatttaggccgtttacattcaatgttagtattgaaatgggaggcaccattgcattcattgtgctctttgttgcctgtgtactttggttattttgtttttgctttttaacttctatttttgtcttatagggcctatgtgatttatgctttaaagaggttctgttttgatgtgtttccaggatttgtttcaagatttagagctccttttagcagttcttgtactggtggcttggtaatggcgaattctctcagtatttgtttgtctgaaaaagacttcatctttccttcatatatgatgcttagtttcactggatacaaaattcttggctgatgattgttctgtttgaggaggctgaagatagggccccaatcccttctggcttgtaaggtttctgctcagaaatctgttgttaatctgataggtttttcctttagaggttacctggtgcttctctcacagctcttaagattgtttccttcatcttaactttggataacctgatgacaatgtgcctaggtgatgatctttttgcaatgaatttcccaggtgttctttgtgcttcttgtatttggatgtctaagtctctagcaaggctggagtagttttccttgattattcccccaaatatgttttacaagatttcagaattctcttattcctcaggaaaaccgattattcttagatttggtcatttaacataatcccagacttcttggaagctttgttcatattttcttattcactgttctttgtctttattggattgggttaattcaaagaccttgtcttagagctctgaatttctttcttttaattgttcgattctattgctgagattttccagagcatttcacatttctaaaagtgtgtccaaagtttcctgaattgttgattttttttaatcgatctgtttccttgaatatttctcccttcacttcttgtattgttttttggatttccttgcactgggcttcacctttctctggtgcctccctgattagcttaataacctaactcctgaattctttttcaggtaaatcagagatttcttcttggtttgaatcctttgctggtgaactagtatgatttttggggtgtgctgagaagccttgttttgtcatattaccagcgttggttttctggttccttctcatttgggtaggctctgtcagagtgaaggtctagggctgaaggctgttgttcagattcttttgtcccctagggtgttctcttgatgtagtactctcccccttttcctatggatgtggcttcctgtgagccaaactgcagtgattgttgtctctcttctgggtctagccacccagcgcgtctacccggctctgggctggtactggggttgtctgcacagagtcctgttatgtgaaccatctgtgggtctctcagccacgaataccagtgcctattctggtggaggtggcaggggagtgcaatggactctgtgagggttcttagcttttgtggtttaatgctctattattgtgctggttggcctcctgcaccaaagtgcaggaggtggtgctttccagagagcatcagctgcagtagtatggagagggaccagtagtgggcgtggccttttgtcttctgctacctgggtgggtagggaaggaccatcaaacgggggcagggctaggaatgtctgggctcagactctccttgggtgggtcttgctgtagctgctgtgggggatgggggtgagattcccaggtcactggagttgtgtaagtaggaggattatggctgtctctgctgagtcatgcaggttgacagggaagtcggggaaagccagcagtcacaggcctcacccagctcccaagctaaccaaagggccagtctcactcccaccatgtcccccgccaacagcccaagtctgtttccaggtggagggcgagatgggcttgaaaacttgcccgaggctacccaccttccagctgcaaaagaaaagggcttggttcttcccctgcctgtggagtctgcacaccagatttgcaccctccccggagttctggccaggaggcttctcaccccattcaaattgttacaaagttcagctagagattttcttctccctgtggttttaccccctgctcttctgaccaccctcctgatgaatccctgtggtgccaggcaggaatggcctgctaggggacccagcgagctctcagtgtctttctgctgcttcctctgcccctgcattttgctcaactctccaaattgactcagctcctgataaagttggaaatttctcctgcaaacagcccatcattttctacagtgggggtgtgtattcgggagaagagggtctccctttcccacttccacagttggggcactctcggtatttgaggtgactcccaggtcctgcagaagcagtctgcttccttcagagggtctgtgggtcctcttgggattgctgatttgttcttgcagttgatctggagctaacattcacaacgaccttttttttttttttttgaaactgatctcactctgtggcccagactagagtgcagtggccacaatcttgggtcactgcctgtagtatggtatcttgaagaagtttgaatttaaacagataagacctagagtcctttacaacatttatttcatgaatgatatagcttcactgagttctcaactgcatctgcaagacatgagctatgactgtacctcagttccttcagctggcatttataataacacgtgctatccagagttcatgctgggccccacaggcccttttagattcagtctgaggttacaacccccaggagtagctttccactccactcagccatggggagttgcatgtctctcttgattcccacatgcttcacgtctactgtttctcaaagtccttattgtaattatgaactttcttacttactgctgtcacacctagtattactggaaggaggtttttaaaactccaaacacaggcaaagggttttggcataagactagataagcatttgttgatttatgtgaataaattgtatgactaaaggtctcgggtagtcactggaaagtgctgtagaattgctgcttgttagttgtttgttgttaacagttgataatgagaagagcagacttctgagaataattcagctatcactaaagaaaagtcaaggcaaaaaaaaaaatggattcagagcctgaaaggccagcttagttatgccacataactcaagtgaagtccttaatttaaaaagcttttctgtcatagcaacctaattacaatgtgaagggaggtactcttaccatgttgctataaagttgcgtgccttccagagtcccaaataaaattccgaggaaatttttggaaaaaaaaatagaagaagaatatttgttctgaattatttttttccctaagtcttctccctttcaatttgatcacaaaatccaatgagacacttgaccacctagcaacagccaaagtttttcttaaaccatcactcagaattgtataacttctctgcttaaacctctcactggcttcctatgttactcacagggaaatggaaaattcataccagtaaaaagattctaggagatctgccctactacatcttggctgcagcactcaacactcccctcctgagtcctctactctggcctcactaggcctagctcttctttttttttttttttttttttttttgagatggaatctggctctgttgcccagactggagtgcagtggcacaatctcagctcactgcaagctccacctcctgggttcacgccgttcttctgcttcagcctccggagcagctggggctacaggtgcccaccaccacgccacctggctaattttttctttttaggtaattcatttatttatttattttcttttattattatactttaagttttagggtacacgtgcacattgtgcaggttagttacatatgtacacatgtgccacgctggtgcgctgcacccactaacttgtcatctagcattaggtatatctcccaatgctatccctccccactccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaagaacatgaactcatcattttttatggcttcatagtattccatggagtatatgtgccacattttcttaatccggtctatcattgttggacatttgggttggttccaagtctttgctatcgtgaataatgccgcaataaacatacgtgtgcatgtgtctttatagcagcatgatttatagtcctttgggtatatatccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtagttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacatacactctcccaagactaaaccaggaagaagttgaatctctgaatagaccaataacaggatctgaaattgtggcagtaatcaatagcttaccaaccaaaaagagtccaggaccagatggattcacagccaaattctaccagaggtacaaggaggaactggtaccattccttctgaaactattccaatcaatagaaaaagagggaatcctccccaactcattttatgaggccagcatcattctgataccaaagcctggcagagacacaaccaaaaaagagaattttagaccaatatccttgatgaacattgatggaaaaatcctcaataaaatactggcaaaacaaatccatcagcacatcaaaaagcttatccaccatgatcaagtgggcttcatccctggaatgcaaggctggttcaacatacgcaaatcaataaatgtaatccagcatataaacagagccaaagacaaaaaccacataattatctcaatagatgcagaaaaggcctttgacaaattcaacaacccttcttgctaaaaactctcaataaattaggtattgatgggccgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaatggtattcaattaggaaaagaggaagtcaaattgtccctctttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggcaggaagaatcaatatcatgaaaatggccatactgcccaaggtaatttacagattcaatgccatccccatcaagctaccaatgactttcttcacagaattggaaaaaactactttaaagttcatatgggaccaaaaaagagcctacatcgccaagtcaatcctaagccaaaagaacaaagctggaggcatcacactacctgacttcaaactatactacaaggctacagtaaccaaaacagcatggtactggtaccaaaacagagatatagatcaatagaacagaacagagccctcagaaataacgccgcatatctataactatctgatctttgacaaacctgagaaaaacaagcaatggggaaaggattccctatttaataaatggtgctgggaaaactggctagccatatgtagaaagctgaaactggatgccttccttacaccttatacaaaaatcaattcaagatggattaaagacttaaacgtttgacccctggctaattttttgtatttttagtcgtgacgggatttccccttgttagccaggatggtctcgatctcctgacctcgtgatccacctgcctcagcctcccaaagtgctgagattacaggtgtgagccaccgtgcccagccaggcctggctcttctttgaatttatctagcctgctgtcatttcaggatctctgcaggtatttttcctctgctgaaaagtcttctccctaatagcccaaagctcttccacttttttcaataatctttccaattgcccattcagaaaggtttaccctgatccaccttttaaaaaccaagccacctcctatggtctcaggctttaattttcaaaacaaagctttctttttttttttcctaatctttatcatcacttgtccaaaaaaatatatataatatgtatatgtatatatatattatatacatacatattcattttaagcctctaaaatggacttttctcttgctttaaacaattttaagccatatcaaaaccagacaacatgccatcgatatttgcaactctttttaggttacccattcccaggaaaattagaaaataaatgcaagatgatgcatatttcacttggtaaataaggaataaacaggtgaaaggggactcaaacacattctactcatttctctgccttttatggttgaagacagaagatacaacattcatctatagttgcataaggtaatgactactaattatagcaaaattgagacttgaatccacttcattgcagtacagtacccttcataacatgtttctgtcttgcttatgggtatttttttccctttagtttcttaatacaaaatattctagacataccctccctggatatagaaaaataagaataaagttgcatttactcaaagagatcagtaaatgtcacacctaaaaaattacctaaaaagattatatgtggtcagatttttattatttgtaaaatatagtaatagcttgtcattattatcattatttttctacatctactctgttccaggcattttagcccagttatctccatttctcacaagtaagcaaggtagactttttttttttttcttttttttttttttttgagacggagtctcgctctgtggcccaggcgggagtgcagtggcgcaatctcggctcactgcaagctccgcctccagggttcacgccattctcctgcctcagcctcccgagtagctgggactacaggcgcccaccatcacgcccggctaatttttttttgtatttttagtagagacggggtttcaccgtgttagccaggatggtctcgatcccctgacctcgtgatccgcccgcctcggcctcccaaagtgctgggattacaagcgtgaggtagattttattagctccacttttcaaatgaggaaaatgaaattcggtgtgccatagcacattgcccaaggtcacacaactaggaagagtcatggacagaattcagcccaaggtcatcagtgccagcacctgtgctttctctcgtgctccacacccctctgtagataacaatgggacaactctaataatcactcgtgtaattgaacttatcttcagcttatgtaaaattttccatggtcatattgtgagctgggttccaggccaatctctgccactctaagaaaacaaggtgacagtgatgaggtatgttggaatgcattgttattaaagaaacaagttcttatttacttaactggaaccaggaatacatcagttctggccacagtgttagaataaaagcactcatctgatacacagaattaggataatctctacactagaagggcaaagaggggaggaacaaaacataagacaaaaataaaacattttgcatttgtttcctcgtggaaacagcatcttagaaagctttgcaattgtaattaaatattgtgtattgtctggctttgagatggcataaaaaacatttaaaagcaagagaaaagcccattgtgagggcttagaaagtaagaagtaagtcgtttaatttttctttcatctgatgttaatttatgcagaagctaataacatatttgtggctcagagctgctcattgtagggaagatttctttcccaaccacactcttctgtgatccctgccagaatacagccatcatttcagggcttattatacttttgtcagggaaaggtaatattctgatactttcacatcctgtagatacatttaatttttaatcttctgaacatcaatgggcttaaatgctctaattcttctctagctgttacaaacaaaatggcaaaccaatgagaaagagatggaagaggaaattttttatgtgtgttcaaagtcaggtagacagaaagggaagagtactcttggctgttgaggaagaaaaagtcaggggcaaggaagttttcataaaagaaacatgggttatttttatatccaagtaggatataatcaaattgttatgtttttataagtgaaaaatttaattccattgctaccaaatcacctatataacagagacaatagtgcttgaggaaatgtagaatcttgagaagttgacattttaaatgaaattcagcatgaataaagtaagtctcataatgacagcttaaaggtctaattcataaaaatgttattaaaggacattaatctgcattttgtggacttctgctcttattcatgactctcacagtgtatgactgtaatcacaagcagagtgtataataggagcattaattcaatttggacgaagacaagaatactgtatcaccacaataaaattccagctatattaatttgaagggtagaatttgttgcacaagagcattgtctaaaagaaaattgaaaaataaatgaatgccttccatattctgggttcaaatatctactttctttgtgaagttcggtgtaagattgactaattggcacaagctttttaatgaaatatttattcatcaaccttatgaaacttggagacttggatactgagttctgatcttatggttagtatggcattagtgtttagcttgagcttagaaatatttacaagtcatttgtattttaattaacccctttgctgatacatgacatcagaggtgatgcttagcaaatggctattcaattgtctggcatatacatttatttagagaagatgtaaaattcactactacataaaatttctcccagagaagctgaaagtagtgatacttgaaagtatcttcattcagaattttaaatatgatctacatgtttaatatgcataaacctttagaaaagaagaagtggaaatcaattggtttatttctatctctgaaactatcaaaatttgacttcttgactttctacttctgattggatgagctgtaatagtatgctgtagacacttttagacaaagtgtgaatacatttttccctgagacattagattatctctagaaatcatgaaaggggttctttataaattatatgtctaacattgaaagaaagtgttgtctttgatcttgtaggtaaaaaagctctatacctatgggaatgagttaattcctctatttaataagatgcagtcattagtagacaacttaaggattcattctagaactacatattgaatttctttagcataataatgatcttataatagttctgggtaacggaagtctttgaatgtacctgtacctgagatgagagacaactgacaaagagaaaggaatttcaaatataaggtaaatagcactgctaattgaagataaaaatcagtacatttacaacattaaccgtagctattattgtcccaaatctaaaaccactgaacattcaatttcaacaactatgtattagtacaggactttgttatctaaaatgattatgcttaccagaaaagtgtccagggatgtccacctgctatgtggctatgcctgggcagcacgtgaattctctgtctttgctccctcagaccaaggctgtctcagatttatgaaacagggctcttccacgaagtttagaagtaccacaaacagtttgatgtggcatccagacttactgcaacctctgggtgcaaagattgaacagccttgttgatacaaccactcagaaaggaccgtggaagttatgtttccaacacactgccagacacttgtcatcaggcttaaatgcctgttggcaagagccagatatgaaaaacagctacatcaaaagatacctttttaatggtctaatatattatttctaatgaaattaaatgtataaaagaaaacaaatattaattcttctagtttatctgcagtatattttccaagaaatatattttaattttatatatcaatacttttaggcactagataaacaattgtttggttcagaaagttcaaactatcacattcattatttgtaaacagtattagcagtctacaacgttacacatttactgtgagccaggcactttacacagtgttttgtaaacattaactttgagggaggtattattatttgataaatgaggaaaataagacttagtgggattaaattacttgctcagtcacaaagctagctggaggcagaactgacttaacaaaaatccttcatttcaaccttggttttgctttcatactaaatttccctaaaggaaatattttaaatgtattctctagaaaaagaaggggaaaagaagaaggctgagaagaaagttacttctgaaacaaaaaagaaaggtaggaaatttaaaagccatgtaccacataaatcaattagtgtccatgcataatactactggtaaatctattattttctaggaaagaaattcccttaataaatgcattgtcattgttattagtgaacactcttaacatgtctagatattccaaataaaattaaaattgtcaatttttaaaaagagaattcaatcctaaacactttttgaaaattactactgtgattattttttctttcttaagagcagctgcttaattctctctaattcactactttactttaactatatatgtgaatatgatggttactatttaactaattcagtctaattttaaaagtcattttatgtagagggcagaaaatacttgattggtttgttttacacatatatatatattttaattggttgttttcaaataatttatctgatgtcccaagtgaacttcagagatttcagaacttttgacatggttctggtgacctcatagctcagagaacattcaatatattcttttcaatatatgttaggaaagctgttaaataataccataattaataatgccatttaatgttttcactgttattaaataatttttgcctttggcaaaaaaaaaaaaaaaattctgtttcctgaagagaaattatacctaagccactagtctgttatgaaggtgctaccttattcatatttgacatgacttatggctgatttaagatttctctatacaagataaattagatgcctcactggtagtcatgcatgccctgaaatatttgcaagttaaacaggtaaaggcttataactttcttattttaccagcagaaaaagaagatatcaaaaagaaaagtgagaaggaaactgccattgatgtggaaaaaaaaggtattgcactttctttgtttccttagatggattacgttcaggatgtttgcttcatgaaagactcctcatgcaacatacacaaattgcacacagttacttatatctacccaagacgtgaaggtcaaagcaaaacttgcactagacaaagttaaacaggcaaagaagactttattcaaggctattgcaataggacagagagactggaattgagtctgaactcaattcccccccaaaaaaacgcaggaatgtttgtaatggctggtatggggaatcacaggacatctgtttttgcatattggcttttccccctcaaaacgtaaactttcagtcttatatctgcatggtaagaagtagtttcacaatgtggagcgaggagtccaaggaagttaggctcctactcttccacagaaacttagagatggggcactatctttcttgatgattacatttcaaagggatggctctcagttccttgagaaaggctttatgggttgtgaaactgaaaagtggcttgtaaatgtcccagctactagagtggccaagacaggagcattgcttgagcccaggaggttgaggctgtagtgagcaccataattgcactactgcactccagcctgggtagcagaggaagaccctgtctcctcatccccctacaaaaaaaaaaaaaaaaaaaaaaaaaatctgtatctcaataaagtagagaaagaatttacaatgacaagttttccagttttctgaagtaaatgctctaagaaaagggagattaggagctgctgaaggtcagaaagaaacctattaaagtttaatcaaggtgaggaccaccttggtcaagatacaatgaacttgagaagagatacatagtaataacaataccacattgcaaagataagaagctgagaaagaataatgcaccctattaagaaataaggttattcaactatttgacagtttcgatttttgctttaaattttgttctgtttctattcttgttcaaacatgaatattggcttcgattcaggttaggcttaagtttacatggaaaagacaatcatctcaagtattatggtttggtgataagcattctcacctgaaagatttcctccactgatgtcagtgatgcttaaaattctaccattagaaccattccattcctttgagttatgaaggaatcgtcccctattaaaatgcagatcttctagggcttgtgtatatggggtaaaaacctaattcctctcagctattaagaacttaaagtaaatgagatttccagatctttcctgtgtaatagtaagctaaaaattgtaccccagaacatgaggtggtaggtaagcttaaacgaagaagattgaaaacttcagggtggggaaccgtctggggagggcaggctgggttagacggcattttagtgaaaatctttccttttctaagtagtaataatgtatgtggaaaaaatgatggtggtgaggaccctaaaaagaagagcatacataggatgtcaactatataaagattatgattagcaagcagcaaatagaaatgcgtagaaatatctggcatcatgctataaatggggtagaaaaaatgtaaaatattaagaattgcatgattatgtggcccatgaaatgagcaagaaggatcagccagacattctgtgtgtccaagagttgattgcccattcctttgcatccaaatttccattattaaggctgtattattgtagtctattgttctattaaatattcactcattttcttttaaaactttcttattttctgatgaaatatgtattttatcataagaagggaaaaacagttctgactctatgaatctgagaaactgcttgcttagagcagtggatttgtgaaaattacatgattgaggggtaaagataaaccaagatacttcttccttgccatcaattttactaaaagagttgcagaagaaaattttgagttgtaattttcaagcatttttcatatgcacgcaaatgcaaaatctgaaaacgtgtttttggcaaaactcaatggttttgtgtgtgtttgtgtgtgctcatgcgtatgtgtgtgtgcatgtgtgtttggcttggttttagctttttgagggaaatgatgaaacttgtttatgtgcaatggttcatgggaaaatctgatactcccctgccactgggagacctgtgttattagcccagcagtcatgtcaaagtgaggttgtgcaccactggcaagagaacggattatgcccatatcacttcctacaaggacagtgctcagccaccgaagcagagaccaaactgagtaattgctcagcacatctaggcaggactattcagctagtgttgtctttcttggagccagttttctgtttgtatgcttgtcatttttacttttgattacacaaaattccattgatttttccaaatcagttcaacttcctgataaaagataggcagagtttatttgtttacaatccctcaacccccaaatactcaaaacagtgtgtgcatgtgtgtgtgtgtgtgtttgtgtttgtgtgtgtctgtgtcagagagagagagagagagacagagagattgagtttcagttagtgctagtttttaactcgtttctttttagggtttaataattctttatattttcatgtgacagcaatatggtttacaaacagcaggtttcaagcttattatgaaagtagtaaaattttacagagataatgagagaaattgagaataacctgaaatcttgaagagctgggggacaaaggtcatttcttcctaaagtagaggaacatggcagagcatatgatctcactactgtagccccaaatagcaaatttataaggcataagatatgcctacatgcttatttaatatatgagtgttattgtgatattttattatatttatgttaatgttaatattatttatattataaaatatatgcatttagttatatgttatatgttatattattattttattttattcccttatattgtattattatgccgacatgacaaacctaaggcttaaactctattcagtgataaatgggcttctaccgtatgacactggtaaatcacactttgccagtgatctctggggaagttgtaggtggatgggctttatatgatacaaaattgccaacccattaattaataggggttgaaactgagcaattggtatattggggttaattataacactcctttatttagtgtatatttgaaatcatccatggcaaaaaattaaataaatacctgccaattaaaaacattatgtaaaattaaaaaaaaatcatcttggtatttttgcaatgttataaggtacattttcacttgaagaaataccatgaaaaaagcaatcaacaaaagaaataaagactttaaaaacatctctctaggtttgtattagacttcagtgctagaaacactaaacactgtagttggcactgctagaagacattctatacagggaactgagtacctacaatgttattgaaggactaaaataactgaaatcaaataatcaaaatttggattattaagcatcagggcagatcaacaggttaggagactgctttgttcaccagcactgtcttctcacaaccacaaagactagatcctggaaatgttgaggcaagcctcagcagattactaacatcttcatttgccaaatcattcatctgctctgccaaaccatttctgctttcagtctggtggaacttgatatgtctccagaactctggctgcaagtgagtctgtaagatgcattccaattttctcaagtgaaagtggagtgaaatggaagttgaaagaggctatcaatagtatctataaaaatgatactttcaggaatgtccaagatgataaaattcatacaataagagatggtttttgaacacctacactttatagtgatgaaacctatctttgagttcccccaaaagatgaaaaggatgacacaactaagcaatatgatcaaatttggcaattccaagtgttcacaaggcacacttacctgaagtttatgttgctcttcaccttcactgtagataaaagaagcatggatattctttctctcttccaccacaaggtgatatttttgaagaaataacgtttcacctacttgattagattataatatttgaacaattaacaagttgacttgtctcataacaaaacaattataacctgggcaaaatatatagacacacaagagaaacaggccaaagctaagatgacccattgctcttgggttggccttttcatagttacaattgtaaacttttaggagttaaatttgtcatcatcttatatgtttataaacttattaactgtgaaaataattttgacaaaataactattgataatggtataaaatcatatttaattatcacactttccaataggatttttttttcaggaattatctgtatagaactataaattacaagaaggatattaaaaccacatagcttttctgaaataagctactagaaaaaaatgaatgtgttcattcattcatgcatgcatgcatcttgaaggaaatatttaaaaaatgcctactatatgccaagctttgtactaggtgctgagtacacagaagtggataaacagacaagatctgccctaatggagcttacagtttgacaagggaggcacacagtgaataaagacaaaatgtccacaagttcaactctgagtaagggcagtggagaaaataaacttaaggcaatgatagaatataatgcgttggggtggggaagttatttaaatagataagattattagagcaggcctctctgagagacagcatttaaattgagatctgatgtattgaaaggactcagccattgattgctggatcattgtgtgatgtatatatatatatatatatattatatatatatatatatatttatgatgtgtgggggaaggggagtgtggtttgtactaggagtcagaatatgcaggaacatgtataggtgtttggactttattaaaagtgtaatggaagagattgagctgaagttttaaatatgggaatctttatagattatagttgatgctcttggaatagatgagactaaaaagagacagtgtgtcaaaagaaaaagggaatacaatccaggatcaagacctggggaagtccaacacctacaaattcaatggtggaaaataaagcaagagaggctgaaagaaattgccagagatattaaaggaaaagttaagagcttggtattatagatgtttcagaaatagatgtttcaagaagcaaaagttatcaactttgtgaatgtcacttacaagtttgttttacgagggcagaagacacaagggcagtcagtggagtgaaagataaagtcaggttggaatgggaggtgcaaaaatggagactaaagtgtagattttgcggggaagggggaaggattacggctgtaggaggagtaaagtcttttgtgttttgtctagttttgctttaatagttcaatctagtgcccgatgtacataaacagaatgtaggagattgatgctcagagggacagaatatataagcagaaatcgaaaagataattgagaaattatactttgatgagtatttggtgaaaactactcttttttttttttggagataataccacaggtgctgtgatatttaaaaagttgatgttttcaaattatgactaggattctatgcagattgccttaaaagagaggcatgcatttgtaagatatacaatatatgattaggtggctctggtgataaaactaaaactccaataataaatacattctgagataaaagcctcaattttagaaaaagatatatccaaaatgtcttttgtgctcactgaggaaagtttgtgaaatgtattttaacaaagctctttaaggatcattcatttacaataccccattagagctttacactgaaacatctttgtggtggtgaattggtcaggtaagatttgtctagtatagaactcataaagaatttgtgctgtttaagggatacattcgtatctatttccatcaaattttttcaattactgtatgtggcaaataatattctgcacaaactaaaacctttggctatttgctttctctctacaaaatctgcttttctcattgagaaattgcaaagagtcctttacagaagcttattgctttgaatataccattaaatattattgtctaccaggcattagaatattatgtattttacttttgaatcttttgtaacaagttgttctagctcaaaataatatatatggcagactacagatcacttaaatttctacatttacatgtaactaaaagaaacctattttaaatatttatgtgtacatttataattggacaaaataacatatagtatctttcatatgtattcatgttaagttttagtttaaaagaacatccttccattttctagacttgtatattgagaagattatagctttttttctgatcacccacatctttctccttatttgaaaagcacttggttttagaaagttatcttttttctggagttttgcaaatatgtatttgggcaagatttaacaaatgcatccaattggtattgttagacattgaaatctagataaattttttcaggatatttgatagtaatccaggagttactatcaagttataaatgtagataattcatacacttttgagtgatattggggcagttgtattattttatattccagataaaattttttaaaattcattcagataagtaaaaaatggaaaatctagtacacattagacctggtttaatcagtatttcccagccttgacttagtgaggctccacaattacaaggcaatagtagattcctttcaagttagccttttgttccacaacagattaggttgtaaatctgcgttcagatgacagcgtcttgactgtgttaaaaacactggctatgctcgaagggctttgaaggaaagagagtatattttcaagtgttttataatcatggaacttaggtaagacaatagttgtttaaacatttgagaataagagattttccaacagtggaaagtcttctgacttgttacttactatgatatcttgttacttactatgatattagctctggaagctaatctgttttagagaaagtaagatggagttaccactataacttattgtgggaatatctgagataacttttcacatattcacttttggtttgaacaatacaaaagtgagcttgggctgaatgcaaaaatgaggtaaggacatgggcattttaaaataaatattagaaactcagaaggagcgaaggttcatgttaaaaatatttaggcctgaaaagaggactagtatacatgcgactatttttaatctttttaatgcttattttggggacttggggctaccctctctgaggacaaaaacaagatcacctctgaacttgagaggtgtgttatattatattattatattatatttatttttttgagacagagtcttgctctgtcaccaggctggagtgcagtggcgcgatctcggcttactgcaacctccacctcccgtgttcatgcagttttcctgcctcggcctccctagtagctgggactacaggcacatgccaccatgcttggctaattttttgtagttttagtagagacggggtttcaccgtgttagccagggtggtctcaatctcctgaccttgtgatgtgcgcgcctcggcctcccaaagtgctgggattacacgtatgagccactgcgcccagtctgttttattgttattattattattatattttgagacagggtcttgttctgtctacctggctttaatgcagtagtgtaatctcgcctcactgctgcctcaacctcctgggatcaagagatactctcacctcagcctcctgtgtagctgggaccatgggcacgtgccaccatgcctggctaattttgtttatttttgtagaggtgaggtctcactgtgatgcccaggctagtctcaaactgctggactaaagtgatcttcctgcctgcatctcccaaagtgctgggattacaggcatgagtcactgcacccagccttgtattatcttttattaagttctttcaacagggagaattgaaatgcatataaagaagaatcagtaaatatcagtaaatagaccacatatttcttctctgtacgcattgatatatcaagaatttttagcaggtcttgcacacgttagataaattattttaaattccagttcatatttattaataggataaattattttctgaaaaaagttaaataaaataatgtaattatacagtagtctcttgcaaatatcataaattttcctgggaaaatgacacagagtggcataagaaatggaatgtcagttagacaccagttattttttaatctgttaatctcaatttaaaaatatggagagattttgatcaatttgttagacaataatgtgacagtgtggcctgagttttccttgtgacttgagatacatatttaataatgcagatgtgaaatatccaggcaaattttgtcgttatatatcctaaaagtctataagattttcctttcagtgcaagtaaagctttaaaaacatcaaagtgatatctccctcaactgcagcctctctagggatcccaaaagcgtatttttgaaacaacagcaaattctgccagtatagattcattttatcagcagcattttaaagtaatcataacaacagttattaaatctgttttctcatttaatcataacaactctgtaaggtaaccattataatccactttttatagaaagagaaacccagcattggaataggtaaattacttgcccatcatcaccagtaagtagagtgaagtcagtatgaaagtcaccaaataaagcttcactgtcttttgggacccaaaagcactttgtcttctaattctaggaaacaatggtggtagactgctttagtgtctttttttttcctccctctttttcttttttgctaatttccttcagatgatattgcagacagtggtaaacatgtaggaaaaaatgcagaagagatcctgtaggtctgactcttacttttcttgtagaaattatgctttccttcattcattcactcaaaaaatatttaataatcccataatacatgcaaggaaatctgcttaatgttggacatagatcagtgtaatagacatagatcttgtctccaaggacttcagcaaacaaataagtaaaaattataccatgagcactataatagggtaaatacaaggcctcacgcaaaaatcaaggcagaagtatagaaattacttctcttttgtggtaggtgagtgactattagagatctagaacagggacaccaccgacctatgtaattaggtatttgaccaagacacatataatatttatttttaatcaggatagagactggaacacatacacttttaacagtggtgtatcactgaagatacttgatcttgcaagtggcagatgatctcaaagaaggaatttattagtttatccaactactattctggagtaaactggctttgagtttagcttgatgcagaggtcacacaatatcatcaggagatttacctctctctgcttttggactctactcccttgggattggcctatgtagctgtaaattggccataggtgctgccctatatcctctcttgttcatgtcctgctagggacttgggaaagcgggtaggggtggaatagatcagtgtcctgaaaggtcaaataaaaacttgagcagtatcagtcttcataggcccattcctgaactaacctttgtggtgtgggtgaaagaataatctgattggtttattttaggccacgggtcctatccttccagcagagaaattacataaactttgtccaaaacattcgagctgaaattggattgggtgatgattccctagattaggtttaaaaaatgatgagatggactagctacaacattgaaaaagaaatataagtactctcttcaagaagtcatttctagatggtgaaaatctaggtgatatgatttctttatttttatttagagaataacacaagggagaaattttagtgtcatctatggaggggatacttaagtattttagaaaaccaacccaacatagaataaagcagtgtgatcaacaaaagcaagcaaaattgcaggtttcattcactaaaatattatgtgtagtaaagaattaaatccttcccctctactttgtagttttagaattacacttggataatagtctttaattttaataaagatattttaaaataaaccagattatattcaggagagagtagctcagaaatgtggatgtgtaatatggaaatcaggaaacagagaacatcaaagccatgtttctaactttgatctactctcctatttaggtgtagacttactttttattatccctaagaatgaggactccatggtggaagttagaagtagacaatgtgggatgtttaagattatatggggaatcttttaagtcagtgaacactgccatttgaagttttcaaacagagaaagagtgggtatctttcttgaatttgtggaggtaatcctgtaagaagaaggattacattacatttaagaagacttacaagatgctattttttcaaaattaaacatctagctaaatgaaactaatgtctagattatttaaattttgaagtgaagttattattattattgttatcattgtattaaatttagccacttgtcttactcttctagaaggttagttattaaaaaaaaaaaacaaaaggcgtggtcaagagtttattccaggaagtgaggccatagtaaatgttcactatatataacctgagctgacaccatctcttctgactgcctattccagcaaaaaacatcactgtgaatcttatcatagaatgttttattgatatctgcataaaccaagggcactaaaaaaataaaatttattacacatgtggaataatgattaattgtcctcagggcaaagaaatatcttgagacatctcagtagaaaaaccccaaagacaataagcctaaggtaggaaagaaagtttaataattatttataatgcaaaaaatagggaaaaatggtttctagaccataaaataagaattgtggttattttttagaaagtttgtttgttgtaagtagttaaaggagccttgaggagcacatgtaataaattacctctgcaattaagaacagtatttttcaaaaaataattaatgtcagtataaacaattaagtaattttgttagtcacttgcacatatccggttagctatattaattttggaatataaggtcaaaaatgatgaagtagctaatgctaacagatgaagtagttaatgctaaaatacaccagaaggaaaggcatataaaataattgccttgaaagataccatgctgatgtagaggtgaaaatatatgttatacaaatctgaggagaaagaagaaaatacaccatggcttgaacatgtgatataagcctatcagcggaatgtggtaaaccacttgggctgtcttccctctaaaaatatgtatagacactaacattcccaggaatttgtactacttactattgctccactattccacacatgcagcaggggctcagtggacgtttgtgaaatcaatcctaagttagcttttgaaagaatgcctggtgattccattatgttttagaaatagaatcctaatagttcactctctcttttctgagactactctctccaaactgttccttttttaaaactcctttacctttttacccttcttctctatcagccaaattatttgcttcctttttttctcagaaaataaaaattagaagagatctctcacaagctctgaccatcaaatccaaccatgtacttcatctgtctcatctgtctccttacattctctgccttcttggcagaagacaatgcaatacagtggtttcaatgttcatacttctatgaaaaatccttccactggtgcacagtatgccttccccacctgctaactaaggagcatcactcctgcaattctctcctctgcaaattcattttgatttctaaggtcattctcagcagcataaaatgtgctatgtcatatgtgtgcatatgtatctgtgtgtgtgtagatagatgatagatagatagatagatagatgatagatagatagatatgtatattatataaatatcctgttattgacagcacatccttctcaggttgctgcctgatttctcagatcccctttacagctaaactcctcataagcattgtctacattctccttccggtctctcatccccgctgtacttaggctttcaactccaccacagttcttgtcaactctccacattaccatgtccaaaggtgaactccttctcaagagcatttcacagcctatctctttcttcactcaccctcttagacaacattctttccttttaagttctctggtcactctcttgttttcttttgctggcttcctccctttctttctggaatcccaaattggaagcactctagggctcaattctctctttctctatcctcactaccttggtgatctcatagtttcataaatttaaaaccattcttataataatgactctcaaatgtatgtctccaactggggcctctcactgaactccaaaatcacaccttcatctatccaattgcctattcaccatctccatttaaatatccagtagacttcttgaagttaatatgtttttttgaacaaacaacaacacccctcatctacacatacacacacacacacacacacacacacacacacacacacacacctctacctctgaatgtggctctatgctcagtattttcctcttattagaagattactacacccttttttccccaggcttaaatctctctagccactgctgactccattatttctcttccttaattcattattaaatcctctcactttcacctttgaaatatgtttagtagctgaactttcctcactacctttatgaaccacctcagttctggtaccatagcctcttacctctaaagtcaagttcatagtgtaacaacaatatgaaaacccctgaaaatttcagcagctttgaaaaatgagaacgttttttcttcttcatgcacaagttgggaaacctgctgtactcatcatagccacttaggcacccaggttgatggatgctctgccttcatctgtttccacctttacagaggcttccacttcactcagaataaaatctaaagtctccacaaaggtgtaaaaggctattcatcaactgaagggcgacgataacacctgggcagcttttctcatgcagcaaagccattaactgaggtcctaatcacacatgcttgccatttgtaatcatttgttatttgacgaaatttcttccatttccaatagaactcacggtttcagcatttagatttcaaaagtatatgcacaatttaatttcctattgcaactgaattttagcttcactcaaattttatcaaaatgacaagaccaattagcgtatgaaatatttaactagcaagttaaaaaaaaaacgcagacagaaagctaattgatgcatgagttgttttttcttgtttatagagggcctatgaaaacataatgcatatgaaaagagccgtgacttcaactttgctgtaaaatggtctctatagaaaggatttagccttgatgagaaggcatggatgtgtgaatgtcattgtggaagaagtaggccagaataaccaattagggacagaaaagggcagttaggcaggaaggagttaaagactgcaggttagaaaacagttttttattcagtttgatgccttggtaacatgaggcataaagtttccatatgtgccttcgaatgtggccaggtagggtatataaatacgatgattaaaaactcatagtcttgcctactgaaagactgaatcaacaaaaaatgacaatggacagttataattttcctctggcatttctctttccttcttattctgctcatttggtgaatggcccttcccctaaactctaaccatgtaggctcaaatggggtttcaagttactgtcattgttccacctgtcactttccccatgagtgtgggcccatgacccaagttaggccagagtgctgtccataggctttaagtaaaaaggaaaaaaggaagatgatttatttttatagatggtaatttgagtgagtgcaagaaatgctattggccgtatttacatccttgatgtggtagctaatcttgaaaataatgctgccccataaaataagacaaaaaaacatattaaggtagaagtttaaaggtatttcaagactatgattcatgtatccctggaaagtactattcccctgacctcctgacattacattacatgatttaattaattcctcattttgtctaagttagtttatgtttgtattttgtaattttcaaactaaatgtttattactcaaataaacatccatacagatttagaatagttatagcaactttaaaactcttgaataatgagagtgagataacaaactaaataaaacattttatgtttgatataactcaccttgctgcacgacttcttataggaggaaaataacttctctgataaatgtttaaatatacctattttggtagctggtttagagagtgaataaatatgtatttatttaatgagacttaggaagaaaaatatatttgtcaattcagcatttacttgccagaaaacattatgttaatgtaaatttcaaaatttttataactaaaagcaggggtaactttcattggttttatcttatgaataaaataggaaacaaaattcaaatgcttcttttaattttattctgagctttaacttctgttttttaaaatgtttaatgtgaaaagatggcattttatagctggagtataaaattaacaacatgtttattcctccaaactattaataaacacagcgagacagcccaagacaaattagacacagctacccataacgctgttacatttatctgctttgctagtaattatagttagaaaaaatccactatcctttgtgctacatagtaatccataatttattcctgttacacctttttactaattttttcctaatagccccttgaaggaaacacacaaccttattattattatctgtatctacagcagatttaggaggttttaaaacctgttatagttgtcattgaggataagtagaggggtttgcaatctagaatttaaccttaggtaataagtactgaagactttttttgttaggcctaagtcttgttacataaacttgccccattttatttaaccactttgacctaaattactacttgtataaattgtgagcagcaatgattccattcaataattttttaaatgtgtggaattcccactattttgtaggggaacttttatgtgtttgattcatcatgattaatttagtccaaattagtttttaaaatatgtattagattgcttttcttggaattccaatgggaggaatgttggattcagagttatgaagggtattatcatggctctctctctgaatctctcttttcccatctcccataacttttcccatctcccttaactaagctttcctgcttagttaaagttttggataaaaactctataccttgtaacaagattgcttctgtaaatgtcaggcttacaaagtcattaaatgctgaaccccaaggaaaaaacatgctgaactcaaaattctaaggaaattttctgattggccaaacttgggtaacatgttagatgtgtgggcagaactgaatacagttacgtcccagcgactggttccaagatgcctcaggaataccaaaatccaaggatgttcaggtctcttataaaaaatgagataatatttgcatataacctacgcacatcctcccaaatgttttaaattatctttagattacctacaatatataatacaaaatatatgttatgtaaatagttgttattctgtattggtttttaatttatgtatatatttttattgttgtgttatttttattgttttcttggaaatatttcttttttttgagatgtgacctttctctgtaggctgaagtgcagtggtgctattatggctcactacaacttcaaacccctaggctcaagcagtcctcctggctcagtcccctgagttgctgggactagaggagtgggccgccacactgggccaatttttttttttttttttttgtagagaaagggtctcactctgttgaccaggctggtatcaaactcctaaacttaagcaggtctcctgcctacaccttccaaagttctaggattataggtaggagccactgcacctggccccaaatattcctgatctgcaaaaaatggtggcgctcacctatgcaaagcctattgatgcagagttggccatctgtatataattacttctatggctgagtcctcctgaaaaagtcaaaagaggttaggtgggaagaggatgaggaaaagttcaggtcgagtatgaagagagaacagcagagacagtgggaaatgaaattgggaagaaagatcctgatattcctatcaggtagctgatataattaagtttgtgggcacaactggataatttacacttcatttgacaggtaaatgtgtaaaggaaacagattgacaaaatcatatctttgcctaaaaagtattaatctgccaatatactgtcaaaggcaagagaccaagagaaatagtagttagaaagttatatcaataaatattacagagctcaagtcaattacaacaatgctggtgacaggtaaggagggcctaatccaacgtggcagattgagaggagagagccacggaaagcattataaaggaaattcacccagtatatagcaactgagcttctaaggaaggaaaagaaaacatgtatcagtatttatttaaatggctttttagcagataaatttcctcagagaattttgtgatctctgctgtttcctctcttttaactggaagaagaatgttgttagaaaaaagaaagaatcagagggaaatagataccgttctgtcatgatgactttttaaaaacatactgttttcatatgagcacttcagttggctggttcagttgttgttaaacaatattttggggaacccaaaaaccattttccttttggcatttaacaacaattaaaaattttttccattaatttataatgtggttcctttgttacttaagtaatctttaggctagagaaaaaaaagtgagtccattctgtttttttcgacactgagtatctagcacctagtataatgccagtatgaagcagatgctgaatccacccattgaataaacaaaggaagcatcttccatcacatgagatgtatttttagttttatatccttcaaaaaggatttgcctcccatctgtgaatttctgcatttactttgtctttattcacttttgctcactgtggtcatgtagagaaaaactaaatattgtattcccagtctcctctgctgtatgtggagtcttaattagcttttcaaacacattgcagataaaacctattaatcctctgaccttcactgaattcaaaagtttttgtgttaattgttttgagagaataatagacagttttgctgtttttttttaaaaaaatccttgcatctctgccaggaaaacagtagaaccagaaagagcatttgaaaggctgcttgtatttcagctgccatcttttaccactagtgcatgtcagaggacagtcatttctaaactttatgaaagtcatttgttttcttacagctttataaaataagcttttaaaatgatttctatccaaaaatagcaaaaatagcaattagatcatttaagatgattgtaattttgtttattaaagccctaagtggaaaaggaacttacatttattgtccacctattaaattacgagcactttgcttgcattaactccttaaaacttcaggatcccctttttcctgtggtttgaccatttgtgtcaatattcacttttgtttacaaggtttcaatcactccactgggtactgacgaaaaactgatgaaaattgtcaccctcatttcacagaagtgcacacattcatttgttttcgagagtaaaaatttctactgctgatgtaggaaggaattaggacttgaaatctgttttctctgattctaaaacgattgtcaaagtttcaatgaccattagcacttgggaggcaggaggtactcagtagtatcacccaaggttaaggtgacatacacaccagttttctcctgtagcattgacataattattcatcacactttcttttattctcagagatgtccagtgtggatgattgtgctccatctcagaagcttttaaaattatgtatttgcgagtgctgtgggagaccaaggtgaaaagatcacttgagactaggagtttgagaccagcctgggcaacatagtgagacccgccccctgtctataaacaattaaaaaattaacctggggctgtggcacatgcctgtagtcctagctactttggaggctgaggcaggggcatcatttgaacccaggaaatagaggctgcagtaagttatcacaccactgtactccagcctaggtgccagagtgagaccctgtctctaaaacaaaaaataaattttaaaaaattatgcatgtgtaaaggctaaagcaactccatcatggaaactaattcactatgctgacttctgcttaaccccagttcctctcagatttctattttcaagtacttaccataaatcctgcttataggcaaattccttctgaaacatctataccctttctctatggtatagaagccctggctctgggggttaacagtgcggggatccaccacctctcagctacccgagacatggcttctgcttgtaaatccctaggaaatgcttctttcagagaaactggatctatcagtttctttttttagcctctcagctcccatggcctttgggagtaggttcacatagatagacctgctcatcttgaaacagcatctctagaggtttagaataccagaatctctcttcccatcagcgattatgattcagtcgtcctggtgcaaggataagaaagacaactgtattttaaaaatgatccttgggtgattctcttctgccaggtaagcaaaacactcatcaaggctcataaaaaaagcagccatgagcagtgaaacagaatgctttgctgggagtcgggagcttggacctgaggtctaaccctgccactggatgcacaaccctcatcgtttcaggcttctgctttttctttataaaccgagaagatggaatggagtcagtggctttatgttggggttgggggttgagtgtagaggaaagagtaccttgcaaagtctcaaagtatgagactttgtcaaactataacaagattctgagattcttgtagccacctatctccatgggagctgagggtgagtgaagaggtacttgttcttttggaaaatcactgcttttagggtgccagtgtttgggatgaaagtatgttgtatggtatcattgcctatgttggagcaggaaaaaagaaagaatggaaacttaggtagatggtcctgaatttttatttctaaatcaaaacattaaaaaaagtttggatttagcaactacttgattcagtaacttgcttttcagctgcttagtttaaccacacacacacacacatacacacacacacagcatgaaacaacagctgaagacgtatttgatgatgtgagcacaaatggatttttttagtctttttcctactgagttgctggagggcaacagtgcgaacatccacccttccttgccagctggtgtgtattcctaaaccagggaaataacggtcacacttaccctacctattatgacaagctacctctgggtcaaaattattacagcatgttcttattagtgtctgaatcccactttcatttgtgtgttatacttacccagtcctggatgagtaattttaattgtgagagccaaataagcaaaatgtggagttagcccttgacaaaaatagccactgttacaaacgtgatttaagggctgaaatggttcagatcatcatccctggtgtctttgcttaacaaaagcagctaggaggggttattggtctcagaggtggaatatagctgctctgctctgtcagaaggaaagtgctcctttggctacttcttctttgtccacagggcaaatactgtgatatgagaaaccggagagatgggatgtatcattggcagcttggccctgaaggctttagggcagtatttttctctttctgcccctagccagctgtctttttgcacaggttgaatgcatgtgctctgcctttgacattgtgcatttaaatgccagcttgtgcaatttacagtacaaaagggcaaggatacgtgggggaatgaggaaaaaagaaacctcttttctcttctcattggctgacctttgtgatttcgctttataaaggcattgaaagagcccctttgaccatatttctgatcttcaaaacaatcacagaaatagccctttataatgttatttatatacattgctaccagtcttcctgcattagaatataaagaataatttgtatccctggaactgaacacggaaagccattcctatctcagttagctgaaagtaaaaccaaattgcactctgtgattttggtaatagggatcaaaaaattttatattgtaggattttaggccaataatacctgaatctgaaaggtagacttaatatgcttccctcaaattaatttagaaaatttcaaatttggagagatcataacataataattttatgagacagatataaaaggagatgcaggactgagagtgaccttggtggtatgcaaatcctcattcttgagaaatgatttgtatagacttaatgattctcttattctccttaggtattccttcattgattcatttgttcacttattgagtcctttcattagaaagatgcttttctgggtactaaagaataatggtggctgggcgtggtggctcacgcctgtaatcccacaactttgggagacggaggcaggtggatcacctaaggtcaggagctcaagtccagcctggccaatatggtgaagccccatctctattaaaaatacaaaaaattagctaggcttggtggcagatgcctgtaatcctagctacttgagaaactgaggcgagagaatcgcttggacccgggagacggaggtttcagcgagctgagattatgccgctgcactccagcctgagtgcaacagagcaagactctgtcaactaaaaaaaaagaaaaaaagaggaaaagaataatggtgacaaggagacaaagtttttgcatttatagaacttcatagtccagtgaaggagacaaatcataaagggcatgtagtatgatatccgagaatgatacttgctatgaagaattgagagggcaagtggatagagaatatggaaggtgctatgttttcactgggtggtctgggaagggctgtctaaggagatgctatctgaacagagacttggatgaagaaaggagtgagctgcacacacatttgtgaaaatagtttcatacagtaaaaatgcaaccttcacacagaagaaatgcaaaaaccccaatgatcagggaacaggaaaagaagcagtggaatagaatagcatgagtgaggagcaggtggtaggaggtgaagttaaccgagttgtggagatctggatcacaaaagatattatcctgagtgaggtctgatgctttcaaagggcctgagtacagatcattttaagcaattataaaagtgaaaacaattagaattaacataaacacatttctcgtgtgttttgttggctggaaaatttgtttagttgcctcttgctctgtccccttaactttagtgacactgctgtcactgaattttgcatatgaaattctcttcagaaaaggataagactagtgccatctggtggtcgtagttgtgaacgtcatactccatcctggagtatttgcaaaaccaaaaacatttaggcccagcagtgctaaaactttcaataatacttatcctcctaggtaaatatgtctattgagcacatataaaactagaatatggaaactcgactaaagtattcgctgatgttgttctgtgctttgaggaatcttttagtttagcccagtagttatttttgtctatacagtatatgcaatgcagttcacatagtaggcaataaataaattgctattaaattgaaattagcctaatgtctacttatcactgaggtaccattgacctttattaggtcttctttcttaggtctctacaacagtagtattcttgaatccagagagagaccacatcattttctttttattgtgatatttgtggttatgattatttggctagtacacttactatttttatatagtgtttgcctaataaatataaatttacatatgggatagaaagaactatgttttaacattacatgggtgtttatcttaagggctacctgcttagactgtctggctttgagccttgcctcagtcacctgcaagttctatggatgagccttagtttccttctctggaaagactctaatggttctaacgttacagcgatcttgtcaaggttaaatgagaaaatctaggtaagctgtctagcccagtacttggaatattacaagtatccaatacatggtaaatatttttataatttgtatgtgtttggtatgtagcatttgataagctaaaggtcaaatcatgtctcatgggaaaattaaatataaataagtaactagtttgtaaggatagttcagcctgatcactcaataagcatttagttgaattccttatttgtagtaagcactgttctgaaatatccatcatacatttatattaccaagaagtatgcaaagctacaaaaggacaagcctctgagtgtttaataattgtgttcacagagcctagagtggcatctggcacagagtagatgctcaattaatatttgctgaatgaatgaattagaaaggactccttaaatataaatattatctagttttacttcttattcatgtaattatttaataaaatttgatatgttaaagtttctgtatatagatgtaagtaaaactgaaacgatattcaaaattgtattatcattacatttttacctaggagaatgaaatcagtaataatcctagggtactcattttccagcaataatcaaaagattcttatattactaattgtgagcagaatacttaaagagagaaattttggcaaaactattatgcgaatcactaaatttgcatatagtggtttttcccctaaaatgtaatgtgtgttttaagacttaactctcagaatggcaattccattttcctgcttccaagttcttgattgggaactctttattattacacatatattttctattcagctaaaacctccacaacatacagaataaaagatttgatttttcctgactgaaagaaaagctgatatttgtatatatgcatttgttatttatcaaatgaactctaggacaatgtcaactgcttactaatatccaatatattccatggacagcctccctcaagcaatgaatctcagaatatcatggcaatgtgaaaattcctataactcacatatttctatatatcctatggagtacgttctcgttaaacatgaggtaacacttattctgtgttttaatgacatttcagtggtttctagaatttttttaaaaaaatctcaatagaaaggatttagtaaccttaaggttaaccttgatcaatatttcggaaagtattattaattggaacctaaaaggaatgctaaatgcaaagatgtggcataggttcatcaaaattaaagaagtcatgtaaaattaaccttaattcttcatcagatagcgaacttgaagatcagagaaattgtgcaggcttgatgcatgtgtagcaaagcatttgaaaaggtgccttctgatgtgtgattaaaaggtaagaaaatgggctgaatgcaagagaaaactagttaccccttgaacctttactaaccaacacttagtaatggataactcttaatctggtagagatgtctaatggtgagtagggggcttcatcctcttctgagagtctctggatttagtcattactaaaaagattttgcatttgacactgttgactatctctttatctgtaagaagcctattcatgatttgtcaatggtttttgacatgtctgttataataggcaagcacatcttcaaagccaatgaaatttgttacaattttatgtgaaaaaataccttcaagaatgccttttgggaaactatattcacttgccaactggctgtattaaacaccactctttctcttgtcaagtgctttttcttacaatgccctatttattcctggagaattcacttttatcaggctatgaagtcatcaattcaagctcactataaagaaccaaagcttcaccttaagtgcttaaaatactcctaagtaattttgagtaatggtcaattctacaccctttagaaacaccattttaattattttttataaccagtactttctggtatttcaccaaggtgtgatttcagatgtaattctaattaaagtaacaatttgattgtttgatgccagaaagtccagacatataaaagtctctgaaattgaagtgtttttgataattgttttgggagcaatcacaggacattgagtccaagattcagactgagagactgagatgctgatgtcattggcattactgctactgttgccccaacactgggaatttgttgagaacagaaagatgaaaccattaaatgaccttttcacagaatcacattacatggattccaaactttctaaagagtgttaacttttcaaatcaagaagtactatgatatcttgatttcttatattgcttttccctcgttttctccatgctattttctttttaatgtgattttttcattgtccaccacattcctccttaagtaatcatgtttagttctatgtttgaacacagagaattattgaacattttagatattttttggggattccaatctgctggaagctgtcaaggtctaaattagctagttactaatgaaccgaacataatttttctttatttttttcttatgattttatcacatgatgagaattattctggtcgttttaggatttaccattattatttagaatttttttaaaaattgatattgttttagttaatttttaaactttttaccacaaaatatttattcatagaagttactaaaagctacatatccgagtttggtaagttcccagctgagcctacagtctgttgataaagagatgtaaccaatgatgatcaggcatcttgcttacagaacattaagagacccagaagagtattcataatctcaccaggcagctataccacaatgaaattctaaatctaggaagaaaaataggacatttcttaaaatgtgatgatggtcttccagcactatccaattaaacttcctatattggtagaaatatcttatgtctgtactgttgcatgtggcagccactagccacaggtggctctttagctgttgaaatatgactagttattgagaagtcaaattttcagttttatttaactttaaattatttaattttgcatttaaacagcttaatacagttattggctgccatattggacagcactgcctaatctttaaatttaccatgttctccccagctcccacccatttcccttgttttccaataatatagacttgggaagtaaattgtggttttagttaaggcaaggttcaggtcctgtgttcgtctaataactacataagattccatggtgtgctggttagctatattttggggagataaaaatagtactgcgttatagtgtttgctgatttccgtggtgtacgtaattccaccaaggccaatttgaagctaacaacatgaaattaaccagccagaaggatttctgaaaatttaactatctggtctcataagctggtaaaaactgtctctaatatacctatactctttaaaagtcccaaatccttcccatgttttcttaaatgttgctaaggtttacatgccctagatcacttctctctgtgagttctgctcttacttacttggttcagctcatggactggcttcttaattctctgtatgctggccttttgtttttttccataaaagcacttttctttagtttccataaaatccattttcagaaaccagttgtgcaaagcatagaatttttttaaaaagatacctgcagatggtagaggggatggggaaagttcttactatgtggcaatattaataaatacagattaagtattgggtatctttgctatttaatatcctcaggctactcttcactgccctttcccaggttccctcccactgcacgtcatctctctgactcctctttggtgccttccttctgccatagcttgttctcacatcctgagttttggatttcccccagaaattccaaactttccaactaggtcatacaaagcaattcagttctcttcagcctctattcgcaaactctccttttgatattcacactcatcctgttgcttgaaggaccctttatttgccataatcaatcttccttagaaagtagttattcaggctgggtgcggtggctcatgcttctaatcccagcattttgggaagccgaggcaggcggatcatgaggtcaggagttcgagacccgccctgccaacacggagaaagctcgtctctactaaaaatacaaaaattagctgggcgtggtggcgggcacctgtaaccccagctactcgtgaggctgaggttggataatcgcttgaacccaggaggtggaggttgcagtgagccgatatcccaccactgcactccagcctgggcaacagagcgagactctgactcaaaaaaaaaaaaaaagaaagaaagttattcatacatgtaacaaaacttattgaataacagctacacaccaggcactcttctgcttgtaaatatcaaatttggccgttcattatattagtattgggtataataattttcaaaatgcctagcacactgctgatgtatgttggcaatcaataggtgtcattttgttatgtatttgtgaagcaaaatttagaaatatattaacacactaagggacagaaataaaggctacaacctttggaaagattcagactttcatctctgtcttccttttaattacacattctatttcaccctcaaagctgactcttaaatactaatatttgtgatgtccagatatgtataaacagtgatgtaatccactatcattttagtaaaactgtgtataaatcactgtacatttaattaataccacatgtattttcactgaccctatgtttatttgttgctgttgctgtcataaattccctagtcacttattgtggatacacaataaatatatacttaaaatacttttagtttcaataagtgaagagaaaatacaataaatgttatagaaatgattaacattacattttggttcattttgtttcttcgttgatcactttttgttttgctgtaaactatttggtaatttttgtgagtgcagtgagtaatattttattgtcctgatgctaggtgcttgcaaaaggggagaaaatgcatggtgttctgttttactttatgtgattgggcatagaaatgtcttaccaatttgatctcttatatctgcccacagctcttggactccgcagcctttgtcttagttcaggtcatcattactctagtctggagcagtactgtatcctccttcacaatatgtactttacaccaaatattctgcatcaatgatttcactgacggcatgtctgattatttcactctccacttaaacctgccaaagctttactttgtccctaggataaagtcttaattgaagagtttcaatgtctttcctgatctttctctggcttcatctcttgataactctttcatcgccctttgctccatccatataaaagtccatccaattgtttaaagtcaacccactctctcttacaattatgattatttcagagccttctttgttcaaatccttatcctcctctctccacctcccctttgtttgaataccagttgttactttcataaaatatcaccccttactggtcttctggatggacaggtgtcttgtttcaatgaatttcataaaatctctatcccttataatagcacatggcatacaatactgggtatttgtttctcactagactctgagttttgggtgtgtgtgtgtgtgtgtgtgtgtgtaaattacattatctgttttaactgacagagcaaggcacattttgtgaagtgaatgtcatgcttgtgttcaaaattaaggagaattaataactgcaatacataagcagaagaatctgtttctttgctaacattcaaaagtaggaagaatgaatacctttgcaagtggctattatgttcaaagtattatggttggtactttacatatgtcacctcatttaatcctcacagcaatatgagcctttgaaaacttaagcatgctcaaggaaaatatgaaatggcaaagccaagattcaaagcgtgacctttctgactgcaatatttatgttcttttcactaatccatattgcttttgagaatctgtgaaagctgtgttgctgactactacccattttgtgggctaaattgaagaatatatgtcaaagagccttgtaaactgtaaatattctacataagtactgtgaactttataggttttcaagacacatctgttaaataaatcactaagtgactatatgatattattattgtagttagtgtgaaagagaagcaaggaatacttattatttccatttccaggagtaacatcacccagtctatgttcctcattaatgagtgttgcattaaagaaaagttctatcatcacatatgtttaggaatcagtgccctaacttagattggtttctctactgcagaatttcagtctggtatatgttaagtatattgtaaagtcttaggagggtaacattttgtatgcagtgctctccagtgttatttgaccctgagctgcttttgtggagaagagcatctatctggactagtattctatgggttccactttaaagtgctatatatcactcgtaaaatgatttttcttgtcagagattattactcttaaagatatgctcttccatgtaaatttaaacaaggaattcgaatgggtacttctgggacggtagagtatggaaattaatttatatacgtatgttgccaaacaattcttttttttttttttgagaaaaagtctcactcttgtcccccaggctggagtgcaatggcgcgatctctgctcactgcaacctctgcgtcctgggttcaagcaattctcctgcctcagcctcctgagtagctgggattacaggtgcccgccaccttgcccagctaatttttgtatttttagtagagacagggtttctccatgttgaccaggctggtctcaaactcctgacctcaggtgatccacccacctcggcctcccaaagtgttgggattacaggcatgagccaccgtgcctggcccaaaacaattattgtcaagttacttctctaagacataggtatgagaattttgtactttatattagaaaatataaaatatgaccttattcaagtgcttaattagtaccatgtatagtgagatgcttcaatgaaattcagagattttgatgatgaagtattgtgagcacagtgttgggatgaacaagataaatagcactaaacacatggtattgaatacttactatttgccaggacctcctataagcattttcaatgcattcattcattgtatttcaatgtactgattagtaccagcataaaaccaggtaccattgttaatacattttaaagccatatttgggaaactgaggaagagagctgttgaatgattcaccaatgccacacaattagaaattggtggagcaagatttaaacccagaccaggcacctctaggacttatgctcttaatgtgtttacaatattgctacttcctaggtggtttattgtggtgaggtctttgtggaaaaataatttcttattacaaaagtgtttcatgttttgctataattttcaaggtttataacaattttgaatcaagcaattataaaaggcagagaccttacttttaccttccttaagattaatttttacaaaaaaaaatattgccatgcttttttcccttgctgtttgatccttcaaaataataaacattttttattcaagggacttattcctttagttcattatttatacaaaaaaaagagaaagagtatgtattgtccatagtcacagagagggtgccatgagccaaaagaaaaaaacaagatgcatatgggaattttatgggagtgtgcagcttaggaggagagatagaaacatgtctctgaacagcaaaagcaagcatagaaagggacagatgccttaagaaagtcctggtgaagcactatgttggccccaaggagggagaaaacaattgcactacgaggatcagaaaagtttccaagaaatgatagtatttactttggagggtaaaaagtggttgactgtgaagaaaaagagaaaagtagaacaagacaagtaagggcatggggaagagccctgactctgtttctgtatgcacagagttaataaaacatgtttcgttcggtttggttggtataagcagaaagcaactttattctttctgtaactaccaatgcaaacccactctgtagacttgcttctcttcaccccttgggtgaaatcaggaacagacactatagcttgcccggtcatgctcaactcagataataaaacaatggtgtcttttttcaagacatccaatccagtatattatcaaagctcccaactttcattcaaataaaaatttcccccaccccacccccacctaagcttgggccctctcagcaagcaccctgagcttggagcctgaaggtgggaaggtattgtgggtttcttttctctttttcctactctactgaagcccctgaaattgattaccctaccagccaacccaccaggcttggagcaaggggagagcacagagataaagacgacaatttttgtttttgaatcagtaaaccttgaaacccttctatgttggacttcctgttatgtgaaataatactttctcttcttaagtaaaacaatataggattttctataaatttgctgtatagaaattagctgttataattgccattgttgttattttattttaaaggcagagacatttatgtaaaagattttcctatgtttatatatggctatcacaatgagtcacagcaaaaccttttagaaattatattggcttttcattttatatacatgcatatgacggaaaataaaatttaatattatatattacataatataaagttttaagctttatattaaaatttatagtttaaaattgcaaggaaaaatggcattattttgaagagaagtggtaattcttgttatattgacaacatgctgggctagggtcagaatgcttgcagtttagtccaggcctagtggcctatcttacaaagtaatgatacagatcaagtgcagtaattaatgcaaagactttttaaacactgtgtttaaaaatttaactttttattcaaataatagtgtagagtgagcttttcagtatattggagatactttctgaatttaatgtggtatacaatcttgatgtttgtgaaatttatttttgttgaaaataacattcagaatatttataggttttagttttctttggtcctacatcattctattttggcttttacttggcttaaaaatgtttctgactaaaattttaatctgtgcatttgtgcttatctggttttctagaaaattcaacaaatgaaggatgaagaatcaatgcagttttttagaaatttgagtagacatattttagctattacttggagtcaaatatggtctcaagataaattaaatatgaactataaaacattatagcacaaaatactgagggactatcgttaagcttccatttgcttttcaagagatgggagatttttcttagtgtaagtaatctaatgagtgttctctgcttgtagtacttgaagtattggattaggtacccatgaggattacaattagtatggggccattggtgaaaggtatattcctcctttgattaaaaaaaatttgcagttatttgttttttaaattaaattgactttttaaattttacatcataatgtgagcctggttgaaagatgagaattactaaactttttggtctgagaatttatcacggtaacctctactgcacccttcctttagccatttccggcctcgtcatgtaatacagaaaccaattgtgtttgcctctgagatttcttgttgatgctaaagtcttcaaaaatgtaatccacagaagaatacattgtaacattttattcttaaatgaattttccaaactctttaattttaaaactcagcgtatagttcatatttataaaaatttctactgccttcagatgggttagttggaattcagaccatcttgagatgatggagatgggctaactggaaagcctagtagctgtaaaagtagatttcagttgagccatttgttagaagaccaataacttgccttttaccacagtatgtgggaaattgtttttttgtactagcatttactcacttgctctcaaacacttctatgcacattgctccagcatttgaatattgactcaatatggtatttgtgcatataagcatggattttgaatattcaatggttaaaggcaacctctaggttgactgctaaagaaacacattatgctttacagaatagttctccagagaaagtgatacatttgctgcaatacgtgaagatgtgggctccagaagcaatgtcaatattcagtaaccttagcttgtattaatattatgagaaccactaggctgccagctaaataccaatttaagtttagatctgcatgcctaacattggggactactgttcctcagagctgtgcataattccttttaacactgataaaggagagaatgaagtggtgaaattcccttttagggaagccaatattgagaagcccatttatttatctagagcattagcatgtgagctgacagttaaagcatttgaactcttagaaccatgacacaaacgtgaactaaagaacagtccatgggaggcgcagtggctcacgcctgtaatcccagcgctttgggaagctgaggcgagtggatcacctgaggtcaagagttcgaaacaaacctggccaacgtggcagaaaccccatctctatttaatagaattagccaggtgtggtggtgcacgcctgtaatcccagctacttgggaggctgaggcagaagaattacttgtacttgggaagtggaggttgcagttacctgagatctcatcactgcactcccgcctgggtgacagaaacttctcaaaacacaaaaaaacaaaaaatagttcaccacacattacaaaaagtccacagtctctaaaattaaaaaaggttaaaaatagattgtaatctaaatggctcagtaattcagtgatattacatctcaaatactaactgcatattttcccacacatcttagagataacaaacaacatatttccatgtttacagaaatgaatatttttatatattaggttggaaaggacatcaagtatgtggcatctatcacagtacatagcttcaaaattaattgtcctttcatccaaatttttgctttgcttttaatgaatgtttatgaaagtccaaggagaagattgagagtccaatatcagaaagaaggaaataatcaagtgtggcttatctgtctttgttagagatttcttaactatttattaagtggttctttttggtctgagaaggaaaagctgccctataaccttaatatattagaatattcaccaataacatgtagtatcccaattatatacattataaaacctgaatcatttcaataataatttgaatatcaaatatcttgtcccattttcctcccttcaactgctatcttttatctcactattttctatttgtattacttacattttttcaattcctcttttctcctgtatttttttatttctgattttgattcgcaaaacttttctttatttagtaaaattctattttcagttatgttgagttttttaaatttggacctcttccttgtgctctgcaaggtgtcatcattgatcagagtactgtccttctaggaaacagctgtgtattcctgctattttaataggggaattttgatttccagactaagatgtactttatctccctaggcagatacttatacctatgcttttttcttatttcttcccacacattctgggatcttgctaccctaattgtcttcccatttcccagacttttccatatttttctctccatttggtgtttctttattctcctcaaacaaaacaggaaaaaagcctttgcttgatcttcctgccatcttcaagcccctttgtagtttctttttttcctatggcctctgccacatttgtcacaggaatggattccactcacttctattttgttactgtccaccttacagctctaaaggtaggcttccttctatgctcttttccattccaaaaccatatccacaatggtttccagggatctcttagatataaaattttatttctttttatttaaccctgaactttattgcctcatttaaaaaaatgtcttttccctggccttgttgaaatcaacatttggatttttcttatagattattaactaatatatttcttgataggatggtagtctgaagccttctgttcatctgtctctgggaaaaattgttcacgctcttaatttcagtttacacttcgatgtgcatgactttagaatctccatatcttttcaaggaccctcctttcttcaaatgtctactcaatattttcatttaaatttgtaccatcgcttcaaacttaaaatgtgttaaaagctttagttaaattatgttaaaacctattctgtttatcaagtccaaaatctgtcttatttgaacaaacagccttctttccttctctgtatatgtcaaacaaatctcaaaattgtattagattcttcttttaaatatctagcttattttttttccatttccattaacatttgcttagtctaaggtattatcaccttacacagagtattccagtgacattgtacctggcttctatgctaaagggacagaagccctttcccagacaatcatggacacttttatctcttcaaaacactgccgtgtaactttcctgcccaaaaatgcagtagcgctcaatgtactaagacaaaagtctatcttatttgctgagatttcagggtcaattattttgaccataatttacttttaaacaaattttaacatttggtttattaaaataaaacctttaaacaaattaaatttaacaatttacttgagcaaaaaatgatgcataaacctggcacgattcaaaactaaagtgtttcagagagctctgctcaggtggacagtgtgctgttatagcccaaactgaagggaagtacagaaatagcttgattggttaaatctagacatttgccttatttggacgtggtctgatcagttggctgcctgtgactggctgaagctcagctgtttgtgattgactgagactgttttctgttacaaaaaacatactcttaagtaaggtttcagtttgtttacatactgagttaggttgcagttcattatgtaggaactcacaatgtgaagacagcctcaggccaatggccttctgcttatttcatgtgttttacttctcattaacatcaaacaagactcttctgctccagctggattgattcataattccaggaggatacattgtcattcactctgcagctttctttccctttcccctttgtggctctacaccttatctctcctttagttttttttttttttttctttttgagttggagtctcgctccgttacccaggctggagtgcagtggcgtgatcttggctcactgcaacctccacctcccgggttcaagcaattctcctgcctcagccttcctagtagctggaattacaggtgagcacccccacacccagctaatttttgtatttttagtagagatggggtttcaccatgttggccagtaggctgtctcgaactcctgacctcaggtgatccacctaccttggtgtcccaaagtgctgggattataggcatgaggcactacacccggcctcctttaaatcttgtctatatcctgcctccttaaaaattgccaatctctaaaactcagagtaccatacactttatttagcattttttcacacagcattcctaagcaaactgtgggtggaactaattcttatgtttaggtaatatagatgccttattcccagtaagcactcatgcaataaatacagaagagtaagtgacaaacctcagtaattatttggagacgtgttttctcatttaaaatcaaattgcataatgttcaacccctaaccccctgtttaatctgaggactaagtgtaccagaaagcgtttgcttagaaatagcctctgaattcttccttgggctgcttgatttagaattctccattcaggatgtctaccctttggaaatcatggtaatttatcaatgtaatctgcattttacaaacctagccatttttacaaaaaacttaaattctctttgaatatgattataacatctttagattttgacatctatagaactgtagaggaaaaaaagggctcaagaagtctgcgtaattttgtgaggataattgccacatatttggtttagaattgtcaggcatataatatgggcttttcaaacaccttgtctcccaatcattattcactttttcacgcaataacatttcgggatggctgctcagtaccaagaactgtgttagagatacaaggtacacaaaagccagtctttgcccttagtttttctttccactattcttattacgttatattttcagaggactacattcacacaattctgtttgtttataacatttccaaattgggtaaggagataaaagtggtgtgtgtgtttcttattttctaggaaaggaaaaacagaatggtgatattcacatatactgcttactaatattagaaaaaaggggctggttttttaagtgctatatttagatcatactgttctatgacaccctttaatgaggaaagcactctctctaccttatatgtaaagtgggcattagagcacgggtccccaaaccctggtactggtctgtggcctgataggaaccaggctgcacagcagagggtgagcagccaggaaaggagcattacagcctgagctccatctcctgtcagatcagcgggggctttagattctcataggagcttgaaccctattgtcaattgctcatgctagggatctaggttgtgtgctccctatgaggatctaactaatgcctgacgatctgaggtgaaacagtttcatctcaaaaccatcccccattacccccatcccccactgtccctgtgagcataaactgtcttccacaaaaccaggccctggtgccaaaaatgttggggactgtcaaaattagaggccctgtcaactagaccttatttaatttttaaaattgaaattttaactgaagaatatggctaaatcagaaattttgtttcctttatatgtttgtatatgtgtatgtgtgtgtttatatatatatatatatatatacacatacatattctttatgtcaaataaaatggcttattttctaaaataagctcttgacttttaaaatcattactatatttttcttagagtctgaatcaatcctagcccaataaattaatcactcatatggagaatgcaatagtttttccaaatcataacatttatttcactaaagtgtcaaatttctacttgaaattctaagtagaattcacatttgtgtttgagtcctaactgttctagaaagtgtattcttctcctaaggaaatcattccaatttgttggtcagaatgcttgcttttaaaatattatcaatgcaaaaggaatgcttattttatagtagtggaggactaccaggataagtcttaataatacaaatgaataaataatcaagaaatttgccatcaaaaatgatgtaggcaaattcttctaatacttttatctgtgttcataatcactgattttagaaagttgctatagaaggtagaaaggaaccttgagtgaccagctggtactgtctctttgctttaggcaaaaacatctaggacccctctaagacaggtatttctttctctggcatctcaagaaatgggacttcatatcttccatggtattgcattctgttgttttattagatacatggaataaaccttttccttagtctaaatgtaatctgcccttaatatggcaaatattttgaagagtaaaaggccaaatgatctgtatcttgcacataactttcctttatgttaaaaaaagtttcttctgctaatcatttaaattaattgataccttggtcttcaaccctaaattgttgattacttaagaaacttgtcattctcacacattctatccagacagctagataatgccatgagggggaaatgctcattattctgattgatgtttcccaatcattttctgttttcctatgcttaatttttggaaaaagctgattttatgtgtaacatctataggtagattttgacctacatgtagtaaaagcatccaaattctttcttttttcaaattaagaaatacttagatgagttaaatggaagcgatagtcttttttagattaaaatatagattattttagtagccgtgaaataatcaaattttttctgaattaaacactataatgctaagttattaaggtaaaagctacttagattccaaaacaaaaatacatggcttgatgaggtgaagattttctgggggaaaaaatctagcaaaattatgttacctattgtaaatcattttgccaacttatttagatttttaacctctagcaataacagattattttgatacattattcatatttctgcattgtgcaccttttgcaatttgcatatctggctgcaaataggcccttctttcaggcttcagtccccttggtcacacaggatggccaaaggctgcttcatgattaatttcatctcaatagggtaattatcatactgaaatgaagcaatgcccatgaaatatgctttcctggagttataagtacaagaggcttagcctagagctttcaagtatgtagcaacttttagcttaaatgttaacctttctctattttggtactatctatatctaaaaataatactggattttataagaatagaaaacaataacttagaatttgatttagcagctctttggactgcaagataatttgtcattagtttccactatcttatgcaaaaaataaaggatgtatatattttgaggggtcaaggttttataatgctgggtcaaattttagctgctgaattaataaacatgaatttaactcctgatctgtggaaaagccattcaacttttctatatttagttttcttacctaagaaaataagaacggtcggccaggcacggtggctcacacctgtaatcctagcactttgggaggccgaggcaggtgaatcacgaggtcagcagttcgagaccagcctgaccaacatggtgaaaccctgactttactgaaaatagaaaaaaattagctgggcgcagtggcggacgcctgtaatcccggctactcaggaggctgaggcaggagaattgcctgaactccggaggcggaggttgcagtgagccaagatcgtgccactgcacgccagcctgggcgacggagtgagacaccatttcaaaaagaaataaaagaaaataagaacagtctaagttccttgtaatattgatgaagtagcaagagacagctttaaagctgttttcatttctttggaagattaataaaataaatttgattcataatttgaatcctgaaaaaatgtttatctcaaacatgctcttaagtagaattccaatattttcattttttgttgtttgtttctcctcctattcttttaacaaaatccatgcaaattaattaaaaatttgcaaatttgtctaaattagttaattttacaaaattcccaattgcaatgtgggttaccatatattctactaaaaatctagttctaaaatttagagttaatacactttctgaataacacataatcagtgatcaaagagaaaaagagattttgcgtcatcttaaaagtgaaatagatccctgagcttaatgttccatttcaaagcagtcaattggattttttttcatttttatagttagatattctgtgccatttcttactgtttcatagagacaatttttccagcagtttgttgggtctggagttataaagttgaataagtgacaatcaatcagtgatctcagagaatttatagggtagtaggaagggaagttgtacgagtaaataattatatgatttcacattgaaatggaaatctgtactgtggaggtcagtgggctgggtattgtcaataaccaggataaagtctgtgtggtaggagcccactacctgctttaccatctgctgctactcattctcctgcccctgtcagttcctctctctaatggccagccacttcactgcagatggggggagtctttcttatttattttgttgttactataagtaagagacttacatgttattcaggtatttgaataacattgtttattgtctcttttgaagtaataattgatctctaccaacttattctaaaattaaaacataataaatacactgttttttttttcagagatgggagaatgctcaaaaacatgtaagatgtgggtaggtttctcagcaatactattattctttacctgctgtccattagccaaagaccaattctggctgctgacagtgtagcagtccatttgccactaaagttatgtgaaacctatttttgaaaatgtaatggatttgcactttacattaaatgaagtcaaaatataaacagtgtcctagaaatgaaaagttaatcgtattaaactaatatttaaatctctgtgcaaaaattggctctttaacaaaatgtttgcagactaatgatatcttttcagttttgtaaatcaggttgttccatatctgtggaatcagaagacattgaaacatttggctcatctgattcatgacaatttgtttatataaataccgcatgtttcagggatctacaaatactaacttctctgataatttcctgaaaaaacacccccaagtgaattatgctgacattttaatctaggtccatcctgtctctgatttaaaagtccaaaatactatttatcaatttcagaattactataatctttagttgaatattgttatggtcatctgttttttatttaagtcattgtactttatttccaaaaacacagctataaacaaaactatgacaagataaaatcatttgatatgatgaaattttcattagaatatgtgtagtggaggcagtacagatgaaatactgtagtaggtgttggaaacggtgggctcattatcctgtcttttttatttttgtataggtttagaattttccctaacaaaaatgtagtttcttttgtagttggcagaaatcaaaaggagacagaaaaattatttataatgaaaatttgtctgtctggattaatgtgttttcagtagtacaatatttggtgcagccttcttgtgttgtacatgtatggactcagggtcgattcctcccctaatgtcatgcaattttgaaaatggaaatgctgtgcaagagcagatgtcaaatctgatcttctttgcatgtgtcctcaatagtttcaaggatgatatttttgttggttggatgcaagctggcagacttactgaaaaggcatttggttttaaactgttaatttctattgagatgtagatcatgtagtagtttgtgaactaatattttagacgggtgaaaacgcaattgaggttcgtgcaactgcaattgcatttgcaccaacctcataaatgaactttaaagcttaaaatcagagaaggaatagatggagttatgagggacaaacatgatactgctatgatcccgagattttcctccattgaaatctttcttttgcaggtagacattgtagaatgacctctttaaaatacacttttacctggaaacagtatcttcaatgcatcagtgtgcatttgtggactgttttctttggcatgtgttggacgcgggacaatgaggggcagggaaggcttagggagggaactaagtcttagtagaaagaagagcccatagataaggaaccctaaaacatgcccaatctatgtgcacacagcccaacccaggacaggctaaggttattaaagaggtaaaccccattgagagatgaccagcctgttgggacactcaaatgggaaaactcagcactcaggggcatgtttctgaacctgaccgctgagggagaaagcagctgacagagaaaccaaacagtctgtgggagaagtgataaggccctaggaaaagcactacataatttgcaggtgtgtgtgacctccgtgctctaatagaatcttaggtgtgatgaggttgtttaggatcagtgatttaagaggatataaagaaaaaggagaagataagaggaaaattggctgcaaatttttgcaaatatttctacaaattctaaggtactttacatactgatattttaaaatctttttctttaaaatttaattacaaattgcagtataattttctaatattttgagatctccaagaagtaaaacatctgagcagaatggtgctcatttgttgaaatttttgggcatattattttcttcttttcttccatttgttttagtcaacaattatttaatacttgtctactaaatgtcagttatatataattactaattgagaccatttagtctaggtttgacaaagatggtactagcatgcatgcagttttcctccagaaaaaaaattaattatgtaaatatcaagggtagactgaattcagttttggcaaaagatattttctctgaataaatagctatagtaattagaattatttatgaatcaagtaatatttattttatgtaacaacaaataaaattagcatttttataatcatgtttatatataaatgaataattatcttaccaacaagaggtaaagcatgaattagaaatcaaatcaacattaaacaagttataatcaacatttgacaataattaaatgaaagattgaatatatatgtgaatcaactactacatatccacctaacttcgtgtccacacataattattgctaaacatgtgatggatgaatgaatgaaagtgaatatctaaaacaaatgacccaatcttactttccattattaaataataattcaataattgaaaacagtaaagacaatcagaaaccatactaagtcaaatgtgaagtgagccgttattttttgaaatttttatttacccattatttcccattctgattaagtatatttaaatgtttatcatataagtttttttttaataaatcctttttctttaaaggaaaaattctgaacaaaggagaaaaacatagcaaaaaaaacttagaacaagagggaagaaagattcataatgaagcttgctcattctctcggatatattttgcccagggccacactaatagtgattggtgccactgcagtttagggaagggcattttagagtcaaaggcttgaacttgggattggttgtttcaggctttattctcacattagtcactaagggaccttcagtaagtcatcttatttggttctacatgtgccatcgatttcaaagggctgataatacagacataatttaaatagaattctgagattttcaaattcagatgctcaacaaatgcaaagtgatattccatggccagttaacagtgaggcaaaacagtgtttggaatctttatcttatgatttaaattgcttcagtcatgtttttctttcagtaagctccattctcagcaattcctctaataagtttatgtcttaacaaaaattcttcgtgtcaaaagcaacactttttatgctcgtttgtgtttgtgctcccctgtcccttttttatttatatatttttccaaaatcatacttcatggtaatttatgtttttttcattccaagagccgggaaaagcttctgaaaccaaacaagggactgtaaaaattgcagcacaaggtaagcaataaaacactttaaaaagcattgcctttttttaaacatctatagcactttattgacaaaagcaaaagctgtttattgcagaatagcaccatctgctgggatattgcaaaaaaaatattgttgaatgaaaatacacagttcaagtatttatttagtaattggagcaagcatgactgagagtaatgccaaatttgcagaggaactgctgaaggacccaagaactagtcttggctccaagtttcagtatttgagctttatgtatatttttaaaaataatccattgatgtgcataaagaaatacaaatacagatataaaataatgtacacttttctataattttcagtataccttgtaatttatgttacatgagaagatcagaatgttattaaagcaatattacttcataaacatcaaaactgtaaaaatggggttccagatatggctacaaaataattatcctatttttatgagccatctaagaaaattaatttcaccatttacaaatatcttcaggataactaaagtggtttcgtctcacaccatgaggattaatttgatgaaagcatgagggaagggttcaagtgttctgcctttgttatgtggcaaaactttatggaacacacttagaaaataaaagatacaatgtttactggagaagatctttatcatctcttctatgctagattatataatatcaagcaataaaggagatgcacataggtggtggtacaattttcaggggtagaaggctctcatagcagacttcttagcacatcacatgatgtatgaccgaatgtattacatctgagcaaaatttttctcttgtatttaatcttggacccagcaacatgcagaatcacccccgaaaatattggtaacatgggtttgttaaatgccatttgactcgaggatgttgtctgtgagcaaaataagctagaatgattaaaagctatgataccagtttttagttttcacattgaaaaacttgtttttctttaggaaagttctgatagggaatatagtaaatattatgaacgatagaaaggcaggacaaatattattacctttggttttttaatacatgaaaatgcaggtcagggtgagttcctcaagccaatgactaccagtttaagaaatcattgctattagtgtatatatgttttcatagaaaaccacaatcaccttaggctcattctgtttgactgagacttctgaggaccatagtgtagatgtggaactacgacttgaggcaagaattttgtgttagttacttcagcctcatgttagaggcattcatgaggaggaaaatgaagagatatctgaaaatttgattcatatttgagcttgaggccatgggctctttaaactacatttaaccattcaagatttaaactacattggacaagtcaaccttagagcttatcattttggaataaaatatttatttttgaggaaatagtaaccaagagtttcaaagtcttgttagaattatccttggaaggaaattggatgaaaagattgatgaagcacagtgaacaaggcaagagtgaggtattctgtgtatgcgtttactaaaataaaaatgacacaccaatgcagggacacatcaaagcagaactgcatatcattcgcgtctttgcaaatcctccatagatctttcttagatatgtttattttaatgccataggcatataattaaattatgcatataaataattaatatttgcaagtacttcacgtggagacaaaacttaaaattggcaataatcctatagtagactgattttttgaagtataaagtgacaaaattgatcatgatctttgtggcatggtaaaaggctagattagatctgttcatttatttatttttaacttttacaacaaaggacatattaaaaatctggctttccatacatatgtatgtatatatgttcatatttatttataactattattaagatttagcatatattctttggaattttaaaataatttaaggaaattattttaacaaagttttgagacactgaggaggcaacaaaataaatatctcactactacaggaaattccaatttggagatctaagaaatttaggtagatataaggaatggcttttgtttctattaagacatgagacaataacctcaactaggatggtggcaatgacataagaaaaaaagcacaaatgtcattaacattttgaagaactaatatctgatagagtatatcaaaagaaacaaaggaaagaataaaaatgatactgagctttggaaactgggtaattaggagatggtaattgttaaaaatattaagtttcaggggaagaaactagctgaagggaaaaaactagctgaagggaaaagatgattcattcttcagtggatgaatgttgagcaaaagtaaaataattggacaataatttttttggagccaattagaatttagatgggggatcaatctagttcacaggtattacataaaaaattgttggaagaaattgatatagacccaaattggaaaggaaggagagagatggggaattatttttttaatcagttaggtgcaatgatgaggtagacacctagtgatattaaaatgccaaagagagaacacatgccgtaatggaactcggcttaaaagatggggtatgtgcactctgtgttagtgtatttccactggcttttttcttctggattcctgaagcaaacattaagaatctcctggatactataggaagaacacagaaagagaacaacatcaacaaaactagaatgttagccattccagtctttttacaatgtgaaaaccaaaaacccagttattgagaaccatgtctactcagtaaattcaggagtcatccaatcccataacagagttaagtagattagaaccaggcaagctgaatttgaggaccagaagtaggacacgtggaacacaagctacaaaaccgttctagaaacaattgaatcccgagaccctggctttgattagcttgtgggcctggaatccagcttggtagataacatggctttccagttggcaataaataaaagccatgcaccttcaagggatccagggcaacaacagaaaccagaatcagttatgatggaataggtcaaattccttcattcaactatctccattgtcgctgaaaactggaaactgaaactatcaaatatataagaatgggaaaaaagaagatacatgtgcatacatgcatgcttgcatctctatatgcatatgtacagattgtttttcatgtattattttagaaatccaaaaatttgttgtaatttaacaagattttactaatcttgaaggaatttaagtttcagaggctttcttgtctgtagaatttgtaagaaactacagttttgctaaatgtattcacattctgagccctctttttggcgttggtcaaggcctttgtcaggttgccctttagatgtgtgtttatggttaaattgatgaagtttagcgttcagagcaattcattgaccagagctccttcgagggggtaattttatgttgtttcattttgtctttctttagagagttccccatacccatccatccaaatcatgattggatgattttgaaaattgtaaaattttttgaaggaaattcttattttcaatgtaaagaatcaacaacaaagtctgttgagtcaaactcagagacttactaaaattaaacctcatggctttgaaattcatcaggccatgtccatatcatttaattcattttcggtgttatctttgtttttatccttattatatcattggaataaacaatttcttaacttaaaaacattgtaaatataaatctgctatacattttgtgtattattagttaaaaccacatcaaaaagaaacaaatgtcccaaagtagaattaacttatttgtaaattcacttttctactacaaaagtaatagcacgtcaataacatttagaaaatagagaaaaataacctgtggtaaattaaaatacattttcttcctgtcttttattcctgatttttagagccaattctgctgcttatactctgcaaattattttaatgtttcagaggcttcattttctgctctgggctgccttttataacaaggtcaggatgaagacccaataagaggatgtacctgaaagagctttggcaattgtagcacagagcaaatgtccatagcagttgtttctaagtgttttctaagtgttgtttctaagtgatccccaacattctatcccgctgaggtgagattaccatactggaatatgcacaatctcaaattcaactaatgtggcctaagatacccctgaatgattttggctcctggataaacattacacagaaccaggggtcatattgcttggagcaattctaagcctgttgagcacctctcccaaatatttctggtaatacccataagcaacaacgtggatccagatttagattcatggtccagaattggataaatatcagcacagaggaagccagaattcaaaggtgattaaagtgttctgtacctttttctctatgtaaaagaaggcataagtttgctaaaaggagggtaggatatttattttcccttcctgaaattgggcattttatacatggttattataagtgcaaatgtagactgcagactagtatataattcctcagtagctaagcatagataatttttggaatatcacttccactttttttgattaatccagtcacagcctatattttacgaccttctagaagagattgtggtttcctcagatataaaatttaaaatctaaaatgaatttacactaagcatatacatataaatttgacttcttgtctacgtaactccatatatttttttcttcttttgctaatgcttatttctgagtttacaaatatctttatatgaagtaatattttctgcttacactcctatcatagatttggatgaattgattagtgtataggtgaccactgaatttatgaatatgtggaatacattctcatattctggggagtattctgaggaatggtcatttcatatgccttaacgctattttcattacttcagcagcagctaagaaggatgaaaagaaggaaggtatgttttatgcaaaatcccactgagccttttgtgagtacaatttaccaatatcctgagttgggttttgactgctattctgtctatattccccttggataactggatctattatgtgcatacattttgcatgaatgtgctttttctacttcacctcacacagaagggtgagctactttttgaaagtaattttaatctagtctttctcaagatataaggaataaaacatagcttctcaaaatcctagggctcctactctgttgacagttttatcaaatttcagaactatgtaaaatacagactcattctcatcggcattcaaatcaaagtcttctaagcctttggggtatataaaacagtagtcaagtttcaatttcacagctttaagctttttatctgtttttttttttctcccattgctctgcctctcggatttttttgttctattttttctggcttatataccgcttttcattttttctccttttgaaacattgtccataatcaatatgcaatattggaggagcttgggatgagctgtgcttttgtagattcaagagatccagtgtccatgaccagctaaaaaacatataaaacactccttgtaggcagcaagactgaaatattggtatcagcttcaaccccatttttttctttttcccctgacatttagtcctccagaattttcacttttcctgagctatccttttgtttaattcttcctataataattagaacaactaatcatcattcacaggatccagttctttatttgtgatctcacattgccatttgtgacctcatgttggtcttactaacttctcatgtaaactagatcaataatctccaaaatcagtggtcaaggactcctgtgggtctctgagatcttttcagtggttctataaggttaaaattatttttataaatgataggaagttttcatttgcctttctcactgtcgttctcacttgagtgagacttctagaggataaacaatggtaataatacaacacagtaaacgcccaagcagatgtgcaaatcctattgctttctcattaaaccagacattaataatagtcacaaaagtaataaaaaagtcactcatttcaccatatttttgtattgggaagtgtatcgatcataaaaatatgttatttatgttaacatttaataggtttattatttttaataaatgcataaataataccatattttaaaaatttcctcagctttaatttttttaaaatgataagcatcaatagaaagaagctacgtaaataaaagctgtttgggagttttaatagttaagattttaaaggagtcctgaggtgaaaatgaaaaactttgacaaaaataattaatttgcctctaatattacctctttccaaaatagtcaacagatttcattcaacttttcatgtcataacctatttaaaatattgagtggctttacaatgactctgtagagtacactgaatgtactctacaagtgttaaccttcaattaaagtttttaaattctttttctgaatcgtctttcctaactgcctattaagcgtacatcaaggcaaggtcatgaccaaggcctaaacaattccaacagtaaagatgcaatgatccctttttgagattgagacaatttattactttcatagcaaatgtaagagtagccagaggttccagctctccaaggttgttgccccacacaccaaaaaggatgaagcccaaacaaaaggggccagataatgcaacacaagttggggacacgtcattgctgaggagctaatccagactacagcaaaatgattttgtggtctgcagctccattccaggcagctttaggcggaatcaggaggtgatgagaagctgcctcttgacatcctcctgggagagatagggagccatgtgggaggtggtctcacagcaggtctttacaagcctcccgtctttctgtgttctgggagaatcacaaagcatcctaccaaaacttaaattaactgtggttcaaaactttacctgcatggcctgtatggatatgtgcaaagttgccaggacatcatggtgagctgttatctgatattctcacccagttcttcctttatcatcttcatctgtaccaagtcattctctattttacatatacaatgtggcatcttgcctttgttcttgctgttatcctaacagagcttatcctttttccttctatgaacattcatacattttcctgtctctgagaagttggtctgatactaccaattaaaaatactttcctgcatgtataatcttccatttgtatctctctactattatttatttcttgccaccttgtacttcatgttacttgtgtttattttcctattactctaattgacttaagccttttgtcttaagggaccatgtccaattaacttttatcccttatggaggatgagcacatttccttggtttgcacatttctgaacaaatatatattctatgcacgcaccagtaatattcaggactcaagataaatataatacccagaagaaatatgaataggtacctgttttctcacaccacaggcaaggaatgatttttttttaactactaggaggtatattccagtgagctttttaggtttgggaagttataatcagctattgactgtccttcttaggtgtgtgtaatcactagctgctccttgaattctacgagcagatccaggtagattttattcatctaaactcagattgagtgatgaattcctagcaaccggaattctaggaattccaggttatcttctgaaagatagaaatccactgagaaccagccatatgagatttattttttactataaatagagaaaatagagctgaatacatgtgagaattagtcgctagttctatggcttccagattcagacccgaagataaatcatgctgaaaaacaaagcaaaattcctagtattatagttgactaaagttgtcaatcaggcaggttccacaaaggagataggatacttcagtactagcactagtaggctatcagaaaattaacttttcccttcaatataaattggtatttcattttctttctgtttttttttttctttttttttttgagatggagtctcgctctgtcgcccaggctggagtgggcacaatctctgctcactgcgagctccacctcccgggttcatgccactctcctgcctcagtctcccgagtagttggtactacaggcggctgctaccacacccggctaatttttttgtatttttagtagagacggggtttcacagtgttagccaggatggtctcgatctcctgacctagtgatccgcactcctcagcctaccaaagtgctgggattacaggcatgagccaccgcgcccagctggtatttcattttcatctggcatcacttatgaacataataggccttacttgagacactgctacagatgagtgaatgacggattgaacagatggcaaacacatcactgcttttaaatcacaggtgctgggagcctcaatgttcttaaaagactactgcccagattattgggcagggaagtatattgaccaagtaagcctttgtaatgttttaagctgtttgagccaagaatgctgaaagggcataatgaagtttaatagcatgaatattaccagctagtattaatagctcttcagggtcagtatgtgatctttggactccaagcactatatttttaagttcctctattactttagttctacatttctgttgcactattgactccaaaagaaaatacataactttatcatgacattttgagtttcatttgcctgaccctggacttcatatcgtgttttattctttcattttaatacaattgatatctgataaaatatattattgattcttattattaggaaatagaaaggcagattaaaattttagatattctatagttacatttattatattgaactttctgtacatattccattccagtatctggtcagagaatatagggattggaaataatcttgttctaatatgccatgtttcatcttctctgtgttcccacatttcccccaaactttaggttgaatttattcctacatgaccatgttctcttcataatcctcctgtgcttttcctgttggctgtattctggactcaagagattgttcagtgaggaacacagaactgcttgggcaggcagaaatcctatttcagtatagtggagtcaaactaactgacaacttaaaacggacattgaactatcaagttcataccttaagctgttgtgttataagattcttatgtttcaagtagaagtggccactgcatattgttaatataaaactgtattatgtcatattttttctgtgtatttgaattgcttgcttatccaattaaaataattattcaggaagaaaatgaataggaaaatgtttgcaaagcacatatgtttcagatagcaaatgtagcctactaatttaaaattcctgatgacaaactaaatagcaagaatatttttcacattggttttcagagctggggttaattaagaaaaatctattctaaaattattttcattgtagtgtgctggacacaacagtgtttaacaaatgatgactaagcaaatgttttgtctcaggaatcgattattttttaaaatcaagagttttttccccttacaaataaaacatattcgtgttacagaaaaatttgaaattcagaaagagaggtaataaaatcttgcctaattatttaatctgtccacaactaccattagtatgttggcatattttcttctaatctttcttcatacacactcacatgcacacataaagtcattttatattatgtttttatttttattttgcattatttaatttatcttatttagttaatattttccacattgtggcataattagcaaaacatcatttgaataattgtgtatttttctattgtatgaatataccacaaattcatcaacactctcttattgttcagagggtagtgtttaatatgcccattactgagagacacaaagcaatatcctgagaaaagcatttccctaaatatttatttttatgataatattgctttttttctctatggatttctagaaatggaattaccacatcaaaaagcatgttaatttttatgattttctggattcttttcttagtttgtttcctaaaatatgtttctagcttatacatctacggaagtgggacattaccttcaccacaatgttactggcactgattattattgttacataaaacaattttgttgaccatctaactgccttttgtgaagagacaatgagtccattgtcatatccaaacattttagttccctttcttcatcatggaagtgaagtcgtgataccaccacacctctgtaaggcacagaaatccattaacttgcaaactattagtgaatgtctactgttctaggttccaagccagataattataagccagaaaacaatttagctaccttttgcaggtatcaattcatagttcattattatgattctaatttcagtaatagagaatttaaaagttcttacagaaacagtaaaaggacaaagaagattaaaaaataaaatattctaagcaaaaattcaagctcaggtgcttcaatcttaaaacaaatgagcttaaaaacctcttgttttcattttcaagtggtgggagcagaaagtttcatggcctaaataatagaaaataataaatttatcagatctaggctgaatgcccgtctactataaatgaaatcgatgtcttttgaccacgaaatagacattactacataacagttataaatatagtgatgtattcatcagtaacccatgagtcaacagtaatctatttcttttccattaccataagaatgtctgaatatctatattggaagtgtattgattattcaaagacagtgcaacataattcacctggactgacttagattgaacaaatgaaagtttcaagttaacttcatgaactcctaagcatctttatggaaacagagcatatatttactcagtttgatgttctattaacaggttactaacttacataggcaaaacaaaatttctttataaattatatgtgggtatattttcctttatatttttcaatgttttatattctttataaaatattattaatataagatattttataaagagtttctcactcctgcttcactctaatacttattcccacaaaacagaacagtttctaagtctcatattctagaaatatacaaatgatcaatttgttgaataatcaattttatttgattgtttatagaaatttgttgtgagctgatcagctgttgatttattgtatctgttttattaataatttatctttgtgttttcagattccaagaaaacaaaaaaacctgcagaaggtactggacatatttctttttttctgccttatgtttgatgaaccatgaaacagcataccttcttaaaggattgatgtagaagaaagaattatgtgtgggatagaggagaagaaaaaatgattgagattgagagagagagagagagagagagagagagagagcgccaaatctattctgacaatactgctatgagaagtatttcgcagtaatggaaataaatactgcatatcctttcacagtaattgtttccaaagaaatgtttacttaacaagaaattgaaaaattttcagtatcaaacatttattttactagaaagcacacactaaattactttttgatagactggcatcaattaggaactgatttcttcctttcggtcttgaataattcatttggcaagtatacctgtgcctcctagacttgttcacatgtgtttttatgtgtttaagagactattacatatcaggtgtaaataatttaaaatggttaaacagtataatcctgggttaatttattgtcaaataatatttgccaatcaaattatggaagcacctacagtaattaacaatacctcagagcctcactgtgaaatttcacctcattgtgaaatttaaggagagaaaattggaaggaggggtgggaaaaattacagtctaatcaatatgtagggtagtacgttttatctttaaagttttaagagcaatgattttgtttgtatttctttcagtagaacaacccaagggaaaaagtaaggaaatgcatgcagtgtatttgtgtacttttttttttactactattatttgcctgctgctgtatttagacctgcaattttgaatccgcttttcctatgttttatgcatgtgaactctgttgttttttgtccaagtgaaaaaatacacagtctgggggttagagtggactgagaagcatagtaatcatttttagaactctttctcaagctcatgcaatcatctaacaatactcttgacgggcttgtaatcaaaagtaaaactgcattccattaacccaaactgacttatgtttttgtaaatttagtcctaatctggttagttgtcagtcctttgaaaattgactagaagttcttttacaggctagttttacaacttttttcctatctttctttttgtaatctgtagatattttggcatgcccatgtgatatatgacatttttcccataacataatttcccccctacactcactatgagctctgtctaatagggttgctattcagcctcatccactgttgctttaacactattaagactgtgtgctaacaattcagtcaagctcaataacttaatgtatgtctttcacaaatataggttctcctctgaagaaaataagatatatttaacaaaagaaagcaaaaaaaaaaaaaaacccttgaacttattcaatacactattaaaaattagcacattaccagcaatatagattttaagattctagtgatatcaaaaatgttttaaaatatataccaattaaaatatatttatgtgttttggccctacaaaaagcaaggatgctgagacattcaacgttgtaaaaatgctctaaaatgccctgtggagacactcgtgaaattatactacaactcagccagggggagcaatccatctacagagagttctctcagttccagatttacgtgtgtgcagagctactgatgagtactggcacagagatacagaaagcactctataaacgctgcaccagcaggaaaatggagaacaactggagattcgaaaaatagtattaaagtacatatagagatagccttaaggccctttattacagtttataagatttaaaagttcctgcacacactgcagctccttggcaatcttcagggcactgatgcacttaataaataaacatgccttttcacgcattcattcacaacccaactgtttccctccttgagaaggtcctcagattgtgactcgggcagcaataaggagaagaaatagttttcttcaaaacacctatcagttcttttcaaattcactcatttgctatggtttatcatctagacttgcttttattattgttagtgttgtatctttgaatttctttgatttggattttttatcttgagggttgctttactcgatggtacaccccaattttatattttattttgcttctacttttctaataatcacaacttaaaggttgttcacttttcagatatttttaattatggttaagggaaacaggatgaaaagtacaagagaccatcctgtacattttgtaaatgtttgtgagctataatttttttcaaaataaaaagtaaaagaaagagacctcaaaaatcaaccataaacatgagtttgcagtccctgtagagttaaagggtaaatcaatgtatatttactaaggtaattcaataattacaccatgagctatcctatataatgaacaaattagcacagctatttttcagctttctgataagattgaggggactttattttaacttttaatcttatgtatagctggtattcgattctgatgcatgtccaaatctgcttccagtacttttttgactgttatcactgtttgtgactgtcatcacaaatttcttggaaatgttttataattagagcttcagttaagcaataaattaaacaatgtatttaattgctcttcatttgccagacaacatttgataatgttctcattttgtttaattttagctaaatcgtcatagcttcttctttttgacctgcaacacttggccaagccatttgtttcatttttttgttttgctgcttaaaggctgtcttaaaagaggataagttgctcattataccacacttatttaattagaagcctgactaacaaaattgtatacttgggaaattgatgtgatgaccgtagcattctatgacactctatatttttaaaatatagtttgtagagttctttcagtatgaacatattctagtcttcaaaatctattcattaaataaaactttaagaatctttccattcttctttaaaatatcagataaaaatgtgggtatgttaaagtatttcttgaaaatcttcttttacattaatttgacaaggttgtcaaggcaaaataaataagaatagaaatgtagatgatagcacttcatgtaaaattagtgcttgcaattcttataaaattagtacttattataatgtaaatgtcagcttaatcttgagaacaaaataatgctttgtctcatacaatattgacaaaagtagattcctgaaaagaaacgctatataaagaggactccaaaaggagcatttgtcctaaaagcaaggcaaatgttttaccctgaaacttctttttctattttagtgtcttaaatatgcctcacaaagcctttgtcttagcttaacagctatttcttccatgtaagaagattcttagaagaggcagtccacgtgaaatgtgctaatcttcatctttctgagaattattttaaaataactgcaataagctgcggtgctgtggctcatgcctgtaatcctagcactttgagaggctgaggtgggtggacctcttgagcccagaagtttgagaccagcctgggcaacatggtgagactttgtctccacacacacacacacacacacacacacacacacacacacacacacactacaaatctggctacacatggtggtgtgtgcctgtaatcccagctacctgggaggccgaggttggaggatcaattaagcccaggaagtggaggctgcagtgaactagaattataacactgcactacaacttgggcaacagaacaagaccctgtctcagaaaaactaagcaatttcttaaaaagctgtaataattatcttttgtacttactattttgactcaaatttatttcatattgatctaatataatagcaaatttaatttttttcaccctttatggattctattttatttttctggtttatcatctgtaaaaaattcaaattcctctaatattcagaatattttgatgctgccccataaggaaactcccaagataaatggaaaaaagaattattttaagtatataatcttagcctttttatgtaagccattattagttgctgcaatctggcatcagcacatgcatgtttctttgtgttaaaacaattaagttgggattcataaactttagaataataacgataataataataacaataataatatgtttcagaacaggaaaagaaagaaaaacatgtggaaccaggtaactgtttttaaattcctctgttctcacaatttcataatattatttgatttgcaattgaatactgaattacaattgaatgacatagaatgctgatttttttttctttcctttttgatacagcaaagtcaccaaagaaagaacactcaggtgagtaagaccactgttgctggattccgaatactcatgtccagtgtttattaatgctgtagcctcaaacaggtggtaaggcagcgccagtaaagggtggggaatgcttccatctcacagtgttttttccaagttcttgacatggacataacatcaatgcagttttagaaaatgaaagccaaatgttacactcttgctcctcaatgtgtgttctgtgaactagcagcatcagaatcacccaaaatgttattagaaatgaaggatttttggccccactcaagacctactgaatcagagtctgcaacttcacaagaccctcagtgaattcatctgtgcagtatttgcgaagtactctttcacagtttagtgtaaaagcaaaacaaaacaagaacaaaacactttttgtaaatgcattatacatcgctttgtttttaaaatatggaataatcacttccagcaaatattatctccttattcataatcttacttaataacatttcctgagtgctcaggggagttgcagtgagagcaaaagtagattttgcccaaaatatatttacattctgatgagaaaaaaactgattgagagtcaaacaactagacaagacaaataaacctatcaacaaaaactaaaagtgcagttgctgtggataccaaattattgtcttgaagttttctagcatttaacctgcccaattaatcatttcaaatgaaaatttctgaaaccatttatatttccctcatttaaaactatcacctcttgattttgcctggctaactcctactgaaggagcttcactgagttatttagtattgtgtgtgtgtgtgtgtatgggtgatcataaccttatgtaatacctatcagtcattcttcccatttcattttatttaaatggaaatagcatctgctcaatcttatttaaaaaaccacgcaaaggggcccaactgtagtctcaccctaccacaaaccacggaaaactacaggtttgaatccacatttattattcatttttaaagattataaaatatcctgagacagcccaaatctgttttaagtgtctgtccaattacttcccatagtatcattttcttacttttataatatttcatatgctgttaaaatcgtattatcttttcccttttctaccttatatagtcagaaattagaagaagccgactgttttttctctttattcccagagcacctattgtaatgccaggacacattgggcgcttgatgatggcttattgagtgaaggaagaaacaccaaatagaacaattacatttttataaatttaaaaacagaagactttaaaataatttacaagatgcaataattgcacatttcagcatttcatattttcacagtatttgacctttgggaagaaatgttttgtctactttacagagaacaccctgttggttcagagttgcatttcctcaagcataacacatcttctcacttacgcatgtaagaagaacctaagatagtgtgtgcattatagaaagacagagagacatacagaatgactattggtgtagccagttttaaaagttttaatagttaaatattactgtctaatattgaacctgacaaaatacaataaattgcttgaaattattatctatttttttcagtgtgtgattacaatgcagcaacttagcagtaactagctgtagttcaaaaattaaaaccatcaatttgaataatttatgaagtgaactcattcttttcacactattttatagactttgaggaaaatgcatttgcctgtatataaaaaaatgagatccttggataattaaaaatggagagcaagatgattgatttgtaaatgaatattctgtgttgggagaagtatgaataacaaacaataaaattctataattcatggaatatatttggattatatcagaaaaatggcacagtattatattttccttttctcagatcttatttttctttagcttccaatattatacacacaatctttaaacaattaagataaccttacaattattttggaaagagataagcagatttgtaattactgttgaccttattatttcttgtcattaacagttccaagtgacaaacaagtaaaagcaagtatgttgaacaaaatttttaaagaagagcatatttgggcagcttactcatttgaattttctgctatagactatgctaatgctaattttgagaatggcttaccagctttttggtatgattatttgttgtgctgaatatgcaatattacttatccctgtcttttccgtgaattcattcttattaaaatttatctatagagctttcatttgttaatttggccacatcataacccctttgtgaagtgttacatttttatttctcattttgcagtataataagtgaactcttcagtacacatcagactgaattatcctaaagattaatcagttgatcaaaccagtaggcaacctaatttgtctactatgaatatcctgtctctaatgaaaggtagcccctcaacattttcttaaccattgctcttggaatgtgacaattcccttttaaggtttctattcttggattatgaagtattaactgataaccataacatactgtggcatttgcagcaatggtaactttgacaatatgcttaggaaaaaatgctgagaaattgttgatatttcttagtttgatgaagtaactgactgttattaataaaagttattttaagcataatggaaaatattttgccttaggaagaaatacataagctttgtatataggatttaagtcagtcctcagttctatgcgtgacatcaatgtgcttatatattttttgagaggttagaggtaaacaagtactggtgatgctactaatacataaaacaaatgcctgttatttagtgctgaggtttttttttgtttgtttttttgtttttgtttttgttttttttgatggagtctttctctgtcaccaggctggagtgcagcggcgtgatcttggctcactgcacctccgcctcctgggttcaagtgattctcctgcctaagcctcccaagtagtttttgagacatattatgtcagtagatacatcagataaaaattgaaaaatatattgagtagcttgataggaatgtctttttttaaaaaaagttacagtttgaagtatacacatagacattgagaactttacaagagaggtttaacatgaatctaaaattccatttatatttccatgaaaatttttagttaaatgtaaagctgattggaactctatattatggagtctttgctatgctgatacttagtctgtagaaatgcttaatcaagaaaatatatcaaacaaatctgataattttgtagcactgggagagagctttagattgaagattgctctgaaaatgaaaatcttcttcctagaaaaatgtgacatatagataaaaatattcatttgcaataaaaaaaaatctgtaagttctgctatctatgaaacagactatccaatcaggttttgaagagatcagcatattttgcaggaaattagcaaattagcttgccaaatcatcttaaacacaatataagtttcataagagttaatattctactccctatatggttgagagatttgcacttgacatggccattatccttcaacacaaaaattaatttgatataattcacaaactgcttaaattatctgataacaaggtgaccagccattttcccaactaaaaatgtattttggcattgaagtcatacagcaggagaatttttactcagctgctacatacagcaggctacttataaagttaatgcctaaaatgaaaattacatatcattatagataccattgaaaagcctttaaattatccatatagtatggtgcacatagttttctgtatataacctgcacatttgagatatgattttacagtatgttaagttgtgaggtcaaatgagaatgatagagatagataatttaacataaactatgtatttatgtgatgcaattccataatgttgaatttaaagggatagatgagattgacagggttaaagtcagtccaagaaaaaagtaaaaggggatttgtcattaagactggattaaaggccataactggaaagtggattgagtttgtagtatgggattgtttactctaggtcctgaggaaacacccgaaatcactgtaggaaaaatactggaggacatggacaagcttgggacgtacatcaccttcagaatagagcatatattagtcccttttcatgctgctgataaagacatatcccacactgggcaatttaccaaagaaagaggtttaatgaactgacagccccacatggccagggaggcctcacaataatagtgtaaggcaaggaggagcaagtcacatcttacatggatggttgcaggcaaaaagagagcttgtgtgagagaactcccatttttaaaaccatcagctcttgtgagacttattcactatcacgagaacagcatagggaagacttgcccccatgattcaattacctcccactgggtcccttccacaacgtgtgggaattgaagatgagattcaggtggggacacagccaaaccatatcatagagtctcatagtaacatgagcttcaagaaaatgaaaacctttcagattactggtgcgatgctaaagaagagcactccatgcttccacatcgaaagttatgtgtcagggtgtggtgtggatgaagaaagtgtaccttgggctaggcagggatgctgaaactagactgacaatttctgcaagtcagcaaagactcctttatttatcatagtgtgagcaaaaatacctcaacacacccacctcccctacctacattcccctgcatgtgcctctccacacattggatagcaacacagaggttgacaataaaattagtcatttccaagcatggagaggacacaacaagtagatgtgtagactgtagagtgcttcatggctttaacactgtatatatggtgaatcttcaagaagaaatatagtagacattgtttaccaaatatatgtgaccacatcacccctttctctttcaatgatcacatcaaggatcactatttttcagaaccttgggtagcactgtcccaggtcactttattccacctcaaggaccttagggctgggatcatgtattccatatgcatggtcagccagccagtagtcagtttgaattttgaggaaaatagccaccaaagcccaggataaagccaaaatatagtcatttttagctctggatctaataatcaggcatttttcaccccttgattttagcattgcacagattgggtgttatgttcagccaccgagcctgactatatttatctccttaaccacacttcagtgcctaaatgtgagtcagatatctatcatctaatctactaatatatgtcaagatcatttaggagacatctgtatgcagaatttaaaagtaaagtcccattgaatttattcagctatgtatgttagaagaatatttggagacaactgctcttaataaaattgcatggttttttttttgactcagtttaaatactctggcatggaaatggcagaagtctccgggaagatctataggcctgaaccagcatgcttgatataaaatgagttgtctctagaccacacactgcatgccaaatataatcttggttgatctatgtatgatcttagtcagttagaacagtcttggtgtactatattgtcccagaataattattacttgcacctcttttcacttgctcgattttgtataatatattatataattactaatagtatcacagctggtgctgccagaatatattcaaaacagcactcatacagcactagagtgatgattttatgaggtttaagtaccaggaaaggtaagatgtgagagacctgggactgccttaggtggtagggtaaggcatgcttcttgtttaaaactatgtgtaaagatgaggttggtgtcctgagtgccagccccaaactgaaaatgccatggttcagagtccaagaatgttcatcaaggttgacacaaagagctagactgatgaatactgacagaagtaaaatctaggttcagttaagacatgaagaggtaggggagaaagggacaggatttcaaatgggaaaccagaaataaattttagtatttaaaagtgacataatgaacacagcaacatggcactataaagcatggctattgagatcaggactatgtgtcctaagtgttagtaataaagcagtccccagatattgtattataaagggtagaatggtattggtgtagatataaacaaatttcccaataggacggaaaaaaagagacttaaaatacatcacacttgagcaaaaatctgacataagaaaaagcagccatttcagaaagtcagagtgtggatagattatttttaaatgttgctgatatagctggtattcaatacaaaaatataatttattcttatttcatacagttctaaaatatcagttccaaatggttcaagaacttaaatactaaaggcaaaacatggcatagtttcttttaacctaggaaaatatacagtttcttgaaatatgggaggatttgaaaaactagatgttcaaaattctagtcatacatttaatagctgacattttattgtattaaaattatgatcttcaatttatcaataaatgcaataaagaaagataatggacaagccacaaacttgtaaaaatacttgtaatatatttaaatagcaagagattaatagcaaaaaatagatgaacaactccaaaaattaaaaaaaaaaaagacaaagaccttgatagacaatgggcagaaaaaaaaatgggcactagatataagactgcattaaaaaaagaaaaaatgcaaatgttctataaacgtatcaaaagatgttcaacctctaagtaataacggaattgtacttaaaagtacaagatagtattttacatgagactaaattttcaaaattagggaataggcttattctggtgatggtagtgatacggagcaaaagaaactctcacgtatgctgctgatgtgaatgcagaatttagggagaaaaatgtgtcatttatctagggtacatgcctagcaatttcacttctatgaaaattattgcacatgtgcaaaaggagacacatgtgcaggaatgttcatagcagaattatttagaaaacacaaaactggttgtgacctagtgtccactggcaggagaataaatccatagtttgtagaccaaacattggaatgctagacagcagttaaagttaatcaactacagctactcatatcaacatagttatatctcaaaaaatcacacaaattaaataatacagtttaatttatataacactaaatattataatgtaatttaatttatataaaattatcttacctttatttagagacaaatacatgtaataaaaacccatatagaaaaataaggaaataattattacaaaatatagaacaactgtaactttgagatagagaagcgtgcagtgctagtaggaaaagtaagaagtttcaaaggccttggcgatattctatttcttaggtgtgcaggaggttacaaaggtgaacattctttattgctattcattagaatgtgcacaaatgttatatgccttctgtttatatgatatctttcacaataaaacaggtttgaaaaacagagagtgagaggatagaagtggtgacattgagtgtagcagctctatgcagagagatgaggtagctgaaaatgtcatatagaattgaaggatgtggttgtctgtgtctctaaagagtgacatgagacattgtgaaagcatcagtgaaggagaaaactgatgagggagcagatcgaagcaatactggcaagaacaaaggccttgacttggcaaaaggagatgggatccagaaaaaaatatggaaggattggtactaaaaaggggcaggaactgatcaccttttggaactggaaagaaaaatggatgagtatgtgctggtgtggtagtggaacagtgatgtaatttagtctgcccctattttctctatgaatttctcaacagcagcttacttttatgttgtaggatgtttaaggagggaagagaatattttcaacttttgttaagagtatgagaaagcaactttattgggtctgtggtaatattactggccagtgctaagtgatctcataaatgtgatccacatttgaagtgaggtctgctgcagggtgggggtcttccttcagcttcgatgactgctcaggtggtaggcataaagtacatttggtgttttggcagacatagtgggttgattcgtgcctcccaccaaaagatatgttgaagctctaccctggtacctatgaatgtgaccgattttgaaatagggtcttcatagatatactcaagttaagatgaggtcatgctggattagggtgggccctcaatctgatgactggtatccttaaaagaagaggaaatttgggacacacagatgcatacagaagactgccacatgaacataaaagcagaaattgcagcaacgcagcttcaagccaaggaatgccaagggttcctggcaactagcagactctaggaggaggcaaggaaggattcttcccaagatcctttagagggagatttctagggtcctgccaatgcctgaattttggacttccagcctctagaactgtggaaaaatgtatttgttttgtatttatctacccaatagttttaaggcagtcctaggaaattaatacagcagatgactataacaacagaaaatacgtgagtgatttaactatggctcatttatgcataagcttggtaagaagtaaagtgaggatatgaggaaaatcttgaaaaatgagaaagtggcaagaacaaggaatggaagtattaatgggatcagataccgtataatgggagttcttgtgtaagtgagctctaaagagaaaaaaatggtgccaaagaatataatttttaaaatcaaaattctggcagtaaaggaaaattctgagggtacaaatatagttggaaattgccagagaagtggagtttctagttttctgaattgaggaggccaaggaggtcagagatcatgtaattgtatgagttgtgtatatcagtgactcccaaccctggcaaaatattagagtatcctggaaatcttaaaaatataccaatactcagggctcacgccagactcattaacttagaatctcaaagctctgttgcccactccagatatctgaatatcataggcttagaaaaactccccagcttattctaaggtgcagacagggttaagaatgattcttaataatattcatagtagtagtagagcagatgataactgtgtgcaaaaatagtcaatgaatgtcaggaaaggccacaagactggttgatgacaacaatgaagaggagtagagagtggtgcaacctgatagcatgtacttcaaaagaactggggtttggaggaagcaaggagataatctatgaagagtaatgagaaacaaagaggatataaatatgcattacttctatacaccttggtatgtggaggatggaaaaacaagcattctccattttagaagactaccatcaggaggggatacagtggccttagtgagctaggatttgattaaaggaagaaagtaaaatgaacattctgagaagaggctgaagatacaggagtgaatgctgctgatggacagaggacacagaggaagggatttggaagtatgtcagcttctaggagaaatacagagccatatggactctgttttctgctagaaggctgaaactcatggtagtaactgaggtaagtagggagggggactcacagtaggaatagtcttgactgattcataggggaaatttggttatcagtttccaaagtgcggtccaaatcaggagcctaagcatcccctgggaactggttagaaatgcaggttctcagaatatgcctccgacatactgaatcagaccttttgcgctcagcatctgtttcaatagccctccagcgtgaacctgatgcatgcttaagtttaagagccattgatctaaagtctttacctggaaggtataaaacagccaggagtctgttcagtcttgaagcccagggtattgagatagctcgaagaagaggttatgtatgtcacttcttgcctgggtttaaattgtgactcttggggcatctatcattgtggaattaaaacctgaaagtgacatgaagatctccttctgatgtctgatgtctttcaaaagccgggttttgtggcacagagaggatgaggggtgtaaaggctcgccttgtttgatttggttgttctcagagcatcagtgctgagcatatatgggtgaagggtgatacaaacaaataccaataagaataaaaataagaatatatatgaccaaggggaacaacctcaactaatcaaaagttataaaatgaggaaataagacttcgtgaaaattcacgagcttattattattattattattattttattttcctgtggactagagaaaactttgactttaactagctttgatttgtgatccaatactctgtcctagccccaacagttcagattatgacttcagggcagctctcctgtcttccactctaagtatttagagaaaccaaaaggccactttttgtcattttattctctttgtctctcttgaagaaacattcaaatgaaattttctatgatattacagctaatcttttacagtgtaaaactaattcattgaggtcaaatattgtttgcttgcaatcagtattaaacaacttttagcagactcaaccatgattaaaagctaaacaaagaagcccttttaaatgctcttctctataattcatatgtaacttaaaatttgtagactatggccgggcgtggtggctcatgcctgtaatcccagcactttgggaggctgaggcgggcggatcacctgaggtcaggagttcaagaccagcctggccaacatggtgaaaccccgtctctactaaaaatacaaaaattagctgggcatggtggcgggcggttgtagtcccagctactcgggaggctggggcaggggaattgcttgaacctgggagggagaggttgcagtgagtcgagattgcgccactgcattccagcctgggcaacaagagccaatctccgtttaaaaaaaaaaattgtagactaataaattagtatcccattgtattgaatgtggccttaattttaagaactattgatctaaagtctatggaataggccaccttcttttatggtcactacctacatttttaagataatagagttgcaccttggaagagaatttctttattgctatttaaggaagtttattaattgaaaaaatcatataagcactttgtattttggctttctctacagcttgctttgctctcatgtgcaacatacattttatctttaattttattctcaatagtataagatgtgaatttggcatcactaatatccacttctcattcctttaatatctgaacttgcagaaactgaacgagccaaagaggagattggtgcggtttcaattaaaaaaggtaaatgcagcttaaagataaagatgtcataactataagttatttctgctaaggtttctaacaatgtattgttttgtgcttagaaaagagctctatttattgattttactagttcgttgatatagaaacaaacctattttgcacaagattttatcattactgttctaaagcctatagttttattcctttaggaccataaattaaagctagttatgctagtcaaattgcaagttaattttgaaaaattatagaaatgtaactgtttaaactccataggatccccatcatctggagagcattctagtgcaacatactgccttaagagattaggaatcgaacaaatgaaactttaactaaaagtactcacatgaacaagattcactttgttcaagaatagtataaaattatgaaatgtattaggtgagatgctgacttggagacattttgctttaagaaatatattgggaagtctgaaatgaagtcaataatgtagccaatgtctttggaagtatatcaagagacaatttaataagcctatcctcaacatacactgatgcatacacacacgcaaacctgcacacatacccttacacacatactccactaaaaccacttctcctaaaagactaatttattgcacatgctttataaagaaaacatataacaggattgtaggtagatagaaaatatatatgacacatattcacatactcaatcccaaacaatgtatacatatgaatataaatgaatacaggaatgtaacttaatatctaatataaatttatgtttattgatacagtataaattaatgttagctactctataaattaatttattgattattttatatatacatatatctctaagggaaagcaacaaaaattagtgaattctttaagaaaaatatgaactgtatttgcaggcaataattagaagcaattaagttattgaaattaatagatgctctctttcaaatacagctctattattctgaatttacagtagatagggctaaaatctatttcctagtcatttctttttcttataatctaatatttgtgatgtcagtttttagctaggtgatcatgatacatctttcattgacatcatttgtactataaatggcagagtaattcatttatcagaagttattgttaatgcggtgtcatattctggaattgacattgctcattagtattaagtgaaatgtgggttaaacttgtttgcttcaaaatgagtaattgtattaacaagaaaaaactgagtcttaatatagtgtcagagaaaatcactaacatagacatagatacagagttcatgggcccagtaagtggacttaaggccaaggcactgatttatgttgaaaggacaaaagtgtggccaacttatgttcaaaaattagacaaagctaaaagcaacaagatgtccaaatagcagaagataggtttcttttggagtgagattttatttttattattttttaattttttgagacagtctttctctgtcaccaggctggagtgcagtggcacgatctcggctcactgcaacctccgcctcccaggttcaagcaattctcaagcaattctcttgcctcagcttcctgagtagctgggactacaggcacgcaccatcacgcccagctaatttttgtatttttagtacagacagggtttcaccatgttggccagggtggtctcaatctcttgacgttgtgatctgcccgcctcagcctctcaaagtgttggaattacaggcgtgagccaccacgcccgactggaattagattttatatacagagccttagtgaatccatgtttgtggaagacagtcttgagacacagttaagaagcaaaggttgaactcctggtagctgatccatagactctgcgctctgcatcaatgggagcctggatattgttagaagaaaaccttggccaaattatatttaacacagtttaactgagcaaaaaatgattcatgaattgggcagcttcctgagccagagtaggctcagagaaacttcagcaaagcctcgtggtggaaggatttatggacagaacaaggaacatgacatacagaaaaagaaagtgagatacagaaacagctagattggttacagcttgacctttgcctcttttggacacagtttgaacagctggttccctttggttggccaaaatttggtaattagcacaagagtagattacagcctgtttctacctccatttgggttcactatgtacagagaaacctctacgccaaactcaaaatatgtaaggaggcaacttcaggctaggcttgattgaacagtatttagggtagaaatataagctcacatagtatggggttgaatcaggacaaattggagttagcacatagacagaattgaaattgaaccatcaattagtgaactcaccagagtcctcaactaagaatggtcactgagtttatagagtatggccaaacattttggttggggttacgtagacttgcttgtcaggcttagagggaagtgaaaggaaataaattatctatctattcgcatgcattattgacatcaactactttgcttctagttggtcatagatctcataccccaattctcaatttaaatataattctacatattgagtttatttgcaactacagcacgaacagaaataagtgtccttttcaaagcaaccatagctgttttgaaactcatgaagggttttaccaatttgacaaattacaaacaaaaatcaaaggatacttttctcatttgtcaagtaacttgttcatctcctacctctcactgacaatcagccgtgcatgaaaaaatatattgttctcatcatgtatttactacccaatccccaaattccacaatacttagcatactttacaactggtccacctctagcctttcacatgtgagtagaataagcaagtatttttttttgtttttaagatattacaaaattgttctaaattgaggcttaaactaggaactgtgtgcaatgttaagtggaaattactaattttgtaattgttttaaagtttttgaagatgaataataatttaacattttaaggtgttcactgtaatgtgtcaatttatctgcagcataaattgtcttatcttaagcctacttttaagtcatattttatttggagatacatagtatttagtcattaatatgatagcagcttgctaatttatatctgattttcaccttgcagttttctaatcattttcatatttactcaccatatatttgtggattatatattatatgaaaaatcgagaaaaattttaaatgttaatattgttcttgagcaatttaaaatactaaaaataggtgaaactttattaagtcactaagctggcctgaagttttactgtcaatgaaagttttttgtattaccatatttcaaggttgaaagccatcagggtagagatataaatacaggtaaagttctacggaagtttgaaaattaatcttacctggggaaaagacaatgtttacggcagaagatgactttagagttaagccttaaataagagatggggttttgctatgtaaatgagttagaaaaaaatatcctgggcatagatttcagagcaaggcaaagtgatacaaatttgtagtatgtatatgaggaacagtaattatctcaagaccattgtaggaattaatataaactgggctaataatgccataaaaggccttgttttaaaattggactttattccatgggcaattagggaggtgatgaaaaattgtaagtatataaataacactcaaacatatgctttagggagagtaactaataaaggaaaattttgaaataggcagattagaaagattctcaacaatgtagtgaaaagtgttaggacctggactagggcattagttatgagattggaagagagagagattatgttagcactaataaagaagtatattcagtggaatttcacaactgatgataagctttgggagggaagaaaagaaaaataatttaatgacaatagcgttcttcagactggctgccagaagaatattgttaatattcttaataacaatgaaaaagaaaagctaaagactttggagagaaaaggcaagattaattttacataaatttaagtcaaagtgctagtagcacatgaaggtagcatcacataggtggttctagaaataaaactagagctccagacaatgataggctggagatgtatacattggtgccctttgcatggaggtaattgagcttgtctggtcatgatgagataaggtaacatttacatttgcatttgtttggggaaagaacaaggaaaatcaaagataaaagcagactaaaataacttcagtaactgcagaaaaaaaaacttccaataggaaggtgatggtcatgggatttgtcaggtacataatatattaataattttcaatacagaattttcaggggagtgacatccaaaaaccctaaagggtgacaaattgaatgaggaaagagggagtgaagtatatgagaaatgatgatgaagatagttggctgggaataaaaaatagtatagtagctggtgtttttatttaacccatatccatctctctctctctctttttttttattatactttaagttctggggtacatgtgcaaaacgtgttttgttacatgggtatacacatgccatggtggtttgctgaacccatcaacccatcatctacattaggtatttctcctaatgctatccctccctttgccccccacccaccgacaggccccagtgtgtgatgttcccctccctgttctcattgttccactcccacttatgtgtgagaacatgcaatgttggttttctgttcttgtgttagtttgctgagaatgatggtttccactttcatccatgtccctgcaaaggacatgaactcatcgtttttttatggctgcatagtattctatggtgttcaaccattgtggaagacagtgtggcaattcctcaaggatctagaaccagaaatactgtttgacacggcaatcctattactgggtatatatacctaaaggattataaatcattctactataaagacacatgcacacgtatgtttattgcggcactattcacaatagcaaagacttggaaccaacccaaatgcccatcaatgatagactggataaagaaaatgtggcacatatccatctatcttttaatctcagaggtagtgtttctccttctcttcaggaccagtttctccagtttttccttcaaatcagtcatccataccattttgtggcgtcctcctctttcttgttactggcattgttcctcatcttggaaatgttttttctctgattaaaattacttcttttccttgatttacacctctctctctctccctgtctctctctctctctctctctccgtctctctctctctctttctctctgtctctctaccactttatctccttcccatgtcagccagctttctgaatgctggaatcctagcactgcctctggccttccacaaagactaagctcctgtccctaccatgccactgaagctccagccaatgctgatgacatcatcattgctaagccaacagaatgcttccatccttatgttactagatttctcagttgcatttatcactttgtctcttctccaaacttctctgttgttgggctaccatgacaatatagtcccctggttctctccatatgactggcctttatttctggcttctttgtgttttttctttcatctgttgcctcgtgattgttggtgttcctcataattcattattaatcctctgaacttctcattctgtaccatttccttttgagatatatctgctctcaaagttgaaactctgccctatatcatgaagttttttcaatcctgtgtccccatctcagaattttttaatgaatttcaggcttgtatgttcaactgcccaataaatatcttcaaattcagcttcacaatagctaatgcatgctgggcttaatacctaggtgataggttgataaggtacagcaaaccaccatggcacacgtttacctatgtaacaaacctgcgcttcctgcacttgtaccccggaacttaaaataataaaaaataaattaaaaaaaaattccccttcacggccaggcgcagtggctcatggctgtaatcccagcactttgggaggccgagatgggtggatcatgaggtcaggagatcgagaccatcctggctaacacggtgaaatcccgtctctactaaaaatacgaaaaattagccaggcgtggtggcaggtgcctgtaatcccagctactcgggaggctgaggcaggagaatggcgtgaacccaggaggcggagcttgcggtgagccgagatccggccactgcactccagcctgggcgacagagcgaggctctgtctcaaacaaacaaacaaacaaacaaacaaatccccttcacattcaatctttcttaacctaaagtcctcattttctctttccaacttactgtttctgtttcttgagcatattttctcttatttgtagccattactgccatactaattcaagccttcattgtcttctaccagaaccactgaaataacctcatgctgccctcatgtttttatttttattccactaatattcatctagtagaacatcccaatggccacaataatttagtaagaccacaaaactgaataagccacttaaaatttaatattctgttcccctgttttccataagataaaaatccaagcttgttaaaatggcatatagagtgccccaagaactggctcctatatccttttccaacttcatctttagacatgccttgttttctatgctacaacaatcctataatgctatgttcataattccgactatgttagaagactgtaggaagattggagcaggaagtgatagccttgtgaacagattaagtagttagcatcacctgagaattgacgagaaacctctgtttccactttccaccataatatgtatctggagactaaactgatgcaatattttttctttcataattagtgatttattccaatgtttcagtcaatgacctctcggggcagtacctgtaaaatctgaatagatcatggacagttcttatatttctggcagtatcttatatttttggaaataatagcattctatctttggaaataatagtttatcatgctatggctgtaggtctacctctccgaagtaatatgtgtcatatgagggacacttcaaacggcacaatattttcttaccactcctcacttcctcaccactattctagcatacttctcctccaggtaagtctcacttctccatttaaacgtacctactaggctgggcgcggtggctcacgcctgtaatcccagtgctttgggaggccgaggcaggtgaatcacctgaggtcaggagttcgagaccagcctgaccaacatggtgaaaccctgtctctactaaaacaaacaaaacaaaacaatacaaaaaaattagccaggcatggtggcgggtgcctgtaatcccagctactcgggaggctaaggcaggagaatcgcttgaacccagaaggcagaggttgcagtgagccaagattgcaccattacactccagcctgggcgacaaatgcaaaactccataaaaaaaaaaaagtacctgctaatactgctaataaagggcatacatcagagcccccatgggtgatacggagaaaaaagggagggatgtcaattgtattggagaattgggtgctgaaggaaaattgtagggaagaatagtgaaataaaagcctaaaacataaaatcaacgtcccagctcccagtttagctaaagaatagccctaatctgggcattacataccaagtgtgttagctgctttgtctcctttacattagttttgatttctgaagtagtgaaataagaatctatttttttttctaaaatacgcttctacaaaagtagaaaaaagagaatttcttcactcagcactaaaggatattccagatatcttgtggtatagaaagagaaactgatgacggtcttcttttgactccaagaagttaaaaaattcacttacttagatgagctgtttatttctaatgtttgctcttcatagaattagaattgatgaattttacattagaaccagaaaagaaaggatcaacattttatgtgaaatgttatcttttctgtatagataatcagcatttccagtgaccttttctgagcaacaaaaaacatagcactttaagggactagccttctctatttaatatgtgtgccagaaattatgaacccatcgttgaaaagaaaacttggtctttatatgtaagtcacacttcagttgttttctgagacatttacccttcaggggattcaattaaaataactaaaaaatatgtatttcctaaacatacttataatgattattctgaataaaagaattatgaataagaatacctacctgtgtggctctattatagttacaaattgtcagtgtttcatttccatgttgatttgagacagaacattcatagaatagactcaggcactacacatcttactagcctcttatagcgtacattgtaaagtgtagctctaatttggctttcaaaggtttctgcatttggtcctattctctatttttagactatcccttatctcctctctggaaatcctctgctcaaactacacttcctctaggaacatctaagtctttcccactcctttgtctttcctcatatatcattggctatacctaaaatctccttttcctggaaaaccactaacattgaaactgatctcttttctctttcaactgaaaatatttattatcaagacatatcttttgtcaagtgatacatttaattacaaaacaagtctatattaattaattattatgttaggaacaattctagatgctatggtaaatgtaagtaatacatttctaagtattctataagtcaaagaaaaaagtgggattttggagatctaatgaacaaatgtatgataaaatttatatgcttttagaaacattcatcagaaaagaaaaaaggcggaataaaagatagctaagaagtcaatattttttaattcataaaattaaacccaaggaaagtagaaggaagagaaataaatgaaagagccaaagctatttatttagaaatcaagtagtacaacaggaaaagtcaaaatattattatcaataaaatacaataaaaattatgaatgcttatgaaaatatattaagaaaaaacagagaaggtacaaaatatcaatatcagaaataaaaagggatcatcactacagattctatagataataagcaaataaaaagattttccaataaactaaaacattttaataaaattaaaattttaaatttataattgtaattctattcccctccctcaattttagccagatggtttcactggtgaattatttcaaacatttaagaaaaaattagcaccaatcttacatcaaattttccagagaatagaaaaagaggtaatattctctcattatatggggttagaattactgtaataccaaaacttaagtagagcaacaactatatatatatatatatatatatatatatatatatatatatatataaacttcttgtaaacctagaggcataggtctaaacaaaatattagcagattaagtctgctagtacgtatgaaagataaaatgcagtcaggttggtttaatttcagaaatgcaagctcaaaaaattaaaatacatacaaattgatgtaattagccagaataaaaggaaactatattcatcatagtagatacatttgatataattcatcacaagaatagaaacttacttaatctgataaaacatctgcaaaaaccattagcaaacatcatacttaatggaggaaattaaaggttttccccctgctaatcaaaacaaaataaggatgtttgcgatcaccagttctatcacacaccatagtgggttttccatccagtgcagtaaaatgagaaaaagaaatcataaatatgcaaatagagaagtaagaaataaaacacgttattcacaaatgatatgattatctacttaaaaaattcaaaacaatctatagaggaaaattgctacaactgagtgactagcaagttttctgcataaaatgtcaaatgaaacataactgctttagaaatcaagagcaaaactttggaaaataaagtgaaagatgactacaatgctgttctaatataatagcatcaaatccataaaatatcttgaaataaatgtaacaaattatgcataatgttcttgaagatctcttacattttaacatatttgagaaattaaggaacacaaaactcaatggagggatattttatgttcaccaatcagatgacttgattttgtaaagatatcaattctcaaaatgatctattaattcatcataatcccagtcaaaatcctagcagatttcttgttgttgctattgttttatttaaattgataagctgactcgattttcatatgaaaaagcaaatgtctaagaatagccaagacaatcctgaacaagatcaaactggaaggtttgtagtagtagatatcaagaattatcttaaacctacaggagtaatcaagactgagtggtatccattaggaaaaaagtgaaattttatctcacaccttacacaaataataattcagtggattgtactgctaaatttaaatgattaaaaattataatgctaccaggaaaaaatgtggaaaatttagaatatcttataaccgtggtggaggcaaatctttttaaatagaatacaaaaagcattagttacaaaggaaagattgatacattgaatttaattatcattgaaactcctgttaacgtaaaccagagagaaaaaaatgtaagtggaagaagacatttacagtatatgtatatatgtgtgtatgtgtatatatatatttaaaaagactcatttagaatattacagatgcatacaaatcaatgtaaaaaacattaaaaaattaggcaaaaatctaaagaggcactccacagaagaggttatctaaatgctgataagtatatgaaaagcatgtggcattattaggtatcaggaaagactgaaattaaagccaaaatgtgatactactgcatagaaagactgatatttttctaagagacagtagtaggatttgtgcaatttaaaagaaaatagttattttatttattttattttattgttacaatgtaagggaaatatattaattaaattaggccatcctttccctacttagatttcttgtgcttccagagtcctattgctggtgcctgaaattctggagaagttctagctattatctcttcaaatatcacttcttcctcacactgtctaatcttttattttataagttcaattagatgtatgttaagatgaattctatcttctatgtctgttaacctcttgtatattttccatctttttgtttctctgggatgaattccaggctatttcttcagatatgtatttctacattgccctttactccttacttacatctaactaatctatgaacaattttaatgttatttttatagaaattttctttatttttcagatttaatttgccttttaaagaaaatgtattacagccctaaaataagattggatgaataaacaggagtttgcctgtgaaagtgagatgattgtgttttaggcaaaggttaataaaataataacagcttctatttaatgagttatgtggctgccactgggctgatttccttaaattgttttcacttagaccttaaaacagcccttgtagcattatctgcatttttaacaaaaagaataaggctcaaggtaaaataatgtgcactcatttttgcagaaattcagtggcaaaactggactgtgcactctaaaacattcattgcttcttcttctaggacacataatcccttagaataaccagaattgtggttgcccttcaagggaatttgataatttcaggctaaactgcacagttcttttctggtaataaatcagttctggaaagtcacctcaggaatatcttgggacttgtgcctttatttcagcattgaaggccaacttgcctaccccttcccactgtcctaaccctaatattgactataatctaacaaaaacagcaaaataaagagcatagcattcattggtatttaccctataatatcttgtgttatgtaagatttatctacaggtgtgatctgtgaggttcatacatatttatttgcttttagtttaacatctcccttgcttcacagtcacatggtttgctctattttggggtcataattgggtaaaataataggttactttcctggaaatatagggaatttttttctaaccagtgcatattcaaatttttggatatctgtttttttcaacagatataattaaaggtgaaattcacctcctttttttccctccctccctccttccttcttcccttcttaattacactgtctttttacaaagatcaggaccagttaccttatagacatttttgattggtctaattatttcttcacaatatggtttaaaatgttctatacatcctgtatttgatgaaactgaaagctaaatctggcttagctaaatttcagttggataccttggaaataatactttagagatgatactgtatatgctacacggcatctcatcaggaagcaaaagatgtctggatgtcctgatatgaatgaatgtttctaagtttcatcagtgggttaagttggctacagacacatttcttcattttaaagttgtattttttcttctttcagttttatgtggggtgatatttgggtgcaatagcaataatcagttcctcatcaatctttcatttaatggttgctaatgaactctgaagattttcttgaatcaattctttcaatggagtgcactgattccaaatgaatcatttgtactgttctacttttggactgtcaactactgtaaataggtaaacagtgaatacttcactgagagcaaaacatcttagagaaaggggtacagcacccaaataatccccttttggttactgatgatttgggatggtttcatttaatatttaaatgaatctcaggcatgactacactattgtttcagctgattaagctatgttaagcacgaatataaaggagcatctagttgacatttacaagacactaaatgactccagcaataacctggaatgcaagtagattaatcatagtcctgtcaagtggaattctatgtagagcttgtttatcaaagcggagtgtaaaggaataaaacagatacaattgtagaaatgtaggcagaagattatcacttttttctttaattctttagatataaaatctggtttcaattgcgttatagagaaatgagaaatgtttaagaagcttcaaaataacttgtgtaaaagaaagatttagcattgaaagaactccaaaatgctttttttgagcagaagcagtatttctgtctggaactcttctttaaaccttatctttgttttgcagctgtacctggaaagaaggaagagaaaacaaccaagacagtggagcaaggtaaaaaaaaatgaaggaggttgacattatcttctttagaaagacaacaacatgcggaggaaagcactggattcagacaggcggaagacaataacctttaagtctattactctttatcactgtccttgcatgtttttctgtgccagggagaatgtgagacagcaatctgggttggtctttcttttgtgtaactgaactttgaatatcagttccgaacagggaaactccccaaactgtttaattacatcaggggacatgctgaagattgctgggaataagacaatgatccagggtaactggtagacatattcctatttgatttgtggttttaacaccaccttactgattataatttgaaaaataaagatggcccaatcctatacatgcaaaaactatttctgttgcttgaaaaaaaatatgtaaaagttaaaatgaagaaaataacagcaaaaatagagtatattatgatatatactatattatgacttcaaccattctcccaagaggtctgaaatttcagtgttataaatcataatggtataaaatagttaatgcattttatttgtatttatgtagttatatcataaatagatcactccagactctgcttgagaaaaatgctacagtacactaaacttaaaacatttaaagtgatgtggcttctcttagagctcaagtgtgctaataattttaattgtcgttccctcatgtcattgctcttatataataatactatatttattgtaataaattaaattagaacttgcaataattttatcaagaacaaagtctaaatgatttctccttcaaatttgagatgcaattaaatgtatgaaatcctaatatcagaagttaagatcttttgacataaatatatcaagaaaatccttcaatccctcacatgtcaaataagtaaactaaggttaagaattcagttaagtaaaaagattggttaagaatttatttccttgggcttttcaaaataaaatccctttataattgcatggaaaatgttttccaatttattctggcttctggggactctgaaattttacagttcagtagatgtttctgttggtttctttttgaagaagagtggaattttagtttctgaaatataaagtgggagcactggatcctaatttcagtgtgttcatttatgcgtgttcctgagtctaaatttatttttttaaaaaataaaggtaattatccctgatctgcccatctgagaagatgttgtatagggcaaacatgaaaacatatgtgaaaggatatgaaaatgtgtaaacttctagataagcatgtaacagatacttaggcattttttcttataaaatcaatttcaacacagatgacataaattatcaaattactttgatttcattgagttttatagctttccccctctagtataaaagtgctgattactcatgatattcataggttgttttcatagccacagtatatcaaaagaagattgactagatataaaacacccacactaataatagtaccaaacagacaattgatttgaaaacattgtttctttcttctgatcatcacattggtgtcagtttcattaattttataatgtctcctctagtggacaagagactggaaatggttcttagagataggatcttactccttcagatgattttataattttgtttactaaaatcttcttttatcttattaaagcttaggctcttggattgtgtgaaaaaaatgaggttctttcaatggctatttttatattgacttggtaaatcatttcaattttaaatattgtatgacaatggcctcatatttttcaatcataacaatcataggaaataatatatttggatattttgcatatttttatgatagtatatctattactaataactgatacaaaaaatagatattttgtgcttttaataaagtaatatgagaagtaataatgacattctataaattgtcccatattctaatagttatgcataatgctttaagacttgtatactttgctttcttacatagtttttagttatcttcagaagtataaataatctattagtttataattcattgaaatatagttaaattctctttaaatatttattttatttatttgtttaaacatgtggactttatttagaaaaattatatgatttttgttactcttaatagagtttaagtacactttgtgatctgagtataattgtgcatattgaatctctggacttaaatactatggatattccagtatctcaaaattaagttgaaagttttattacagaataatgtagtattcagttctcttaagaattaaaaatcacttcgacagtcagttaagaagaaacacgacaaaaatatttttaggtaattaaataagatttgtctactaaccatcaagaataaattttaacacagttagtaaacattttattaagtataaagttggagcctgttgatcataaatgtatcagagttcactataataaaatattcaactttgccttaaattaaggaatgtttcaaaattcataaatgggctaatttgtgtccacttgaagagtttctttctttgcttttgatgctattctgtaaacaatggttccctacataattgtaatagtgttttacgttgtcacaacaccaggcaaaacccaagtgctattgcaagctttgtaaatctatcactgtcctcatccaccttatcagattcttctcttctttgtgtatgcactggtctttttaaaatctgtgatgtgtactgattgtagatttattccatactttcaagtgaatgctaataatatctaagagtaatgatttccctgagaaaactttatccatttgaatataatgaatgttcatatttcttggtgtaccaaagttataaaaaaagacagaaacaattttacatttaaaatcaatgaagtaaaacagaagatttagttaacacaattgtatttaattatttgcttaatatgtatttttaaaataacttatttgcatatgttgactaagtcatgctgttgaccctcaataaatgttaaattatgataatattatagattcctgtgaattctaaactttttgacaatacttcgtgctttggttgtttaatatttattgagcgcccacaactggccaggcgctggggaatgggtgtgaggggcatagcatgggcttcggagagaagatggtctatattgaaggcaatgcatgaaaacgaggatactctccttgtttatgtagtttatatattttcaagagaaccattagcaactcaattctccactccactgcctcacttactcacataatacattttacttcttcttactcttattttacttaatattatgaaaacaatttattcttatattttatctcattaatgggaaattactttctagtcccttcttttctaactctttctttccactaacactattcctttaataagagaaagatctaaatcctacttatcacagcagaataatacgtactcaatggaagttcatattgttaacattaatttctcatagaggtctgctttctgccatgcaatatttgattcatgtgattcagacattgatgggattgctattcaacattaaagagaatttcaccccaaaaaatgggcaatgtgtgtcaattatgtctgtgaggaaataaccaactttatgtatccctttgacattctagacaagattatataaaagaaatcagaagttcattataatgttcaccatgcaacattatgagtttaagattattgagctgctaatttcattttttatcgattaatatttaccttcactcctgctattatgctgaagccacagtaggttgtatctctttttcccttaagaatctttaatagaaagtatattacaagctgctacattacaaagctgagtggtcagagcaaagattgtttcctgagaaattttgtttcctttttatttattttcttcttttatttacagattagctttccactacaggcctaattatgaaaagacaaatgaattggttttcactatcttaaatacagttccttatcatcaattacttttccagttcctggaccaaattaatgaaatttaagtttcatactctaaaattaaatcacagaaataatctgaaaccatcagccctatgtaaaaatgcattgttactgtattctcattgtaaattaagttacacatttcaggtcaagtaattttagtaatgaaaatcaacactttatcaatattctacacaacatttacctgcatcttagtgactattattgtcccaatttttatagaccaatgatatattacaagctagttgtaaagcaatgctttaagagtcaaaatttaactcagatcttggaatgtcaaagtagtagttaaaagtttttcatcattatgacctgtaaagtctgggttttacttcacttgatttttatacagaaaaaaaaggaaaaattatttcccagacagagaatctgcattctcatttcaagactttacattgcattccatgatcaaaaattcttaacttggagttagcgcttacaactttggtcttcaaagaagaaataattgatgatagccagtggcaattataaaatgttaacctgcttgaacaatagagcacagagctatctccaaataaaactttgggcttagtttagctctatcaatcatttgttctgtgactgggctacttatttgccttgcactgccttttttaaataagcaaatattattgtattaagctatctctaaaggaccttccatctctaatattgttcaattctcacttgtaagacatgttttccatgctcaagacatttccacattgcccccaatgctgaagaacaagctgtcttctgattgcaagtacaatcaatcaacaggaaagtccaatttagattataaaatgaaaataccttaaaatattatttaaatctactaaatggaatgacaatatttaaagttttgctgatactttacattacacttaaatttcaaaaatatctcaggaataaggcatgctattgggtaccaaattaaatgacataaaatgctttaagtaaggttgtaagcatgagaattagtaataatggcacacaggatatagaaagtatgcccttgatacacacagaaaaaaaactataaaaaatggggcagaagaacttaatgtctctggagataagataatgtagataacaactgtgtgtgacgggtggtttctgattatttttacaacatggcaataatgactttgtactgtcagtttttcagtacgtactatattctcttagcaaaattttgcaaattcattggtacaatggcaggaacaagtttggctttaggatctttaaatccttatcactggaagcatatacatttaaattccttagagggtaacacaagttccttttgctaccaagcctcagtgtgactttccagccaaggttcactgtttctaccccacgttctccattcaagaatccacatgaactttcacactccatggtattcttatgttttttttttatgtttgaaatgcctttctaattcttctttcattccaaattttatcagtttttgaatccatcacaaatgccagtgtttctgtgaagtcttctttcattttctcaggtcgagtttgccagtctttctgctatgcacccagagttctgagccctttatcatcgtatttaatctgtctatgtggttgcatcacaacacagttcgaactccacacaatcttccttatttttccagctctcagtagaaaagagacactcaacaaatatctattaaatataatatggtttatcttttaaaacacaaacttgtgtcctccttttataatatcattttcaagagaaaggattctaggggtcctggacttctttatccacaggagagacactctgtcattctggtaagcacaacacaaagaacagtttctggtttgttgaaatagcatcggcttttattttactccaaccaaaccctttttgagagtcttggacctcaattttctttctgtgtacatatccatcacaaagattacaatacagttagtgtggaaattttttaaaaatttaataaaaatctaaaatataaaaaatcaaattcaacaatacataaaaagaattatacgtattccagatatgcaagtctagtttgacatttgaaaagtgtttaagtaatcaataacatcaacaggctaaagaagaaaaaaacacatgaccctatgaatagtaatggtaaaagcatttgagaaaatctaacacccattgatggttaaaaactctcagcaaactaggaatagacagaaaattcttaaacttggtaaataatttttacaaaaatcctacagctaacattctatttaatggtgcgaagttaaaagctctcttgctgaggtcaggaacacggcaaggatgttcgctttcacgccccttcatcaacatcatactgaaagttttagcgaatgcaacaatataagaaaaggaaataaatggtgtacaagttgggaaaaaaataaaactgtatttgttcaaatatgacttatttatgtagaaaattccaaaaacttcctggaactaatcacagaatataacaaggtttcagggcgcaaagttaatatgcaaaagtcagttactctgttatatcagtaatgaaaaatttgaatgaacaagattaaaaacacaacgatcacttatattggcaccaaaaacataaacacttaggtatattttttaaattatgtataagacctgttggagggaaaccacgtaaaagaaataaacagaaactaaataaattgagagatactccatattcattgatacaatgacttagtattgtcaagctgccaattcttcctaaattgagctacagatttaacacaattccaaaaacaattctagcaagttatcttgtggctattgacaaactaattctaaagtttatatgaaaaggcaaaagacccagaagagccaacacagcactggaaaatgagaattaagtggcaaactgacactactgaacttcacaacttactgtaaaaatacagtaatcaggacagtatgatattagtgaaagaatagacaaataaatcaatgaaagagaatagagaactcagaaatgcactcacaaaaatataatcagctgatctttgacaaaggagaaaaaacaatttgctggagaaaggatagacttttgaacaaattggtgttgcaacaactggacatccataaacaaaaataaaaaagaaaacaaaaaaccctcaaaaatagtctttacgtcctccacaagaaaattaactcaaagtggatcatagacctaaatgtaaaacataaaactataaaattcctgggaaataacatagaagatttaggtgtccttgggtttgacaattacattttaaataaaacacaaaagacaaagtccatgaaagaaaaaaaatatataagttgggcttataagatataaagatgggaataagcatatgaaaagatgttcaacataacatgtcattagattaaaacaatgagataccactacacacctattagaatagctaaaatccaaaacactaacaatacaaaatgctggggagggtgtagagcaacagaaactctcattctttgcttgtggaaatgcaaaaagacaatttggcagcttcttagaaaactaaccttactctcacgatgcaatccagcaattacgctccttggtatttatccaaataagctgaaaacttatgtatatgcaaaaacctgcacacaaatgtttatatcagctttattcgtatttcctaaaactaggaagcaaccaagatgtccttcaataggtgaacagataaataaattctggtacattaatataatgagatttttattcagtgtggaaaatacatgagctgtcaagccataaaaatacatagaagaaccttaaattatatttctaagtgaaatatgccaatgtgaagagtcaacatgttgtataattacaactgtatgacattctggaaaaggcaaaagtatggagaaagttaaaaactcagtggttactagggtttggggaggagagaagggtgaataggtggagcatagagaatttttagggtaatgaaattattctgaatgaaactacaatggcagatacgtgtcattatacttttgtcaaaatctataagatgtataaaactaagattgaaccctaatgtaaactatggactttggttgataaagatgtatcaatattgcttcttggatggtaataaatgtaccacactcttgagggatactgatagtgatggagcctgagtgtgcttgaagagggtgtattagtttgggctgctataacaaactgccattgactgggtggcttataaacaacaaaactttatttctcacagatctggaggctggaagcctaaaatcaggctgctagaatggtgatgtgctgtgacagccctcttctggattgcaaactgctgtctttttgtatcctgacatgcagaaagagggcaagagagctctctggggttccttttatttttctaagaccactaatttgattaatgagggttccatgctgatgacctaattatctgccagaggtgccataccataacattgggagtaggatttcaacatatgaattttgaagggacacgttcagtctgttacagaaagaatgtacaggaactccgcactttctgattagttttgctgtaatcataaatctactctaaaaattaaggtctattaattttttttattattatactttaagtttcagggtacatgtgcacaatgtgcaggttagttacatatgtatacatgtgccttggtggtgtgctgcaccactaactcgagtgcacggaaatctcgaagaattagtccagttcactaagttaattttgaagtatattttgaaattttataccatgagtagcagaaagatatattaaaagcctcctttattttgattatattaataattattcagttaacattttttcttatattcaattatatttcttcaatttttcaatatatatcatcttataaattaagtttcaatttgaacagttacactataatgagaatgattcttgagatcccacataaatgtgttttaggacaggatttccattttaaaaagttcaaaagacaatatagaatataatgaataacattgttatagaaataaagaatgtattatatcttaaatgaatggataatcagaagttattataaaaaataaatgggcataaaagtgtaatatatgtgtgtgagattactgaactttggaaagtcactcaaaatttcttagataacaaaaaaaataaaatgtgaggtaaacattggatttaaatatacgtaattttcttttttgtccaggaagactatcagatattggccatttcattttacttgacacttttgccacacaaagattacaaattggaaaatggctaatcatgaaagatgtttataatgatgatcaggttactgtgtaaagatttgacaataagtttcctgataaaatgtgatcagcacaaaatttgacaaatttattaactcattcaacagatagttgtggaatttcgagtatgtgttaggctacctagtccctgcttcagacatatgatttgcaaggctgtggcaggctggcagttatgaagaacattgatgttatttggtgattcagataggcaccctgttcacttttaggaacaatttgtggtgatatctactttataatccaggatgctcccagaggtatagtgtagaaatttaaccctaactttgtcatctcataacctgggttcaaattttccattccaatttactagctgtaaccttgggcaagttacttatctcttagcttcagatatcacatctataaaattatggataatacctacctctttggagacaggtgagaagttaaagcgatcttatgttaaaaaatgcctaactacacaaaataatgctttatcattatacgtggatacaggaatttccttgagccctgccctcaaggaaattacagtattgtaataaagttattatcttaatttaaacatggaagctttgacatcttaaattgatgggactacactagaaaaatttcatgactaataaaattttctttgaaagagtattctttagtggttcagtagccaaccctgtccctaagatatcctagttcatctcatctccccaacattaaaatagaagttaatagaatgcatatctaatttcttatcaaataaaggagggctaattttatgtttttatatctttaaatattcctgatctttctgaaagagctagacagagatgaactaaagtgcaccctactaattttgattagtagtcagattattaaggcgcataaggataagaatatcaaagtgtgtatatatgaatactccaatgcttgcagccgaggcacacagcctcaaaacctagtaattatgaaattgaaccagaatttagtcaaaggaaaaggttatttagattgtttcaagagaagcccctcagctaaggtaatttgaagaactatactactataaggaagagcttatcaaaaagactagaatactgacactactgcataaggctgttatttcacattcttatgcctttgtatatgtcactgttttaacatgccaatacagcccagcttgtctagaatatacaagtgtaatttaaggaagctcttcaaagaagtatttacaaagtgttatatagtattttctagttgatgcttttggaattcacttattctccatcccctaaatatgttaaatatataactaaaatctgagagaatagtctaatttcccttatttacaatttcttgaggaatatcttcccacagtcttcacgtactgacaacattgttcagatgtcattcaagaaaattttatattatgctttttaattgggttgtccagttagagatagaggattacacaggttgcaaaattttattctttttaaataaaatataaagactatgaaataaataaaagtcccaagtttaaaaagatagcaatgcatagatataattcaactggaaacactgtaaagattttaaaacatatattcaggaaaaaaatgtaaaatgttaaaaaactatatttaccaagttctttagcccaatagaatacaaaacagttaaatgtatcattatgacaaagagaaagttaaagacagtgtcctgaccaagttatatttaattacaaagttaatgaagtgtctacagtaaaattagtctgttatatctttcagaagaattcaaatttactgttacataaagcatcaatatattattatttccttcatgataattgtaaacacaatattttaaatcatttaggcaacttgaaaattctgtctctgtatttacttataaattttatatgttggagtttgtagtagattgaaaatattataaaatatatttttaaaaatatcctggattatcaaaattgcattcgaattaaaataaaacaaagagacattcatgtaagggattcacatattaactattaaaacaattatgcaattaatcactattaaataactttaggaacagtgcagtatcatattaggaagcaaccacaagatgttgtgagacaattttattttcttttttgatgctgtgtgatgatgtgcgttataagttacactctgggaaattatcagatatcgtttcactttcagataaagcttgccaggtggttctttacaattattctttccatcagaagaaaagtccaaaaagtttggtatgttggtattattcattatgttcgtgaaaaaatatctcagatcagcaagcatcttataactacaaaagagaaagagagagagagtttttgaagttatatttctgagcacttcagtagagcaagctgggtaagaaagattaagaattttgaatttggttctttatagaaccaagggatcttaactgcctgataattttgttagaatcctttacactttccaatttcactttctttttttgttctagctatgttcaatgttgacaccaagccagaaagctccaacaaaatatttgtattaacattctcactaaatgtcactaatgataaaactgaatttatacttgatcattcagagcaatgaataataaataataggcagatcaatggtattaataattactgctgtttcctttaaacagatgaatacttgtagtttggattcaaaatgtttatgcttgtgtcaggaaagaactctagggctgatatcctctgttataagactttccactatttcagtcttttgtcttgtctttttcatgagcctcttttttcaaagaattcttgtggaaggaaaaggaaacactattgccatatataccttttatattctacaatacaattaaaagtaaaagctctttgctatttatttttggttaaatatactcaggcccataacttaaactggaaaattcctggatgcatttctattgagtattattttcaaaatgaatagtttttatctcagattatttaaaactcgacttctatagctattttgatcataatctgtattttaaatttttaaaggtctggcaatagcacatcaaaatgtataaagttaaggccatcactaccaatatataaatgatatgtcaatacagacaaattatatgagattggatttgaaacatgccggtaaaaagaacagctgagaacactagtcttagtgtgtgggtgtgttttcaccagtcacatattattaagaaaataattgttcactttctggtttattttgcttttatataattggtttacttaataagtcaagtcagtctgtgtgaacaaagcaaataagattaatttgaggcctttgaaaaaacaagctactagttatattgatagttttcatttataaggaatactgtaggttgctttgcagcacctgtaaatgatctgcacttcacctgttttttccaactgcttgctggatgtttcctttttgggcgtcctgttgacatatgaaacacaatactttcaaaacagaaataatgtcttcctccaaagacctctcctttttacattttgtatctcaggtgagggaaaattatcctactgtaagccaagtaagaactctaagaaccattctcagcttaaaaaacaaaaacaaaaacaaaaaaacctaatacatggccgggcatggtggctcacgcctgtaatcccagcactttgggagaccgagttcagcagatcacttgaggtcaggagttcgagaccagcctggctagtatggtgaaaacctgtctctactaaaaatacaaaaattagccgggcatgctggtgggtgcctgtaatcccagctacttgggaggctgaggcaggagaatcacttgaacctgggatttcagtgagccaagatcgcgccactgcactccagcctggcaacaaagcaagacaaaaaaaacaaaaacaaaaacaaaaaaaaacccctaatacatctacttacagttatgcaattaaaatggcatttcctggccaatgaaattccacccaatttataagcctaaatctaaatggcgtactctcagtgaaaaccttccccaattttaaaattagaattaataaattctttccctattatctatataactttactggagtacttttcacagggtcaaatattttgctctttgttgattaactaccttttcacaactatttctacatacaggccatttcaaaacttagtggtgtaaaacaacagctgatttcatgttgttcatcatttagtaggtcaggacttcaggaggatacagtaggctgttttcacttgattatctcatgtgattgcagtcagatgtctggctgggctgcagtcttgtaaaatcactgactcctggatgtgaaggatggctctctcagagggctggcagttgatactagctgttggctgggagctcagctggggctgttagttggactgcctagatgtagcctctccagcatggtggtgttaattagattactcacatggcagctgcatttcccaaagcaggtgtcactagattagcaggtgaatactgcatgaccttttttgatttcgccttggaagtcacacagcatcacctccacttctgttggttgtaaatggcctacggagcaaaactgatagatctgccctgtccaggcctcccattctctctctgtttctctaaaatgtgtctttctttccatttcatgtttgtgggtctaatttctttcccttgtcaagttctgcctcagtactacatactttcttacatccttcactgagcccattatgcaactactggagccagtacttatgtgcttgagagcatagatatagtggttcaaatccaaggtctcctatttaaagatcttggaaagttatttaatcaatttatgtgaaaagtagaaataataacagaacctatatacctcatggagttgtgagcactgaatgagaaaatggtagagaatattgcctgacacgtagtaagtagacaatgttagctatcattcttatatctttcttcttcaaagcccatgttagtttacatgtacctttttttgtatatatggcatagtctgtactagtgatagaaattcatgggcttattttctattgtttacatatttagtccaatgtcttatagacaacatatgcctggagacatttgtattgtgaatatcaactcagatgccctgtgatcttaagcctcagtatacaaaacacatgaagagacttgcatttttttcctctcttattccttgtaactttttcttcccatgatctctcttgcagaaattagaaaagaaaaatctgggaagacttcttcaattctgaaagataaaggtaacagagttaatttaatataatattacaaatttattaggaaatatatattattgagaacacagtacattagctgcatcccctttgcaaatatgtaaaccagaactgcagaggtcacacacatatttttaaaaacttgtgtttatttgtttgtctctaaaattatttcttctcattattaccaagaaagtgctctgattacaattcccaaaaatcccaaagagaaaagaaagaaaaatgaaaaaaggtttttttaatgaaaaagataaaaaatatagaagggaagtaaagaatattaagaagcacttgtccccaaattctctgattctctcctttctattcctaaaatatatatttagtgcataatatatcccaagcacttggtaaacattggagatgatgatgacaacaaaaatggcaaagctacaaataggaagtaatatttggtaattagaactctgcattctgatattttcaaatgctctgaggcatattctgcctgcgttagtcttgtcacactctatattgctatgaaaaagcatgaaattcttaattaaattttgtaacttccatctcctgaatggactaactgcctttcctctttgcctatgtaaatatttaaactgatcctaagaataatgtccacatacagcatcaagccttctctacctatttcagccttcaatgagtcccctctcttctgaattaacacacttgtaatatttataatttattctgtagtacgtatatatgtgttatatatatgtactataacatataatttattatataagtgtgtgtaatatatgtatatataataaattaactaaaattcatctatttaaatctcaaggtctgatattattcaccttaattttttgtgtggactgatcagtgctatattcaacaattatttattctgcatctaatatgatgtaattaattcagatactagacacaaaggatgcaaaaaaagcatagactataatctctgagaagttacagtattaataacataattaaaattataataatcataaaggaggtacacaggatgctatgagagggtgtaataggagattttgatcaattttgtgtgaccaggaagttttttcctggagaaataatatgaaatgtaaatgagaaggtgaagagtttgcctttaaaggtgtggtaattgtttggaggaagtccaaaagtggtgcatctactctttgccaggcaccttgatacctactttacatatttgtttcagcaaaatgtgctagctacctctatttttgtgaacaaggaatgtgaggtctagcaatataagttactcagtgtcacactgtgggtaatagggaaaggtaagagtcaaagtcatctctgccctactttaaattccattttttcactttaacacagacactgcctttgtcttagaataggggtcttatatttgtattcacaaaagcacttttgctttgagtgtagaccttataaaaacaaaaaaaaatctatttggcatagatgcattggacatacactatgaaaaatagtctaagttcttttgctattggggtaactacacttaattctcacagatgggcttaatctatttttctttagtgattacctgtattttgcgacagttccattcccagcctccactctcatgtaatatgaaagtcaataaaaacagcgtccttgattttgtgaaaatcaaaattgtcatgaaaacatactatcaggaaaagatatacatacataatttggagttcacaatttgtaaaatctaaatatttccttcttccattgtcatatggaagacatttggggacattaatgtctttattttagtctgcacttatatcacaggaatacttgaaccacatgttattgttcactatgaaagcagctcaaaagaaaggttggggcttaactccaaagctacactttgggcaatgataattatcaaaacttttaactattacttaaaatcttcacatgtaccaaagcttaaactagttggaggaataattgttaaaatctgtcctggaaaacattatctggaggaaataaatccacactgaccacttcattaagtaggcttttgtaatttctaatattgttgcaattgtatattttacatcatcctaaatcaataatcacatgctgcaaaccttatatacgtaattttccagtgattgaaaatgttagagaaaatagtagataattttacaattgacattccttactgaaaagtttttgctcaatgtaaaattatctactattttctctagaatttcaatcactagaaaattacatatataaaggtttgcagcatatgattattgatttaggatgatataaatatatctactttttaattcaaactgcattaatgcccccaaaatgcctttattatatataagtcgaatactgttttagaagaatttcatttttcctgaatataatttatcattactaagtatcaaagacaaaattttaatattacctataagattttagggacttcaaaagcctctgcagtgttattgtttttggagagtctctttgaagcctgctgctaagctgtggcagaatcagaatgcagcaatttcacttgctaaaaattcacttattttattagcgttgtattttgtcagttacttctattaaaccactaagagattacctacatttgcctgttactcatacattccgcctgcatgtgtacatccaaattcattttaaaatgatgcttcaagtttaaaaccagcattattacaaggaaatcatttggagctgcatttatcagagttgtgataaccatgagtcactgggggcattcagagatacattattaggcttttgcctttaagtaaggacatatagagttctagggatgaccgttgcaaagaaaaaaaaaatcaggagaatgatatgtcttgccaacttttgttgctggttcagttattgactttcctggaccagtggactcacttaagccttttcaacacacccacagggacatagtcctgcttttgaggtcttgaccatccagaaaacagaaaatcctgttagtgacccatgatattggttatcttccttgtggcattcaaccctatccctgataacttgtttctaactcctggtctgacatatctgagtatggaagattcacctacggactgagaaacagcaaactgaatccaaagaggcaacacagtagttaagtaatttctcctcctctgagaacaaaataatagcacttttaggtttctctgttattggagtaatacaattggacatcaaaattattgactagttttgccccccacgtctgtgtatgtttggatataatggcagaggaatcttgacagaactgatcttcttttactgatgctcaggactgtgcaacttatgatcccccaacttccatttgtcctcaacatgtttttcttggccatttccactcaacaattcaaagctagaattaaggttggggtaagttgtctgaagacttcgaaactcctccccagccatgctgtacttcatcatggatactaacccagttcctcgttactgcctttgtctctgggggtagtgtaaggcagtggaaaatctgaaaccattttcctatcccttagggaattatttttccataacaatgttcgtgcctcaataattttgacagagttccactttatatcccagcaccattaaacactttataggccctgataatcaagaaccataaatcatcctatagactcttggacaaacacaaagaaactactatattttaaaaaatgttttccaatattctgcttttgacaaacaagatagataagctgaaaagtgtcataagagttgactcaaaccactgatgtatctctccttcctaatgcagaagtgcagagtttccatgtaataatctcttcacttttttgtcagatttaatatcctcctcacttccttgggtagttagagattcctcagagaagtctgtggacttcctaaactgggacaaaagcccctgaggacaaagtggatgctgagaatcaatgatctgtaggaaagtcagtgcaagtgatgactcagcctaggaaccgaaggcatcttgccagtagcaaacttggaaatagaaatcacttttattttctgagatcattctccaaagcttacggtattgggtttacaatctttgaatgtcctataaaagtgtatctgttattccaccctttccttctctctccactaaaatcaatgtagttctgtgggctctcattctaggtcctgtattttataaatactaaaccctcacacaaacatacacactcacccatttagatcaacatgctgaatcttgaattctgagactcgaagcattgcactctcctgccccactgggagtctgttcccaccaccactcctcatttcacaacacattaatccttttggcttagccaggaagtgcaagagcagtaaattacccccatcagcttgaaaaacagttaatgaagctttccagtgtgtttgttcaattcatgactcttgatttcatcttcatatgctgaagtatggaaaaatagcactatttatacacaacaccataaatagcaacatgggcatttatttgtcaccaaagacattaaaaaaaattctacatgcttatggatatctaaagctacagcttacccgacaagaaaattttgctttgaaagatgcagttcttttaataaaacctcaaaatcaattcttaatacatccaaaactatctggactcagttaattctaagtgtttactagagtggcatctccatttacaagcaccaccatcacagtctctgtattttcacccaaataatatggtgggaatagaaaaaggggctgaaaggatagatctctttctttcccttataattgcattaaaagtcattttcatccataaaatctttattgagcattaatgttgcagaggaagcataaaatgtgttaatgttttattttttattaggctgttgaatataatgatgttaaagacattgaccatatatgtgtctggagcccatgatatggtctgaattacactgaagatgtgtttggaaggtggtagaataagtaaagttttatttgagttacttcaaccaaggccttcattttgaagactttaaaagtttataggtaaaattgtctcctagctgaaattgtctctcaaattttattttggtcttattctcaagtttgagtctgaagactaaaacaccgctacatacatgatatgtgcaggattttctatttggttgtttattttttgacaaaatgtgggctaaaagaaataaactggctttgtgctgattaaacagttttggaagacttctgcatgctgaagtcatgcgatttttaaaaattacacataaataaggtcctatccatccaaatactcattctcttaaacaagtagattataacttgttgaacaacttatgtttgtgccaaggaaaaatgatcagtttatggcttattgtattctatactgttgtttctttgtccctatatgagtaaaaccatttttaaagtgcattataaagtttccacttactttcagcttactgatactttcagcttactgacttcatttataggtatctgaaaatctctttgtcttggcttcaaataaatgtccgatgtttcttttcagaacctattaaagggaaagaagagaaagttccagcttccctaaaggaaaaaggtaatattatacaatgaaatgtgaagccacattgatctgccttttgcatattcagttatttgcaacaaagtaatgaatcatttcattttcaggctctcaaaaccatagccttcatatgtttttaagcaaaagaaaaaagatttatattccatcattaaattctaaattgtactatgaaacaaaaaaggaaagtgtagctgcatcagaaatactgcaaaaattttaaaaagtcttatgctattctgattccatgggtctgtagtgaaatggaggaatctacattttataaatatccaaagagcgaatcttaggaatagccatggaaaccaaagatttaagataaaatgaaatagtaaaaatttctcagtgaaatcttttgattctgtaagttcatatataatagaatcctaaacatattgtatagctaggaggaacttagaaactgtagtccaatcctcttgtcttacagacaaatgaagcccaaatagtcaagacctttttcaaagttacagtttgtagtggagacagcattagaacttcaatctcctaaatcaagcactgttctttttctaatgtgccatgttgcatctctagcctttccattgtgataggcttgaagtaaggtggattctgatatgccatacatcaaattatgttccctaaaacacaaataaacttgccaaattcaacgtaaaacataaaatttctaactaatccaagtatattctgtggacatggcattgtgctcagagttgtctaatatttcctggtgtcaaagtaaatattaaaaattttccattgtgcccatattaatgagtcactgaaattataaaaaccaagtaatgtacttactattgtgaatgttagaagaagagcctgtttccctgtaaaatattgaccacacttagtagagggacttagctgtacaactttcatcttactgggatttttttattgataagagaaggatttctggtgagcttacataagcatggattggggttggaagtggtatggagatcagcgggagaggaaagctgacagaaagatgagtaagaggaatgaaggatgcatggagagccaccattagtgagtgtagcaatgtataaaactatagccttaagtcatactttcctaattttgcaactaatgttaaaataaacataattgttatttaatgaaatgtaagaacacaacatgattttttttctcagccccatatgtatctaatcaaaaaaaattaaagcaacatagcttcaaacctattaaggaacttatgccttcttttagaaatgtgttattataactaaaactttcttttcatcggcttttatgagagagttagtttattgctgcacactattttgttattttgacacgatatgtaaattagtatattttgccttgcaagaggattcatatatgttatgttaaatgtccaacaggcagataaatcgtgctacattttagtattcaaagtttaaattaattgagaaaggtaagaaaaatatcctggacttaccaaaacattaattcatcttaaataaattctaggtttctttaacatgatcttactgttggttgacttggatataacaatgtaagttgaaatggttagataccattaagtaatttaatcacacaatgatgctatatttcttttgccaatataaggtggaaatatttttaaaaggtgcagacaggaatattatatatatcaatatttttattttaaaagtttagtttttgtttattttagtctctgatgtctggaaatatattctcaaagaatcttcttctactcttccaagtatcttctttccataatcccataccaggtggttggatctagcaccagccatttcatcgttagagatattagtgatggggacaggggcaacatatatcatgttgaagaagatgcattagctaaatcctcagttttacttcattgtaccattttcttcctaatttttagtaagggctatgactagacagtgatttgtacaaaaagacaattaaatgtaatcaccagaataattattttaaatcccattttattattattattattttagaaattcagcccttaaattactgtcaggattttaattagtcatttttatttttcccacttagagtgacagtgatgtctcctagaaatttgccagaatattaatggtgctttaaaattttatgcattgaaattcttcttcttttttgttccaaacaaccagccaaaattcagacctatgatgctgaatgtaaatgacaactcctggagattttatcagcaaagtgtaatcatatcatgcaaagtgactttaactttcacctgtaggaggtgttgtctcattaggctttctctttcattaaaggggatcaccaccatctcacacatattggaacagtcacatctcaaataaatctttagtaacaggaattaactttaaaagaaaattttctaggttaaagttttaacacttcttttagtaattagagagctccttaaaaggtttcattaaaggagcatcagacataatatggcaatatcatacacaattaaatgagaaattaatctgttatgtgttaatcttataatacttaaatagccacagcatattcttctttgagtaaaggtagaaccatgttctaatttattctcttaaatctggttatgcactaaactctcctattgaattaaaataaaaatgtcgttcaggactcatgaccaaagattctgattcagtaatcatgtagtggagacaaggactctggctttttaactctcattttccaggaatatggaagtgcattttcaagatttgaaggctcttctcatcttcattccttaaaatgaaagataaattatagatggataaattttaaaagccgtaaccatatgcaatcaagagggaaacatttacttggttgaaaaacagagtgaaaacaaggtagtaagccaaaaagaagctgcgggggtgctgggctctggatccttaaacagaattgctgaccaggatcacataaggcaataacgttcattggaataagcagggattttacacaagtctcaatgcaattaaccagatactgaagtggaacccccattcaagaaaagaaggtgaaaaacagttgccgtaaatagttctctggtgctacagttaataggaaagtgcagacccaggaaagtggagaaaataaactcagcccctcatctaggacctgaagcaagtcatgtattgaaatagagacttgttcaggaatatccctactaacactatgaggcaagttttggagccatcaaagtgtacttgggactagaggcccagtgaaagattggtgcgagaggaaggaatcacacaatcgcaattcataggaaaaaaagaaacaaaaacggcaacaaccacaataatacagttctcaggctgaaatataacctgaaattccaaatcatatgaaaaaattaataataagataggtttgcaggtggtgttggtgttggttgggggtgtgtggtcatttggggcggcctctgccatcttcagtacatggttccaagttctgcctatgcattggcattgcagccagcacaaaggaggaggaagtgtgagggcatgcgtgccaggtggcatgcatcagtcccatccccttgccaccagggaagatttagattcttgatacatttaactgcgagggattctgggtgagagaaggaatgaagaacaagttgtgttggctagtcaggattttctgccattacatgcctttccatatgtttgaagattattataacagtatggagaaaatgtggaaaatatggagtgatttagactaggttgataatatggcttatgggagagatacaagcattttaaaatgattttgactaaacaaaacaacgcaaaaatcaatgtgcatgaatatgtgtaatatgatcacatatatgcatttatatagcattacaaattatacatatgtacttatgtttaaatattaaatataaaacacactaaaaatgtcatcttgatttcaacattgtatcagatatagtaccaatggagaaaaggtataagaattgaaaagggataatcaaagttgtatttgcagaaaagccatcttcataaatattccaaatttacccacaaacaaaatattagtatgaataagagaaattagcaaaacttctggatacaagatcatcctatgaaaattaatgtttagcattcctaaacataagtgatgaataattcaaaaatttattcgttcagggtaccctattcacaatggaaacaaactctgttacaaagaataaatgtatctaaatattgatgacattttcatgtaaaaattatgaaaaaaattttgaaatccatttttaaaggcttgaataagtgaagcaatatttccttttcctatctggaagtgatcatttccctttaaagtaatgtatagattcatataaaaaatatcaacggtatttttagagtagaaaaaagttttcttaaatgtctttaaacttgaaaggacaaaaataagaaaatattttttgaaaaataataaggtggaattgcctgaccaaatatagttattttttatagaattgctttaattaaaatgatatggaaatagtacgggtataggaacgcacactgagagaacataacagcgagcccagaaatgaagccctaaatgtaggaaaatacattagatgacagatgtatcattgagaaaataaatggaaaaccacacttgtttctcatgtaggaaaaaatttaaattccgctctcatatttgcgcaaaaagaaatttaagacatcttcaagacttgatgctagaagacaaacttcaaacattcaggaaaatagagaagaatatatatagcttttggttacagtagaatttcttaagacacaaagagagcaaatccagaagaggaagattagccacacattagaaaaatatattgcaatgcatataatgaacaaagaaaaataactgatattttaaaaatctgcagattttatttttaaaatgaaagcaagcacttgaaatttaaaatttgccagtttctatttattttaaaaatagctaattgagcaaatgaccaaataataaatttatgatcactgaaaaatgtgggtgatatttgtaatcagtacttcttggttaatttataatgtggactaacaatttatttctatgacacagttcaattcaaatagatgatagagaaacaatagctgaaatctatctaaactacatgaagttttgtataggacattcatgtaaaccaaacattaatagtaggtgtatgtctataagaaaatttgggtgactttaagagaaatattaatatactcagaattcaatgtcatggacctgataatattttaaaaagtagaaatacatttcaaaattgcttcaacatgttagaagccagattcaatcaaaatgagatgctacactgaagtgagatgggactttgagatgggatactagaaaaggacatgcttagaatataagactctatatctcttttacaccatgctgaatttgaggtatttttaggacattctagtagaaatctagagctggaagctggctatttgggtgtgagtatcagaaaaaatatttgggttggagatacacttgtgaacctgtattctgaatttgaagatgttggcatgccatgcatgggtgcgatttcttatggaaagagccaagagtaagagaaataatgttaggagaggataaagttaagtctcaaaattgaggaaccctaaaccttcttcttaacatgagtactaccaacaaacttgaagtccaatactagtaatcactctctctgctatttattttacagaaattggtaattttgcatgttcagttgtcactagtttttgtgtctcattgcaaaggtacaatgttgtttctataagcactattttaatattgattaattcagatacaaacctgcaggggaaagctcaatgatttattgaaggagtatgtgttgtgtagtctgcttttataagaaagaatcaagacagttggtctcagagacttatcccaaaaggcacctttcagaataagttaattcaacatatgccatagtaaacttaaccagtgtttttgtcttgctacatctagagaccataaatattccagtgtccagtgattaacataaaaaggtggagttttgtccccaaagttccagttttaaagttatttagtgttctgattctgtttaaactgatataacagggatttattttgtcttttgaaactgataactctaagaagattcaattaatctatatattttattcactactctaaatttttaaaatgttccaatagtattgcaattcacatatgtcatcttcactcatgtcattgtcctcctctacgaaatattagaactttcagtaaaatattttcatagtctaatactgggtctagaatatttggtttagtaatcaacattagtattttaatttttctgtactttttctgagtttcttggtgcctagtctctaatataaattcttagcatgatttaattctgccctgaagtattttaaggagaaatactacaactgtcatgttaacagtgaagaaattgatgcccaaagattaaatgattagccaagatttttatgctgaattagctacttagtatcagacttaataaccactaaaaataatcttatttttctttttttcaatattggaatatattagcaaaacttatcctaacacatagtcaaaatttttgtctttgtaataattttattgtgtttgctaggcatgaaggaagattacagataatctgttgattaataaaaaagaccaatcaggattctaaagaataaaatcttagaagatgcctttaaaatccatgattactcattttctgaagaattgttaaagtgaaagttggacccataacagtagcactttcactttaagcagcaatttacagcctaacacatttcttgttatgtccattatgccaaaatgtcaagttgataggatggaaagaggtcatgtattattttcaaaagtagttgagggggccaggattttctctgcaagcattagctatacaaaagtattgtatccaagcactgagaatttttataatcttcatccaaaatgttaatatacagcaacatgtgtacagctgtatgtaggtgaaatacacgtgcaactctaagtgtagagctccaatattcattccttggtattttttaaatatcagccctcattcaaaaggcagaattgaatgaaagaatgggtcacaatctcactgcaacctgtcttatcactccaagctattttatgcatatgttctaatatgcttctctccttgaaggtttttttgttttattttgtttcgttttgttttttgttttttcttttcagagatgaggtcttgctctgttgctcaggctggcctcaaactcctgggctcaagagctcctcctgcctcagcctcctgagtacctggaattataagcatgcaccacacacctggcttctgtccattaacattttaaaaaatatattatttctactgtaagtcttctattatttttacatttttgaacaagatataagatgattcatacttaaacctatgacattttatctacttaattgattattcttacttcaaattcaagaaaatcgatactggtacccagaaaaacaagcaagagtctagtgacttcccctcagtaaaggaaaactaaggaatgcctgcttgtttaccttggtaagtggcctttgcacaactttctgaactcattgaatggtttaaagtcagcaggctcattagctgaaatatttccaactcgccatctgccatcttcaaataacatcacagggcctgattctgacaatttctgcaggacctacaaatgcatgcagccacctccaattatatctcacctattttaaatgcacactcttcacactgggaagcttcagggaaggaaagaataatgaggagcatataagtaggcataaaagaaagaacagataaaagcagagtgacactatcagaagtgtggtacattgcatttagcatatacaaaagacaaaagaccatgaaaatgaaatgatgacagaataaggcagggacaatgtatgcatttattctgtgctgaaaagagagaatgccctgtggcccattttatgtgtttaatgtccactcagcaaagtttttctgtaagcatcaaactccattgggaattttgccaaggaaggattgcagaatcaggacttaggcataaagcattgagtcatgacttaagcgcctgcattacaaactggagccattttagaactacacctacagaaacttatcaaccataattgtttttgttttgtttctgttgttgacttaatgggtttgagaggtgtgtaagagggacagagacagagacagagaacatgtgtgtgtggaggtgtgcttgtgtgtgtgtctatgtgttatgggaaaagcagtgatgtcagtagtttgaggctcttgcttcctgaaataactaacaataaacaaattagttcgtgtagccactctgaataattttactagacagacaaattaaatataaatatctgaagataatgcacaccagggttcaacgtctagtgagtcagttctaatgtgtttttccatacatgtaagggttttggatagtgagacagggattctgcttcatattttggtttaaacaccctaaaaatgaagttagcattttgattttcctgtcattttgaaacagcattttaattttgttatatatccgtaacaatttttgagtgttcacataatgttctgtggctattctaggcagtgaggctccaaagatgaaaagacatattccctgtcctcaaagatctcacaagacagtgaaaaaaggtgggacaggccaagcgcggtggcttatgcctataatcccagcactttgggaggctgaggcaggtggatcacgaggtcaggagatcaacaccatcctggctaatatggtgaaaccccgtctctactaaaaatacaaaaattagctgggcgtggtggtaggcacctatagtcccagctgctggggaggctgaggcaggagaatggcatgaatccaggaggtggaggttgcagtgagccgagattgcgccactgcactccagcctgggtgacagtgagactccgtctcaaaaataataataataataataataataataataataataataaattttaaaaaaagagctgggacaggggaaaagtgaagtgttcgccaatgctcccttcaataaggcagaccaaattgtcatctaatcaatggagatctgttatttcaatattagtacttgaatactcaggaaatatttgttaaatcatttagtctaattctagccacaaattcctgagataattataatgtttccatttcaaaagattagaaaatggaaatttggagagtttcagagatcacatattagattatttggttaaaaaggaaataaatttcaaactgaggaattgtttgcttgcttagcttttgcctgtttgtttgtttttcttcaactgcagtggcaaaaatgatctctgcaactccttgacatgaatgaagttgaactatcacttgagaatatcatcaccttgcttcttcattatgcatggaaggattcctcagttcatgagcaaagatgatactaattcagaaagataatcagggaaaatgggagcatagagaatgcatgaagtgtcaagaccatatggatgtggctaaataagagaaaggaaaatgttaaacagtcagtaaaatattgaagtaaagaaatgtacagccagataagatgaaaagctatgtagtagcagatgctgggtgttggttcactgtgtgacctcacccaaagttagaacaatttcttcttttggcaatctatgaactgaagaagttcaaaatcaaactcaaaggcagtgaaatcttgtctttttcacagttatatttatccggaccacaaagcattgtgtctgcagcagaagaaatcagataccatctagtatagcagactgaatctttgcaaaataagcattcctcttaagacttatttagggaggcttatctcatatctgaaacattgaagtcaagctatttggagtgacagtatttctatattccatgcagtacttcctcatgcagaaaacagaatgtggaagagtgtgagtgtgtgtgtgtgcaggcacatgcaaagtgcatcacattttcttttaaataataatatagttaggaccacaacaaagttgtgaaattgcgtgtctttgtgtgtagtagtggtaatagtagtaatagcaagtagtagcaacaggttttcatcaaagtccaaatattcaggagatcctgaataaaaaaaggtccaaatgatggaaaaaccatgggtttggaataaatgtatgaatgttgcttataacaaataaaatgttttttttaattttaaaatacgtattgtatttaaaattgggttagaaaagtgcgagaaaagtagtttaaaatatcagtgaaatgattgacctccaccgtttgctttgtacctggcaccattcgaagtacttcacgtgtagtgtttaattttcacagcaatcctgtttgcattaacgtgaaaatggaagcactgagagttacttgcccaggtcacacaattgcctgatgtggatccagaactggtgtctggcagtctgattttagacctatgtcctcagccaccacgttttccagaccccctcatactgaaattcacctatggttgaccagagataacactgctaatgttcctttatatattttacaggagtaggttttgtgacccgcttttaaatataacaacttcccatgtcattaaatattgaatactactccaggagtgtgtgagagagttattcattttctattaatgctcagactgcttagttttaccagctcaacgtaggaaactatataatacgattcatgatttaaagactggcttgaaaaaaaatagaaacctctgtgattatactgtatatgttaattataatcctaatgactattagtagtttgtgtagataatacaacatagataatatagacagaccacttataagaagtagaatgtggtgtgctatacagtttttatgtattaaatgcttcaaagcttttaattctatcagtagcaactttagttatagaagtgtgttgaagtgcttaaaactttggaaacggaattcaaatcccagttttgccacttactagggagtatatatttaaacatattattaagtctcagtattgctatctgtaaattgagtctaataataacatttaccacataggagtggtatgtaaggattatgtaatttgtccattttttcaacaaatatttgttgatctctcttctgtgcaaagaacagtctaagcactatcatgtattagggaaaataaaaaaatcatcccaggactcatgaagtttatatgctactagggttagagagctaataaacaaatgaatatttaatattatatcaataaaatatagataacatatataatatacttaccttagagactaccatgtggcaaatacaaagtgtcattggtgcaaaataataataatgattattattttattttattccacatgtgagatatctatgtgctaaagaaacaaccgtgataataacaaaataaattgagaaaaaaatctatgatatttagcttttgccttgcaaagtacttaaaatagaggcattctgaaaataatgcagattattgggatttatatattgaataaatttatttcttttctttttatgaagacaaagcagagactcctaaacagagtttgtctccactgctgcccttctgacttaagcacttgcatgctgaagttttggtctgcttattctacttgaaaacactattgatgacattgaaaaatcactaatgaagctcccttccccaggcccatcagcaatttacatttcacaaatgaaatcaacagcctggaaaagtcagtgctgcataggaaatggcaggctgcctgcctcaacaacttagcatggggactttttggttccatatttccccaatgcttgtacgtgtagcccaaaacgaagggcttcagtggcaaatgtttacagaaattagatattgtattattatacaagaataattgtggtagaaaacaattaaacagtgaagacagaatgaaaaataaatgctcgcctgctgtctctctggcctcccagtcccaatggccagtattaactaacaactgtccttggtttcctgaagcatctcattataacttttcattaagcttcatatataaagtttatatatatacacacatatgtaaatatatatatagttgtttttatatggcttgaaataaatcctagttagaaactgtaatctcatatggctcaaaaaatactttactgtcagtagaaatatcatctacaaaatgagtgcactgagttcttaaaaatcaagtagcctaataaaagagctgctcaacttagaaaatccgttgccactttctcacatatcaattcctgccttgagtattcaagggtaaaatcccaattctgtttaaaaaaaaaagagaaaattactttgaaagatcatgcaatttaagtttatgagcataatttaaaaatagctaagctctttatatacatcacttctaattctcacatcaattttacattattttctccattttagcaatgacagaatgaagacttgaggttttaagtaatgcccaaggtcacaaaacttaggaaatgagcttgcttttaaagtcagattataaaacccaaaaaccgactcttcatacaccaaaagaacttgtcctaaggtcatctttagcattactgttcacataacactaaagccagtagttctattctagtaagagggcccacagccacacgttagataataccttttcataagagtgcttacaaaattctgtgtacaagatcgaagttggttctggttgtattgtacccatagttggtataaatattctccacaatttttattttttccaaaagatcgtttgacaaacattaaggctgagaagatttcatttcaagattacaatatgattgacaggagtgaaagccgtgtgcagagtgggaagcaaggctgtttcaaatagatacctattattgatgagcaaaatgctaatgaactgtgtcctaggaagaaaagatttaaatttgtgggaattcatttctaagaaatccaaatattcaaattagccatacttcggaaacagaactaagaaggagaccaagatcattctatccagaccttgggatatgacccgggtgaagggaaataggttgggaaaatggaatcttggttctgccacttagcagctgaatgaggttccgcaaactaacttccgtaagtttcagtcacttcatctaccaaatggggattaaaatagcatgtacttcataaaataatggaataatgcaagtcaataattgaccagcacttgagccataagtactccagaaaaaataattctcatcactagaattgtgctaatttgcttgaaagtttaaactgtactgttgacctagcatagattcaataaagaaagaactattagagaaaagaaaaagttgtttcctttccagtgaagccaaaatctcatcagaactcaccatcaaaagagagaattgtgtattgtagactaagtaattagataggaattaactttagcctaaactgactgagacaaaacatagcaccaggaaacccaataattgaaggtatcattgaattgttgcaggccatatttgctatcattggacacataaagacatcacttatttttttaagtttctaaaataaaatataaatgcaacagctatgtgacattgaatttttatctctagttgcagagtcataagatgaatcaacttcttctaggacttcagatacccaacagggagcctttagtcattctatatattccatttatttcactcattcattccttcaacaatatttgttgatcatataccacatatcagatatttcacccagtgctgatatttgagtaataaacaaaacacagttcttgcactaatggagcttaaaatctaaagagtgattacagacaataacaaaattttctataatactgtggcacatagaaaacattaaaatagggtgtatctaccaagctaagtgaatgtgtcaaaaagggggagaaatatgtgccaaagagtgtcagagtgcattaatagcactgatactactttttacagaaggtgcactcaagtattatcggaagtagtgtgtaaaagtctatgacattctttattatataaaattctgcagttaaacaaattagtttttaaaattataactacagaaaatgagacactgctagactaaaacccaaataaagctggtagcattatcccttatacatagtttatgctcagtaggtattccaactatgaagtcagttttttctgctgtttggagggaggaaaactgtaatgtacctggactcttccattaatcaaaagaagactctataccaagaacagataattataaagcctaggaaagttggttagataaaaggatagactggaaacatgaaaatatagtcaactatcttattgattagggttgtgctatgagtattacttgaatagtttaaaaaaggtatgaatttattctatactggtgtttttagaatgcagaatttctggacaaaagacattgtcctaggacaataagagaacaagatactttatgtcacaattgtctatattattatattaaatttaggtaaaattgatttattttataaaattgatactaacggaaatactaggaaaacaataattatattaaccactaggtggagccccatgaattaaatgtatggtagtcaaagacaaaattgcttaagttggtcaaattaggaaaatttatgacgtttttcttctgagcaatttttattaattttttaatttgcaatattttcagaatgcataaattataagtcctggcttttattaaagacaagaagccaaattacttgattagcatgaaacttttttgcaaactggattttaaaatcaaagtatttttgcttaagttactttataatttaccaaagatacatattccattaatattttgataacagtatataactataattgaaattgaaaacagacaagaaaaatcagtgaagcctacctattaatccactttgtactgactatttttcaaatgttatttttttcccttttgtttgtacgtgtttatgtgtacgttttgccccagaacctgaaactaaaaaagatgaaaagatgtccaaagcaggtaaggatattttgtaagatttacatacaaggagatgttctgtttggttggaagaaagctagttttacagttttacaatcctggctggataaaatatttagacatccaaaacattaaaaaaatactgatgctatgtgccatatattttacaagtaataagcaataaaactaaatgtatgctaaagttaacaaaaattccttgctttctggtagcagattttgggtaagtttatcaaagcactagaaccattagcacatacgctgctctttgtttatttactgggcaattgaacactgtttatgaaatgctaagagggcaccttaaatgtcagaggctccatacagagcatgtcaaatgcctaaaatttattattatcatggattgagttttatgaacctgtatttacctactttcaaccattttgatctccaaaaaaggagtcccacatggttcaacctaacagattaaacacttttctttcacacaattaaatgtgcaaatattttatggagaagtaatccattgacctattggccattaatttgaaagctgaaatacttttaaaatagactttctaaaaacaggttttgcaagggaagaagtcaagagattagctgggcactcaaggctagtgatgaaggttgagtggatgaatatcatagaatatgggaaaatgtagaaaaggaagacactaaatcctaaggaaaatttcaattatagtctttctatggcttatcctaattcaagtattttgtatctttataaggagatttatatgtttatatctatccaaaagaaagttgtatctatatctatatctctctgtagagtgaaagtgatactacaaaaaagcagacattcatgatgttggtctaaaaatttttgcatatattcatttgcacaaattttaatctatatttaagcagttattacaaatcacccttctatgtatatgttaaatattaaattattaaagtcatttctcttaagagcattgccatcagatcaaaataaattgtttattttcttatttttagtgaataagcatgcccatttaaagtaattttatataattttaaaacatgcattctttggaagatcaatgaaaagttgaacaattttaaactgcagaaaaaaagcataatagagataaaatgttatattgagtgtttacatcaaaagttacaaataaactttagatatatcttcagaaaaggaaaaactgcgtacaaaaaattgctttattattgttagcatttttactggagtagtgaaaactcactaatcagataaaaggtgcattatgttgtcctttcctctttgcataacattgtattttatgctttattttactgatgatatataatagaaaaagtaacatgcactaacaatttcctattattagtttacattaagtatttatgtctattttattattgttacttaaattttattttaagttcaggtgtacatgtgcaggatgtgcaggtttgttacacgggcaaagatgtgtcatggggtttgttgtaccaattatttcatcgcccaggtattaagcctaatatccattagttattttttctgatcatctccctcctcccaccctccaccctccaattggccccagtgtgtgttattcttctttatgtgttcacatgttcccatgatttagctcccgcttacaagtgagaacatgcggtatttggttttctgtccctgcattagtttcctaaggataatggcccttgttccatctgtgtcactgcaaaggacatgatcttgttctttttcatgactgcataatattccatggtatatatgtaccacattttatttatccagtctatcattgatgagcatttggcttgattctttgtctttgctattgtggatagtgctgcaatgaacatatgtgtgcatgtgtctttataacagaaggatttattttcctctgggtatatacctagtgatgagattgttgtgttaaatggtatgccacactggtctttgatgaatcgccacactgttttccacaatggtcgaactaatttacagtcccaccaacattgtatatgcgttcctttttctccacaacctcatcggtatctgttacttttagactttaataatagctattctggctggtgtgagatggtctcattggggttttgatttgcatttctctaataatcagtgatattaagcctttttttcatatgcttattggctgcatgtatgtcttctattgaaaagtgtctgttcatgtattttgcccactttttaatgaggttgtttatttgtttcttgtaaatttgtttaaattccttatagatgctggatgttagacttgcgtcagacacatagtttgcaaaaattttcttccattctgtaggttgtctgtttactctgttgatagtttcttttgctatgcagaagctcgttggtttaattagatcccatttgtcaatttttgcttttgttgcaattgcttttggcatcctcatcatgaaatctttgccagtgcctatgtcctgaatggtattgcctctgttgtcttccaggctttttctagttttaagttttacatttaagtatttaatccatcttgagataatttttgtatatggtctaaagaaggggtccagtttcaattttctgcatatggctagccagttatcccagcaccatttattgaatagggaatcctgtcagttttgtcaaagatcagatagttgtaggtgtggagtcttatttctgggttctctaatctgttctatcggtctatgtctctgttcttgtactctggggcacagctcccagaggaagggctgccatttttgccgttttgtggtcttcactggtgatatctccaggtaccggaaaatttgaggtgactagggattggagtggacacccagcaaactacagaagccctatggaaaggaggccagacttttaaaagaaaaacaaaaacaaacaaacaaacaaaaatctccattcaaagggcagcaacctcaaagattgaaggtaaataagcccacaaagatgagaaagaatcagtgcaagaaggctgaaaactcaaaaagtcagagtaccatcttcccttaaaatgactatatcacctctccagcaagtgatcagaactgagcagagtctgagatggctgaaatgacagaagtagacttcagaatgtggataaaattgatcttcactaagctaaaggagcacattctaatgcaatgcaaggaagctaaaaattatggtaaaacattgtaggagctgacagacaaaatagctagcatagagaataacataagtgacctgatagagctgaaaaacacaatacaagaatctaaaaatgcaatcacaagtattaatagcagaataaaccaagtggaggaaagaatatgtctatttttatatggtatttgcttttaatttcctattatgaaagataaatcagcattaaggcattttttattatacaatatgatcaatcaacaacttattgaaaacatatattatgctaatgtcactaccatatgtccagagttgtgcttagtgatataaaatttacaaacaagtggtaagatattatttccattctcaaagagtgtaatcagggacatagacatgagctatcgaaagatggctacaaggaaatgatattagtgaagggttccctaggaagttagagagaggagccattcctatagccattcctaagtagcagtaagcgaaaacttaatggagataatatatttaagctagaaattcaggaatatacagttgactcttgaacaatgtggtagttaggttcattaacccccatgcagttgaaaatccagatgtaacttttgacttatccaaaacttaactactaatagcctcctgttaactataagccttcctggtaatataaactggatgcacaactatttggtatgttatatgtattatatgctgtattcctacaacaaagtgaactagagaacagaaaatattatttaaaatatcataagataaaatatatttactatgatgatacttatgtatcatcataaaggtcttcatctacgtcttcatgttgagtaggctgaggaggaggaggaaaaggacgggttgctcttgctctctcaggagtggcagaagtcgaagaggcggaataaatgcaaatgggtcagaagcataactttacagaatgcatggtaatttctgtctaacttttttgctttttcatgtctccaaaaatgtttctagatagtaccaatccttcttccagcatttactttactgaagcaatgcttcatgtaagggtccctgttgtaaaataagttaaagcagtcttgagtaactggaacccctctgtcagattctctaatgccaatgtgtttctggtactacttcttccaaatctgctacctctttgtctggtactcattcagaagtactcatcttcattaaattatcttctattaattcctctggcatggtgtgtattagtgctttaatttctccaagacctgaatgttgaaatccttcacctcccaccttttttgccatatctactgtctatttcatgatttttttgattgacgctgtcatacatcctgtgaagtcatgcacaacatctaaatacagtttcctccaacagaaacattctgattcaagcttgatggctttcatggctttttcctctaacaaagatgacatcttcaataatacaattcttccagactttcatgatattctctctgtcaaaagtctcttctatagcagacaatcctttccataaagaaccatgtttaacgacccttaaaagttcttatggcctactgatctagagactgaattagagacattttgtttgggggcaagtagaccacttcaacaccttaggtgtagaactcaagagagttgtgggtggccaatggcattattcaattattaagagaatgttaaaagtcaaccgtttactggcaaggtacttcctcactgcagggacaaagcattgatggagccactccataaaaatgtttctgaaatggcttggctctgtatccccagccaaatctcatctcaaattgtaatccccataatcctcatgtgttgagggatggactgggatggaggtgattggatcatgggggcgatttcccccatgctattctcatgatagtaagttctcatgggatctgatggttttataagtgtctggcagttcttttttcacacttgctccctcttgtctgctgccacgtaaaatgttcctgcttccctttctgccatgattgtaagtttcctgaggtctccccagccatgcgaactatgagtcaattaagcctcttttctttataaaattacccagtcttcggtatttattttagcagtatgaaacagactaatacaggttctcattgtccaggtcttcttgtataatcaaaagatttgaagctggtgtttatgctttcccttcagtccttgggggttagtatatttctagataaagtcagtcctggtcataaacccaattgcatttgcacagaacagtagagttaacttgtcccttcctgctttaaattctggggctcaattctctttcttactaatgaatgtcctttgtagtattatttttttccaaaatgggtcactttcctttgcattaaaaacctgttcaggcagaaatcctttcttctcaatgattttcttaatggtgtctgagaacttttctgctgccttctcttggttggctgaaccttcttctcctattgttgtgacattttaaaaaaagccaaatctctttctaaaattatcaagccatccgtttctggtattaaattctccagctttacatccttcacctttctttttctttaagttgtcatataatgacttcattttttcttcaattatgataaagtctataggaacaactttgttatagcaatcctgcacccacataaaagctacattatcaaaatgagataaaaaagtattttgcaataagtacaaggttttcactcctgctggtatagctgcaatgaaaatttcacaaatttccttttctttttgaataattatccttatgctggatttatatatcttgaaatggtggacaaccacagctgcagacctcaatctatagtacctatcaagcaattcaaatttttccattaatgttatgacttttttatgcttctttggagcattctcagcatcactagtggcacttcatattggtcccatcattttagtcaaggtttatgatattgcactaaaaatgataaataagaactacaaaaaaatcaccttttactgaaatatgcgatttactggacagatgaactgcttatgcagagattaatgtcacacagcattttaagcagctacccacaaaacttcagttcatcacaatagtagcaagagaggctacaaaatcactacagtagtaccatatgtactatagttaatttcattcagttatcctttaatattgcatctttacatttgtttacctttctcttgactgtgcatggcaccttgtatgatctggaagtgtttatagtggaagtttagacaaattttatctttttataatcgatttatatatttgtatattttatggtaacaaatgacaaaacagactagtacctacatatattttatgcagttatgatatacctctttatttttttatatttttacacaacacagttcatgtgtgttttttcaaattgttgcaaacctccccaaaattttcaatgtatttattgaaaaaaaactatgtataggtgaacctgaccagttcaaacctgtgttgttcaagagtcaactgtgtaagagcagctgagacaaggaaattactataaagtatgatggaaccagtgttggctttatactagcgatacatgaattttactccctttgccccttgttcaggggtgtaactttacttaaattacttaatgtttctgaacattaattttcttatctattgggtgaagctcatcatactcacctagcatatttgttacatgaaacagaaatgatgctttctacttggcccagtttcagtatggtagctatatttaggagctagcctagagacaggaatgagcacaacagtggtgggagaggtgaggagaggactaaggacattccaggagtcacatggctagcagaagatggcaaagttgcagtagtaggatacagccataagaagatggctgtttaaatccaggaatgggggcttagaagactaaagtgaaatttggattcttgaggccataatcgagaagaaggtggaattgttagtcataatggcatgtagagtgaaattctatagaaataaattagaatcaggagtttgaaccaaaatcttttataacaatctaggtattataaaataaaagtaggagcaacataaaggttgcataaagagaaagtaatgaccttggaatatttacattaaattaattaacattgattactttcaaaattatttagagccatgactaatgttcagtaaatgattttttaagttttaaaaaatcactcagctttgaaacctattgaaaactactaatgacattttgttacatattccttcaggcctgtgagtacttgtgctttaaacagactatcattctctctgtactgtgttataatggcttttgtaatcatcaaactgtttcatatgaaaataataggtgttgatgacattagttctgtataactacaaggtctgaagcatgggaagatgaaggtgattaactagaagttgcaaagggaattcaagtggggtgagtgcttgtggagactctacatagagattttctatagacacttgtaatttgggaacattcactttgaatcctcaggctgggttttgtatttatgaggcgagaggtccagagtagaagacaaaggaaagagagttcttcaaacctgagaaaaaggaatacttatatattgttgatgggaatgtaaattagctcagacactgtggaaactagtttagaaatttctgaaagaacttgaaacagaactaccattcaatccagcaatccaattactgggtatttatgcaaaagctttctaccaaaaaaaaaaaaaaacacacacgtgcactcatatgttcatcacagcactactcacaataacaaagacatggaatcaagctaggtgcccatccatggtggattggataaagaaaatatggtacaactacatgatggaatactatgcagccataaaaagaataaaatcatgtcctttgaagcaaaattgatgcagctggaagtcgttatcctaagtgaatcagtgcaggaacagaaaagcaaatactgcaagttctcagttataactgggagctaaacattagatactcatggacataaagatggcaaaaatagacacttaggactactagagatgggagaaagagaggggacaaagggttgagaaactaactattgggtgatatgctcactaccttgctgatgggatcatttgtaccccaaaccacagtatcacacgatatacccaggtaacaaccctgcacatgtaccttttaaatctaaaataaaagttgaaattattttttaaaaatgagcataagaaaaaagaaaagaaccgagaacaacttcttggaaaagcaaaataactagtgaagagaaaaaaagtgttaccagaaagatcagggactacagtgtgccagcctcccaaagtggaaacactttcaggaaaaagtgggaatgtcaggagtcagtatcaatgtctcagaaaggtcatgggggtaagatgagtgagacaaagccaatacatattaccaaaaaccctgtcatcctgtgaatgtttggagagcattttcagtagagtggtggaaacagaaattagtttataggaattaaaaaaatgcatcaatcataagtgaagaaaatgcacaaactacttttgtgaggagtttgttgtcaaagggaggccaaaaatgatattcttgtatgtagaatcaaagacatatttttactgtcttcatgtttatgatagggtgaagtattccatgaagaggaggagcaaggaaccagcacagagagatattaattaagaaagaactgtcccagatataagaagtgttggaatacatactctagatggaggaaatttttttaattaagaggaagaaaaaatttccccagagttttgtgggaataatgaaaagataaattaaattaaacctgagtatttatgaagaagtactgcttggtaatcttttcttctaaatcctctcctataaaggtgaccaataacatttattgccaaatccggaggatggttttcttgcttattatgacccctcagcaatattagacaatgttttccacctcttatttctcagaaaaagaaaaaatcctctctttagcaaagctaaatcatttaaccagcaacggttaaaaataaaacaacaaaaaatgactatgcttttaaatactggagcaacagtataacaattatttatttttagcatagcatattgttggacactaaatttctttttttttctttacccctttataaaaatggtggcaaacatgacatgcatttgaagtaaaaataaagatataaagacaattttctaaatttcatgttttatttgggaagaaagaatagcaattcatgacatacctgcagactgggtggtctttgattatgtctaaagaacaaagacaagattagaggatttattaagaaaggatagattttatgtattgtttttcgagaaagtttagccagctcccattggtgagtgacagaggtggacaaaattagtcctagagttgcagcaagttatctcggaagctatagataaaactggtttcaggttacaacaagcaattccagcagtcaagtatgtgcagagaattacattcttggagccctgttttgtgccctgagtgttttctccccctggcttttctagactttgttttagttgagtatgacaagaatgacccaatttagattatcagctttcacatttccccccttttgatcaacatccttatctgaaagcatcactaatcaatcattttacagttaggcttaattatcccttcatgccaagatgaacctgtcctagttgtctctgtcccatgtctggggaaatgtttggggtcatcagagacttaggccacatttaagtaacaaatgggccagaaagaaaaatgttctcagggcagatttggctggatcccagcatcaaattccattttatctgtccctgggcagacatcagcaatcatcttgaggtattgaactaatattatcctgttggaagagttggctttacaaagattagacaggcaatagaaacaaagcttaaaaattatcatacaaaaaaccgtcagtaaacatataataaatccagtttgaataactagtttgaaagcttaaacctaattctgaaggtaaccaacaaaacatatctaaaagtctagacatattctgctgagacttgttatagccactgagtagtagtttatgactgggttgaattaaagcagagaataccagctttaccaaaaggattaccagtacaatttgaacaaaaagttgtgatagggatattgtcagagctgctcacagtacagataaaagggatttcttaggtcaagatatgtcaagttaccaacagaagctactgactgaaattttaattatgccattatccagtcaatgaaaaaggcagccttgaggggtgtaagagtctcataataataaggaatcttgttccaacatctcaaggaaagttgtttcatgtggaaaacagaaactttttgtcctagtttgtagtttgaatgtctttggtcgtggcatcaggcggttttgtgaactttctgtgtttcatataccagacatgagaattgttctttagaacttgcctagcattaccttatagggctttaaggacagagcagttctcattttaccacttttatggaagaaagttgaattggaggaacctaaaacaatttaagacctagtctagcctatagatagataacaataactaaaaatgatatatagagttacaatctaataacaggtgtattatagcttttctttgtaaacatgtttttaattgatcatatagaaaccctagatttaaaaaactcttgaagctaggaagccaaaccaaggcagactttagaatttgcttactgtcttaaggttcctgggccttccaggaaatgacagtttttatttacttattgtaagaatgggaactcttgaagtcagaaattttggacatattgtaaaatgtgacattttaattgaagccttggcaccttggtagtataagcaatgttttcaattgtattttgctgtaaagagagagcagattttattggacttttgtaaataaccatattgccataaaaatatttgcaaatagtttttaaatttttggagaaattaaataagaagaaaaatgtttttatctttgtttacacaactatattttaccaaattgcttaagaaagactttttttgaaatctggaaaacaaagcatttaagtaaaggatcaataatattttaaataacagtcataaaaacattatctttatcagttatttaatgttatataatcagcttattttcagcttgatctctattagcagtttcatggatccatcagtttctttatgtacaattttatttggtccattgatttaaaattatcagaaacctgtgtttaatgctgtgcaccgaaaacacagttttttgtcagacaatcttcaaataaactaaataagttaacacaagagaaaaaacatgtttataaaaaaaacttgcataagtaatatgcaatcacttatcttacttttatattaagaaaattaagccgggcgcagtgtctcacgcctttaatcccagcactttgggaggccgaggctggcggatcatgaggtcaggagatccagaccatcctggccaacatggtgaaactgcatctgtactaaaatacaaaaaaattagccgggcatgatggagcatgcctgtagtcccagctacttgggaggctgaggcaggggaatcccttgaaccaaggaggcggaggttgcagtgagctgagatggcgccactgcactccagtctggcaacagagcaagactccgtctcaaaaaaaaaaaaaaaaaaagaaaataaaagaaaattaatattcatatacaaaattttcacagttctgtaactgcatttctaactgctaatcaacttcttctttatatggttattctgtctgcaaaacattttccttaaaattgaactcaacatctcttccattgtccttttttcttttgctcttatctcatggaagtcatgacttgccattcagttacattggcttaaacttctgagtcatttacaactcttctttctgtttcagaacccagcatccaagtaggcacgaagttatgtgtctcccaaatttattctctccatttttttaattcttctgggtaaaacctgtttttttctgattcttattatctcttccctgaataaatatacaaaatcattaacttattatcttgtttacattttctctttaaagatctaccacaagcctatgctacttatctttacaaaatggacatctgtagggaacagtgctaggttactgtcattcattgtcatactgccctcaacatatttatttccatagtttctacttgtttaatccaccacaaccatcaccagaagcccacacagacatttaaaaaccattaccagttctgtgaatttttctcttctcaatgtcttttgaatcttcccctttcactcagtccctcactgaaaacatcctatttattcatctaacctcgaatttcatcaacaaactatcccacctgcccatgactttctagcggtaaacatgtctttatccttggtctgtttgcacatgttttcttctaatgtatcatgtggtattcatgtcgtttgttgcatagatttattctaaccttgtgtcttagctcctatattatctgttctgtgagttatgtctttaatatctaaggcagaaaaaaatatttcaaaagccactatagccacagtaggtccaacaacattatctttatggaaaggaaatcattggttaataatttttttaaaatctgtttttgacatgtttcttgactttatgatatataccacatgcacaggcagttttctgtgtgtaaaaggccaatgaagacagaaagatgtagaggaaggagctctgggacaattgatatggagtggtttacatcatcatttaacttctaagtgatttgacatcatgatttaacttctaagtctcagcttctttaaaatggaattactgacagtatattccatgccagtctatcaaatttattgtaaaaatttagcaatgtaatgcatatctaaatgtgacataatgaaaatgcctaaaaaactataaacatataaaatatatcaataaagtaagtgaaaaatataaaaggttataatctatacagttactatttaaagtgtggtccaaagaacaacatcagcatcacctagctgcttgttagaaatatagaatcttagggcccatcaagaactgatgaataagaacttgcattttaacaagagtcctaagtcatttatatgcacattaaaatttgagatgccttgttcaaaaatttatagacattcagtactgcccttatctccagaaagaaaaacatcaagcttctctcttgccacaaacttggctaattcaaaatggatgtgtttggtcctatttttttgacttttcagtgttttattcacttattccattatccctatctgttgaatgactatgcaccaagttactgtatcaatgcttgctaactaacggtgaggtcttcgccattcctgagcactggttggcatcatccacccactcacttgatgggtgatttctggactttggtcatcctaaaaatgactaaagaagacaactgtccctttattctgacactgaatatgcaaaggatcaatggcttacctgtgtgtttatttgagcttaaaagaaataaataaacccatatttagctagaagaacatgtatatcaagggtaaactgcctttatattttaccagttggctaaaaattttacataatgggtgaatgacttactcaaagaaaaacagtatgcatcgatactcatcagtcaccagagtctctttggctcatatcacttaagaaacttctaattgattactctatttagtttatatctgtcatcagtagaataaatataatatctatttaaaagttcccatagtgatcctgcaagagaaacatatatatataaaatataatatgtagaattatacatatacatattatatgtaaaattgaattttttatcatgcattaggccttgctagcctttgaggatgtataggtgaataacctaaacactcaagaaatgtatcaatgcaaagatcattaaacggttaatatctgtgatgactgataagaaatattacataaatatacacgcagaccgccatatgaatttttcatttatgagttggcagttgaatcagtatttctatcactgacaaaatggtttattgaataaccaccagatattttcatttatgtatatatatatatatatgtatatatatatatatatgtatatatatacatacatacatacatatatgtactgggaggttggtttattacaagaaaacgtacaataaattgagaaagttctaatggttttaaccatgttagttcaaggacatttattgagtacttactaagccagatcctggaaaatttaaaaataactaatattggtggagcaatcaatcaattaattaagaggattcattcacatacatgtataaattgatttcataatgtaaaatcataaactgacattaagtttcattattttgcccaagctacaggcagggaagtggactcacaaagatcaattggatgttcaggttacaaagttgatagatgacctggcttctttcaacttatcaatgaccttactcacatggccaacttgatttcaaggacgtgaaagaaagatttacagtgtcacagatagttatcttttacttcaatttaacctttaaagcagtgtatattcctcttgtcaacatatcctccatattattttgctacaaaacatagaacttgaaaaataccactacaattctattctcaatataaacagagatgaatggggtaggaggaaaggtggaaaatttgaaattgtgcgctattttgaattggaaacctaaagtaaagctaagataataaatgtagatgctgtcaggacaatagactccatattccttagagtagaaatttttgtaggttcatttcatgtgtttcttgtgctaggaacagttcctggcacacaataagagcccagttaatgtatttgaatgatcaagtgcaataagatatgtaagttatgtagtaaaatggacctggaagcctgtttcttaattcgttaaaaggggaaactgacttcatggacataatggtaagatatttcttttaaaatgcttggaatggttctggacacaaactaaatatctaatattttagttatatattatactagtaagtacatgagacagcaactttccagaattaaatgttgctacatctttcaaaatctgaatagaacactattattggccatttagcttacaaaactaaaattaatttttatttcatgtgacttgagtgctatagtcttgaatcttcttctgattgaatttatcttcaggagcttagaagaactatttcttagccaatttagtcaatcaagtatagtgtcattaatagcttccgaaccagtctatgacaggtacaatttttctcagctgatttaaaatctcagagaaattcattctctgtggatcctcaggaaatatacacatcctttcttccaagagaaaaaagacagaatgatgataacttcattaaaattactaaagattacttatgcatatactgtaaacagtgttgaccactattcagatagttaatcttgttaatcttcaattggctgtatttgagactcctccaaaagccataatttgaactttttgagctttcttcagactgattttcttgcttatgtactttatgggaatttaaaaataatgctcttttctttccttttaaaaaataaattactgaaaatcttccttcccaatttcaacccaaactaaactttaactcaggaaggtggtagtaatgaaatttaaactgcatctttcagagtggtacaagccattcactagataagtccttattacttaccacataggaagcagatgctgtggttcttctaaattaaaagaaaaacttggaagcttcttaaacacttgactgttaagaagtcaactgtattagaaaggattctgtttctaagctaatttgtaagttcctctgacagaatgttcagaaatttaaaagaaacaagttttctccatgtgaacatattgcttagtttatatcttctttgctattctaaaatatattagtttttcattatttgaacctattctcaatctccttttttcattctctcatccaactatgcttatatactatttttaatgctcaatgtattaactagtttttaaaacaatgctcttagctcattttttttctactttcccatttagtggattaatataatagaatttatgtatgaataattttctcaagtctatcatgaagtacttcacattggtgagatacttaaaagaggcttgatacttaataattaaattatattccagaggaaggtgtttcagaagcctcttgtgggcacctgtatgacgtcttcccttttcttttacttgctgctcaaatttgacactcaataacccaaaacatcttaagaaagaaaaacaggactatttatttgagtgtagtgggcaagtaaagacataataactacccatctcttctattctcatttccttggtttcagaacaaaatattctcaagcccaggtgctgatatggatgtgacaaatagcaaacctgagacaaataatggttcctttaagggccatgcttgactactttagccatgtccatcaagattcagacattttactgtgctctccttctcacaaacccttcacccccttcccatgccctaaccaatatcctgacattccaaacaagaacaggatctcccaggtcttatatcatagtaggggcccatttcttattgtctcatttttttccctaagacccacctaaaggatcagggtatgatggggaggtgattaggatgacagagtttaataaatcttaacaattaaagcatgctgtgccagagggtactaatcaatagaaaattatctccaatgcattttctattccagaccaaaactatccaatagtcacacctaaacatggcataattttctccgtttgttaggtgaagtaattataaccaacattaatgataaatctcatatataaacttatacatgttttgttttcacatatcccaaagctagatgaccatgatataattttgaaaaatctcctatgtggagagaaaaagtagtatttcctttaatggcatgtttcagtaaagggctgcagagtaattctcttttttgcaactccctccccaatattttagcagtattttgatgaattgttagcagaagtgtatttggagtgtaaatttctcaataaataaattccccattttatatggtgttgtcacttgtttattaaagacaattatggtttatcatgtgtgacaatgcacaagtgctaagaatacaaagatgatagctgcagtcccttgcctagtgaatttcttactctatctggggagacaaatgagtaaatgattacagatcattgcaattagaatgtaaagggatggcgacttacataagatgttgagagtacaaattatctctaacccttggtggaaggaggtcaggaaaggcttccagagaaagatgaagagtgagctgagtcttagtaaatgggcatggtatgttgaaatgtagcaaaaaagagaaaggacatctaaaaggaaaaatgatatatttgaggctacaatgaaggcagaaatggaggaagaaataaacaagtggggtcatactcgagatatctttacaaaatagaatcaacaggactctatggacaatagagatggctagtttcattattagaacctagtcccaatccccggtttttctttcttttaactaaccatgcttatgtactatttgtaatgctcaatatattatctggtttttaaaacaatgctcttagctcaaatttgtttttttgttttttaatttcatggattaatgtaatgtttatgtataaaaatatttttcaagcctatgatgaagttattcacacttgtgagtatggagaggaatcttagaagacttctaaccttctggttggaagagtaggtgaagtatggtatcatttactaatataggaaatgtgtggatgatgaaatagtatatcatgaattcaattttggatttaagtttgaatttcctgaggtatatccactttgtttcagaaggttagatatgtgactcagtagtggaaaaggtccatttatcccttgatattctattcttctccatattttcaagagaaatttgtgatgtctggaatggatgcgccctttgcatggcctttgaaggaagtatacctagcactacatttcaaccaaatcttatttctgtggctatgatcagaattaaactcatccataagaattcagtttcaattgataggtaagcctgattggccaaaaattcttgggagactgaagtgcttagcacatactaaatgtttactgaatgaatgattggataattaaataatcattgtataatgtcagtattatacaaagatccacataaaaaaaaacttcgaagtagtgtttctgattaatcatatctacttctctattggttctctattaacttcctctaatctttcatgctcgatcatggtgcaaacaaaaatttgctactaaacagtctcttcaacatcactttaatcacctttgaacatcaagaggcagaacacaaagggtttctcactactcatttgaggcaaaatatcagataactgtctgagatgaaaagtgagaacagaatggtcaacagtaagatgcttgaataacaactaaaaatatttcatagaaattattgtagtgcagcctcaaaaaaaactttaaaaataatgggtgcctcgaaaacttagcataatatatagccaatgcataccaactaggatgaaaaaggcatatcaaccacagaccctgttacagataatcttgtttaaaggactttccaaacactctcttatcttgcccattattgctgcttttaaaaataaaaaacaccataaataatatttctacttcttatctatcaggtcacttttctatctatcctgacatgaagcaaaattttttccagaaatttgttctaattgtcagagacaattcttgtttaccaaatggcctttaaaagactaaagggaaattttcaaagcatttaccatttctttccctgatgttcagcattgtgtaaataatattaacacacatcattatctatgaaatccctaagaacatatttccaaaattatatacataaaactatattattttattcaagtaactttttacagcacatttgataaatgagactgccttatatgagaatacctctataagtaaggaagaaaaaagaacgtttgtgaactctaattcatacacagctcagaaggcattttctcttagagtcttatattatattttatatatttaacatttatatttccattttaatcttgataattaaaagtttcatgaatctcagaaaacatgtctccgaatcataatggcttcaagtaaaatgtagtaacatttctaaactgattgaagcatcccattaaagtccttatgatattttcttgcatccccctaatggtcttcttattgaatatatgtggtagaaagtttagatattaatcttcaagtcaatttaaatggtaaaatgcctgtcggatggttctttctggctaagatgtatatctacagcaaagtcaacctctgctctgttctaagtagtggtaggcatagatatatctgcatcagaatcactggtcttaaaaacaagatttgttaatacgcccttaaagttaaacatgctctgatagattaaagcagaaaatctatcacgagttgagtaaatagatgtcttaaagagcagtaaacccaggagaaaataatgctgcaacatttcaggttgatttttatctgaactgcatttccccattaagcaatttactcttgagatttaaattaataaaattttaaaagttttaatttgccattcattcatcttttttttttttctgtttgagacacagtcttactccatcacccaggctggaatgcagtggcgccatctcatttcactgtaacctccacctcctgggttcaagcgattctcgtgtttcagtctcctgagtagctgggattataggcatatgccactacacttggctaactttttgtatttttagtatagatggggtttcgctgtgttggccaggtcggtctcaaactcctggtctcgagtgatccacctgcctcggtcttccaaagtgctgggattacaggcatgagctaccacgttaattgataaataataattgtgtatatatatgaggtacaatgtgatgttctgatttatggatgcattgtagaaagagtcaatcaacttaattaagatacctatcacctcaccaatttttcattgttttgtaataagaatataaaaaatattttcttttggcaattttaaaatatataatacattatagatgcagggcaggtgagccccaaagtgaagcttagcctgcaagtgttcttggctttgcctaggaaagaattcaagggcaagccaaaggtacataaaaatagccttattgaagaggcagcattacagctctggggatgttaagctctgtgactgctcctgcagagcagcgctagtccataggcaaagagtagcatctcaggacagttttgtagtcatatttatacccacttttaattgcatgcatattaaggagcagtctatgcagacatttctaggggaggagtagtcatcactgagtcacatggaagggggcagtaactcctgggtgttgtcatggcaagggttaattgacatggcacactggtgggcatgtctgattgaaagctgcttttgccctggccctgttttagctagtcctcaatctggtccactgtctgaactctgcctctggagtcaagtcctgcctccttcctcatttcctgccccctcaaagattagatactcctccttaatcttaacggactgcagaagggtaagattcattttctgtaactgcttcttgctgagtttatgggagtaggccctgcctagcactggaggagtaaaaatctctagatacctgctgtaaggggccagaagcaggacacttccattctccaggtcagtagatggaattgcttggaagccttgtgccagcactgtttttacttggtaaaatcgtggtaatctaaaacaggggtccccaaaacagggattcccaacccccaggccattgactgttattagtctgtggcctgttaggcctgcacagaaggatgtgagcgatggacaagccagtgagcattattgtctgatctacacttcctgttagattaacagcagcattaaatctcatatgagtgcaaaccctattgttaactgcgtgtgcaagggatctacgttgcatgctcattatgagaatctaatgcctgatgatctgaggtggaacagtttcatcctgaaaccatcacccctatccacacccccgaccccaggctgtggaaaaattgtcttccatgaaaccagtccctggtgtcaaaaaggttggggaccaccaatgttgaagacacaaactttactaggaggttaaataagcaagggccaatattagtaacaagatagcaaccaagttcctaggagaggtaaaaaccaggtaagacttgggaaggcacttttgatagttggccagatatagctggggtcagtgccctggttatatctatgtaaccaggtagctttctcatagaccttttgaatgttaatctcaacttgtccacggttgttaatatatgtgtagcatgttttattattaactttacagaatccactgtgttcagccggtaaataatccaacactagtctattatcaaaaactacatttgccaaatggtctaaggacacttgaattccctttaatgcctgacctgtgttggtagctaaggtttctagggtttgagtcaagctccttaggattgacttatggtagacaaagcctccccaaggtgctgctagtcccatcactgccttgattcctgccggaatcaaccctattgctagcttacttctggtattcgtgggtcttatgaaataatggacagtgacccctgggggacaacgctggccaatgtacattcatctctgttccaagtttttgatgtacaggggaaagctactcctaagacaacaggtgactccctagggagttcctaaaggttacagtgtttgacttcttcccattcatgaccagaaacaaaaatgagcccagagggggcacaaacagaagccctacagggtgtgatgtttatcctttgcttccaagttgtgtctatagagatattttttccctgttccaatgggggtggcaggacaatctttatttttcagaaggggggtactcctacctttccagactaggcagtgatttttcccttgtatgttgtgatctggaagaatgcaccatatatggtctcctaacttacaagtggaatcccatttactttactgcagccttgggaacttgccaactgtagttgaatcaaagaatcacagggaaacttctgctgttgtgtcattaacacaacagtgggtgcaaatgataaactcatttgtgcactggagatatagatacacaatttttcaggtccaagtaatagtggcaggaggattcaggtataatccgttaagtggggagagttctatttaccaagcaggggtttgaatatttcagcatcactatggttagttaggtctggggtaaaaaccaggtaagatgtgggaagtgagacttgtagtgagtgattttccaagtaagccataagatagacctctctagcctgggaatgttgatgaaaaatccagcaactgtgaagatgatttcctgatgcaataattgttgaaatatttactatagagttatgttcccacccatactggatcatagtaactaggggagcaaacaggatgaacagtgacatcgtgattcagctgggccttaacgtggtctctatgcccaacaaagacaaaagagatgtttcccaagggattggctaaagtgatacaaaggaagtattacaatcaggaagaagagaaaaattgtagctcccattcccacccacagcatcatgttactacttctggctgagatgttgattctttaaatagcagaggtcccccaaaggttcacagatgtaggtgttggtgtcccccttttgtagctgtgactcgtaagacataggttaaccctggacagatgtactcagctaggtattccctgaagtttaacagcagagggggtactcaatgacacctgataagggcccttccattttggttgtagttgatcttcaggggattcttctttccaagttttagcaaaagtaagtctcctggctaaacaggggagctatttttcctctctgaagaagagtaatattttatttttatagtggaaagccttttgaacctgacctaaattccaaaagggaaaagggaagtttgtatagctaattactataagctaagaccacagcagctaaacttgtccacagacaagtaatttttataaatacatttcctggctcctagtctctggctcccacactgctaaaaaggggttcaagggccaataagtgtccacccacttccgctctgatccaggccagaacatccaactggctacaagtcccctggctccaaatgccccagccatgggggtcccactgagggacattatggacccagggcaggcagcacatgaccttgtcatcagcataggacaaaataaaacatggccattgatgctgcctctagcacaccatgacaaaaagaggtaatacaaaacaaaaatcaagatccatgggccgaagggaatggagttgagcaggtacccactagccccaaaattccttctaagcaacttaagaatcaaaaaccaaaagccaaaatgagattacccattgaggaaaaccaacagcatagaattaagctgtatttggaggaaacactgctcccacagatctctaggacaaaacactttaccatcagaccacaacagcagtcataaacagaggagaaaaattaacaggagctgacaaaaaagctgaaggagagagttacatggatctgcatagctttcaaaagaaatatattgcagaattgaaaataaaattttctggtaatttagcaaattaatacctttagaaaatttgattttgatatttaggccatttgtaaaaagtttttttacaaataattttctttaatcatagcaagtttttaattttacacaaagttccctttataaattccccatttatgaatcttatcacaaattacacagactatctaaaacttgcttgaaatttctgacttgtcctatactacctctttcttttttgtgtgacggagtctcactctgtcgcccaggttggagtgcagtggtgtgatctcggctcactgcaagctctgcctcccgggttcatgccattctcctgcctcagcctcctgattagctgggactacaggtgcccgccaccactccaggctaattttttgtattttttagtagagacagggtttcaccgtgttagccaggatggtcccaatcacctgacctcctgatccacctgcctcggccttccaaagtgctgggcttacaggcgtgatccaccgcacccagcctatactacctctttcttaaataaccagtcatgttactctaggacaaaatatgactatacaagatccctcttcatataaaattactcttttattatatgctttcttggaaaagaaaatacattttttttgacagagtctcactccaccacccagacaagagtgcagttgtgcagtctcggctcactgaaacctctgcctcttgggttcaaatgattatgctgcctcagtcccccaagtagctggaattacagatatgtgccaccatgtctggctaatttttgtatttttaatagaaacagagtttcaccatgttggccaggctggtctccaactcctgaccttaagtgatctgcctgcctcagcctaccaaagtgctgagattacagttgtgatccactgcacccagccagaaagtactttttctttccataacattctttacatctctctttttcactcactggttccctcatattttgaaactcccttttaataacttccaaattagacaaaaattattttttccaaataaaggatatatttctttggcacattttatataaacctagaaaggaagaaatcctgaactgcccagcagacattgacattctataggtgaggattattctatcattttaagactttaaaccacacaataagttcattatttaagcatcgattccgttctttcacttttaacagttttatctagaccacttctaagaaacaagataccatgcaaaacatgtcaccatttaaagccattttaaccattttaaagccaatgaacatcagtgatttacttagataaaaattctgttaaattttagaagacataatattctcttcaaactagtaagctttgactagtcttatttaatttatgagtgctcttttatttataagccaatttcaaagcatgctagacacaacacatatcacaatgcctgtagatagagctaaagaaacacactagataaaatgacctatacaagacaactggattcaagttatttacaaaattgggacccagctgcctgactaaattttgtttgcctcaataggtgtggaaaatagaaagagacagggaaggggattccatagcatcaaataaagaagggaaggagtgaactgcattactcaagggactatcccggagtccctaaggcaccagagagctcacccagtagtggagacactaaagaaaaatgttcaggcagctgtttatctgccactgtgggaaactttccactgggtcttgggtccaagactcccagtaaacttacctgagcaagacagcttgcatcttactggggacagtgaaagagttagctctggagttggtggagaactttttttctgtctctcaccagggatagtcaaaacattcttattgtcaatggccctcttgctcatagcaggcacactgattctggctctggggcccccaagttgatagctcttgtctgggcatcctagacactggcttcactacattgactcaagatgggtaactctgagggaaaagagactaccccataggcagagagtagcagctcagggcagttttgcagtcatatttatacccactttcaattgcatgaagattaaggtgaagattatgcagacatttctatgaaaggggttgtaatcactaggacattgccatggaaaggggcagtaactcctgagtgttgtcatggcaatggtaaattgacatggcacgctagtggaagtgtctgattgaaagctgctttcactgaggccctgttttagctaggcctcaatctggtccagtgtctgagtgccacctccagagttgagttctgccccctacctcattattattgactgtgatcgccatgagaacaatagattactaaaacttattcctccagtttaactgaaactttgcacccttttatcagcatcatcgcttttcccatctctccctctattctctaccctctggtaaccaccttcctattctctgtttctatgagattgacttatttagattccacatataatcatgcagtatccactgatgttgcaaatgacagaattttcttcttttttttaaggctgtatagtatcctattttgtgtgtgtacgtgtgtgtatatattatatataatatatataacatattttatatatatacactatacatacatactatatatagtgtatatatatatacactatacatacatactatatatatatagtgtatatatatatacacacacacacacacacacaccccccacatttttaaatccatatatttgttgatggacacttagtatcttgcctactgtgaataatgctgaaatgaacatgggagttcaaatatctctctgacatcctgatttcaattcctttggatataacagacgtgaaattgctgtaaactagctgaaaattgctgaatatggtaattctagtttttttgaggagccttcatgctattctccaaagtgcctgtactaatttatgttttcaccagcagtgtacaagggattccttttctcctcattctcatcaacacttatcattcatctttttgataatactcattcagacaggtgtgaggtgttatcttattgtagtttaatttatatttcccacatgattagaaatgtcaaacatcttttcacatatctgttggcctttcatatattttcttttgagaagtgtctgttcacatgctttgcccattttaaaataaggtgtttgttttctgttattgaaatgtttgagtcctcaaatctctttgcttttagccctttatcagaagtatgatttaccaatattacctcccattccataggttgtctcttcatttttattgttccgtttgctgtgcagaggctttttagtttcactcaatcccattagtttatttttgattttgttgcctgtacttttggagtcctacctgagaaataactactctgaccagtggagttcttccggtgttttcttttagtagctttacaatttcaggtcttatattaagtcttctatcaattttgagttgattttatgtatacactgtgaaataagagcccaatttctttctctgcatgtgaatatccagttttcctggcactgtttattaaagagattgttcttttcctattgtgtgtttttggaacacttgatttttcctttttaattcctttgctaattcattgaatgtgacctttatatttttattttaaaaattaatctatgcataatagggtataaatggaaacatgccattgacattttgtttgcttttaatgcaattaaagaaatttggaaaatatagaaaatataataactataataaaaaataaggctaaaatccctatcattacaataaacatatatgggtgtgtgtgtctactcttatattgctactcactatttgaaacatattccatcatacacagccaattattacctccattagaacatcaagtctattatttgattttgtttgttaaaatattttttcttatataaatttgatttcatatcatatattttatagacctcaatcacaaatgtctaatttgaatattactgtcattgggattgaaaagttgacataccatgatcaacacaagcatgctctgtttttagctttatctattgatgtctcagtagactgaaaactttctctctgactctaattaagccttatttgctgaaacataatatatacaattacgtgggactcagaattgtgacaaacagccattcctttgtgttacatgaatgctcttaaaaaaagcaactacggttatcaaacagtggttctcaaatttcaacatgcatcaggtacacctggaagattaaatttacatttctaataagttcttatgtgatattgttgtttgagaaccactgccttacagaattctcccccagtaatctactcttgggcttactattgctgcctaaatatagaccttagggagtacgtaggcttagaccatggatagacagacatatacagacactgtattcattaatatatttggatatgtgcttaactgtgaaatgtcttcagatttgaaatgggtccagtatcttaactgaatatacgaattcatgaaactggaaatgtaaaagaattaaaagatgtttatattttattggtgagatttcatcattaagacctctttgcactctttctgtgcttcttatctgttgattaacaaattctaataaattatccttttatgcactatatgtggtgaatgatgattttatcccttcagagcaataatttgtacatctaagtggccatcaggatcatttgagaaggatgttaagtgacaaattcctgggccccacctccagagtttctgatttgataggtctggaatggagtccaagtagctacatttctagcaactccccaggtgctgctgctgctgctgctgctctggaaagtacactttgaggaccattgcactagaacctagactgacaaggacttctcagtgggaaaacacagacacacaacactcccccacatgctgaagagtttgtgaaacctgatgtgtgtgtgtgtttttttaattcctcgtattttattttattttttcataggttttgggggaacgggtggtatttggttacatgagtaagttcttcagttgtgatttgtgagattttggtgcacttatcacccgagcagtatacactgaacccaatttgtagtcttttatccctcaccccactccctccctttcaaactggtccccaaaatgcattgtttcattcttatgccattgcatcctcatagcttatctctcactcatgagtgagaacatacaatgtttggctttccaatccagagttacttcatttagaataatagtctccagttccatccaggttgctgtgaatgtcattaattcgttcctttttatgtctgagtagtattccaccatgcccgacctatactacaatttcttcatcaactcattggttgatgagcatttggggtgattccatgtttttgcaattgtgaattctgctgctataaccatgtctgtgcaagtatccttgtagtataataatttcttttcctctggatagatacccagtggtggaattgaaggatcaaatgatagttctacttttagttctttaagaaatctccaaactgttttccaaagtggttataaagcttacattcccaccagcagtgtagaagtgttctcttttcactgcatccatgacaacatctattattttttaattttttgattatggccattcttgcaggagtaaggtggtatcatattgtggttttgatttgtgtttccctgattattagtgatgttgaacattttttcacattttcgctggccatttatgtatcttcttttgagaattatttgttcatgtccttagcccactttttgatgggattttttaatttgtttgagttccttgtagattctggatattatttctttgtcagatgtatagattgtgaagattttctcccactctgtaggttgtctgtttactctgctgactgttccttttgctgtgcagaagttctttagtttaattaagtcccaccgatttatcatagtttttgttccatttgcttttggattcttgttcatgaagtcttttcctaagccaatgtctagaagggtttttctgattttatcttctagaattgttatagtttcaggtcttagttttaagcccttgatgcatcttgagttgatttctgtataaggtaagaaatgaggatccagtttcattctcctacatgtggcttgccaattgtcccagcaccatttgttgaatagggtgtcctttccccactttacgttttactttgctttgtcaaaagcaatctgtaagtatttggctttattttggggttctctattctttcccattggtctttgtgcctatttttataccagtaccacactgttttggtgactgtggccttataatatagtttgaaatcatgtaatgtgatgcctccagatttgttctttttgcttagtcttgctttggctctgtggctcttttctggttccatatgaattctaggatttttttttctagttctgtgaagaataatgatggtattttgatgggaattgaactgaatttgtagattgctttgggcaatgtggtcattttcacatattgattctaccctggtcattttcacaatactgattctatccatccatgagcatgtgatatgtttccatttgtttgtattgtctgtgattgctttcagcactgttttgtagttttccttgtagaggtgtttcacttccttggttaggtatatttctaagtattttaatttttttgcagctattgtaaaagaggtcaagttcttgattcgagtctcagcttggtcactgctggtatatagcagagctactgatgtgtgtacattaattttgtatcctcaaactttgctgaattcatttatcagttctaggggcttttgggagaagtctagggttttctgggcgtataattatatcctcagcaaacagcgacagtttgacttcctctttactgatttgaatgccctttatttctctctcttgtttgattgatctggctagaatttccagtactatgttgaacagaagtggtgggagtgggcatccttgtcctgttctagttttcagagggaatgctttcaactttttcccattcagtgttacgctggctgtgggtttgtggtagatggcttttattacatttaggggtttcccctgtatgccaattttgctgagggttttaatcataaagtgatgctggattttatcaaatgctttttctgtgtctattcagatgatcatgtgatttttgtttttaattctctttatgtggtatatcatatttattgacttgtatatgttaaaccatccctgcatccctagtatgaaacacacgtgatcatgatggattgtctttttgatatgctgctggatttggttagctagtattttggtaaggagtttttgcatctatgttaatcaagaatattgatctgtagttttcttttttgttatgtccctttcttgtttgtattagggtaatgctggcttcatacaatgatttagggtggattccttctttctctgtcttgtcgaataatgtcaacagaattggtaccaatttttggggggggggcaagagttagtgcattttatttattttttattatactttaagttttagggtacatgtgcacaatgtgcaggtttgttacatatatatatatatatatgtgccatgttggtgtgctgcacctattaactcatcatttagagactgaaatggtaataaaaaattaccaatgaaaaaaaattccaggaccagaaatattcacagcagaattctatcagacatttaaagaattgggtatatccacccaattcctggaattttttttcattggtaattttttattatcatttcagtctcgctgcttgttattgatctgttgggggtttctaattcttcctgatttaagctaggagggttacatatttccaggaatttatccatctcatctaggttttctagcttgtgtgtgtaaaggtgttcatagtagccttgaataatcttccatatttttgtggtgtcagttgtaatatctcccatttttgtatctaattgagcttatttggatcttctctcttgtttccttggttaatcttatttatcttttcaaagaaccatctttttgtttcatttatcttttatatattttttgtttgtttcaatttcatttatttctgttctgatcttagttatttcttttcttctgctgggtttgggtttggtttgttcttgtttgtctagttccttgaggtgtgaccttagattgtctatttgtgctcttttagactttttgatgtaggcatttaaggctatgaattttcctcttagcaccacctttgctgtgtcacagactttttgatagcttgtttcactattatcattgagttcaaagaatttttaaatgtccatcttgatttcattgttgacccaatgatcgttcagaagcatgttatttaatttccatgtatttttatagttttgaaggttccttttagaattgaattctaattttattccactgtggtctgaaagagtacttgttatcatttcaattttctgaaatttttaaggacttgttttgtggcccattaaaaaagctattccgatgatttccaggatcttttcagttttaaaattctttccttttgcattataaaatttataatgtcctactgctcttataccaaattattatcttgtattaaactttaatggacttacttaatgagtctttataagatcacctaaataaaagtttttccagtgaagatctttatatgtgttatatgccccaaataatattacacttacaaattttacaaaagtcaaattttatgataatgacttatattgtcttgacaaagttaaaatataataaatctctgttgaggaacaggactaatttcctcatttgatctaatagagcagtttctgtgacataattaagcaaattatgaattttgtgaataaattcatgaaagttcagtttgttacttgtatttggaaagtttacttttttctacttttacaatgaaaattctaaaccacataatatataggctttagcgcactctagattggtttttgatatgtttatctcacattgtagatgtagttatacagtttaatataaatataacagaaagtttctttatgaatgaattaatatagtaatttgacaaatatctgttaaaatatgttaaatctatttacagatatgtggatcagaaagattattaaatgatattatttcactgttgatcactgttgattaatcatcttaggaagaaatttggtataaaacagattatgtacaagcctttattgacattattcaataatgactgtggagctagaattgttaacaggctaaactatatagacttatagaatgtatatatagaacttatatatgtagaactatatatagttcattgtagacctctgactattgatacatatataaattctgaagctgagcctgtagatgcatcactcccatcctccagtctctgcctctgttgtcacacagtattctctctgtgtgtcttcatattacattccctctatgtttgtccatctctgtatctcttttcctcttttgatcataacgctagtcatattggattagggcccaggataatgatctcatcttaacttaattataactgcaaaaactctatttccacacaaggcacattcataaggtactgggcgtctggacttccacatgtattttgggagacagaagtcagcttctaatggatagatagtataaagagaaagctgaataactagagagatgttatgtgaatgctgatgaggttgatataggacatggcatgtagacaactaactcggaaaccaaattttataattggacagctttgtgggaataggcaggtgtcctgtgtttatcacaacttggttttataaatagcagaactattaagtcaacattttcttaatctagttgggctttaagagcacaactgaacacacatattttcacacaattgtatgtgtattttagggttttttggtgtttccattcatgtttcttagaggattgtgtcaatacatgtgttagattctcagaaagaaatatgactatgtattatcctttcctaccactggagagaatctccataaccttgattttatccttacatttagccagagcacatagctatgtccctaaatcacatttattgggccaaaagtgactttcctcttattgaactgtgctttgtattgtatctctggtgcatgttaagagcagtaggtggggttctgtaaaagccatcacacatttagggtaaaaatattgctgaggctgttatttacattaacaaaaggttatttacattaacaaaaggttctcagccttttgttctgagaacccaggaaacaaatttatctcagttatcattgccagtgattactctgcttctcttaaacagagtaagtatttacatcttaagaacactgtaaatggtttaacatttgtgcttttttttccgcctgaatatcagaaagatgagaggtaaatttgcaacccaagtcaaagaaactatgcagtaactgtaacatgtattttgtgtttaatacaattcctaaatttatatatttttctacattcatttttgctcaatttctcaattttttaccttatttgttttacttatttatctaatgagcaaaaaaagaatgagagcctatcttatcaccatgtattaggaatcgcaccaattccctgcattcaatgatagatacacatgaccactgtccccaaatatctcacaatgtagaaaagaaggcattcacttaagttgatacttgcaatagattatgactaacataatgataaagagatctaccaagtagtattagcacataaaaggagtaagcaattccgctgcatcagaaaaaggcttctgagaaagagacagctaaactaggccttaagcagaggttagccaaaaaaaaaaaaaaaagaaagaaaagaagaggaacaaaaagaaaatagtgaggggactaaaccctgatgatgaaaaaagtcaaagaacatctagatagagagatactatatgtagataggaagattcaaaattatgaaggtgtcaattctttccaaattgacctatagagtcaatgcaattatggaaaattcccagaaaattattttgtgtgtgttgacaaactgaatataaagtttacgtggaatggaaaaagatccagaatagcaaacacggtaccgaagacaaagaacaaagttggaagattgacgctattgaacttcaaagcttattataaagttttaaaattctttccattttttctttccttggcctcaagtagtttatttgtgtgtatatgctgttcagtgctcttctgatgacttaatgtcaccttccacacatctccagaactcccttcctcttctctgctgctctctgctctaccttactctgatctgtgataactgactgtcttggcctttccagactaccagctccatcttataagctccgtgatttgctaggcaactcattgctgcactaaggccttgtaactttctccaagcactaagcggaagcaatcacagggtacatctcatttgtttcccatcactaaagtatcactgttctttgttgtctgatgttcaatatctttaaaaccattgttttatgtattttgtctgttttccttaatttccagtatgaggagtaattagacccctgttatgttatctttgctaaaagaaaaagttactaggatagttttgaaattaaaagaaggcagtattaatatttatctcattacagtagagcatacatattatgtttacctttcccaaaagccaagtgaacaggaacttaaaaagaaagggaaagtgatcaatatggtcaaatatgttcattagtcttggaaagtaatgggaaattggtgaccagagagactaatccatagaatggtggagctagaaactagattacagtgaattaatgatgaagtgggagtgagaagtagaaaaaacaagtaaagatgatattccttaaaaagttgagttgaacagtgacagacaggtactagatggcatttgtaagaaaacagaatcagagaaaagtgttgactattcaaatatttgttgatgcaaaaaagagagaaaattaaaactgactatgaatagagcagaggctgacaaaatggcccacagactggccactagtttttataaagttttattggaacacagtcagtcatatttatttacattattatctatggctacttctatattcacacaaatgaagaattgtgagagactatatggcctaaaacctgaaaatatacactatctgacagttacagaaaaagtttgccaatcttgcactaaagaacttagccataagttacacattctatagaatttcaacaaaaaaggataggtggggtctacattgtttcatttttattttcaaatatattatatcatattcaataatgttaatttaataagaattgtatgactcagcctttaataatttttttacttttttctaggcaaagaagtcaagcctaaacctccacgtatgttatatgcatgctcaataaacaaacacgtacatatgtacatacatacataaaacaaatcttaaatgcatgctgttatttatcttgatttcatgttgaatattttgcttaaagtcaaaggcttgttttgtgtagacaatgtactcattttcttacatgtatttctgagaaaatgctataccaaaattttcctttatcttttattcactggaagcatctttccttaccttgtcattaaaaatctcagctcagatttccattattttctcaaaaaaaatttttttgagacagagtctcactctgttgcccaggcagtgggcagtggtgtgatctctgctcactgcaacctctgcctaccagcctcaagtgattcttgtgcctcagcctccccagtagctgggattacaggcacgcaccaacacacctggctggccttccaaagtgctaagattacaggcatgagccaccatgcctggctctcaaaatatttcttactggaataatagtgaggaatctgttgttacgtactagtttgccacaatcataagaatatggttaatatgacatgaacttttcgaagttaataggagattgaaaccaatgaataacatagaaaataattatataaaaataaatatgcacaagtatataggaaatgaatatctttctataatcattgttactaatgttcatctatatttttagaactacaaggaaaaaaggaagagaagccaggtatgtatattttatttatacacatatatgatttccatgtttagaataaatagcacaatatctctttgcaaatgtcatgtcctagtacaaatattttatcaaattttatccttgaccaacttaaaaaaaaactaacaaaatatatatttctctatgctacccatttctagaaaaacctctatttgcataggtgaaatatctgagaaatttacatggttcagaagaagtaactaagtaattgaattgattcccacaaaaccaagattttctctgattattgtaggacacagacattcaatcagcaaaacatctgctctcatccttctctcttttgaggcttctgagtcagatgaacatttctgaaggctacagtaggcagtagaaactttttcaaaagaacactcaactgtctggttctgaacacagttaaaattttgtttaatgtttcataattgtattattgttgtagggctactgtagtaaaattccacaaactgggtggcttaaattccacaaactgggtggcttaaaacaacagaaatttattgtctcacagttctggagagtagatgtccaaaatgaaggtgtcacaagggacatgctttccatgaaatctgtagagagaaatccttccttgcatcttctggtgttttccagcaatccttggtgttccttggcttgtagatgcatcactttcaaactctgcctccatcatcacatggaaaccttctccctttgtgtctctagctctgtaaacccttctcctctaataagtacaccagtcatattggattaaatacccaccctactgccccatgaccacatcttaactaattacatctgcaataaccctatttacaaacaagttcctattttaaggtactggaggttaggatgtaagcataccttttggagagatgcaattaaatccataacagtccattctctggctggcccaaaatttatgtcctccataggtgcaaaatatgttcaccccatcccaacatttctaaaagtcctaaccattctagcatggttctaagtccaaaatttcatctaaatatcaatcaatagttcaaaatctcattatctaaatcatctaaatcagttacatataaaacttggagtatgattcttccttcagcaaaattcctcttctctttttgaacctgtgaaaacatgaaacaaattatttactcccaaaataaaatgatgagatacgtataggatggacattccccttttaaagggaagaaattgcaataaaataaaaagaggtcctgagtcctaagcaaatccaaaacctagcatatttcaaagcctgagaatattctttctggctcagtgctctgtactctgggactggtggaacagtggccctgtcctcttagctcagtgtgctgacagccctgccttctccaccacaggaggtcccattaacccaggcgtttgaattcatggcttttctctggagtcattatcccttcattttatcatgtctctgtcccttttttgtccaggctggcattgtttttgcttctttaaaattctcgaaaacctgactagtgtcacattcaattcatggggcgtctaagccattagataagagggtcctccacagatgtttcctggataaccacatctctatttctgtcttctgctgaagtggctccatgagtcatacatctaacctctttagcaaaagtttgtccaaccacaaccttggctctatctccatggcacactgtctagataggctgagaattttcaaatcagtaagtgccagttcttattcgattaacggtatcttcttcaatttatgtgtatctttcttttcacattttattataaacaacaaggagaaatcagtttgcaccttccatactttgcttgaaaatgttcttagctaaatttttaagtattcacttactatttccatcttccacctaacagaagaacacaattaagctaagttttttgccactttataaaaaatattacctttcctttagtggccaataacatgttcctcattttcttgagacctcatctttaaaactcatatttctagcaacattctacttctacttacaataatatatatctatatgatttgaatgtgttttctcaaaatttatgtgttacctgtgtaataaatagtattgacagctggagccttgaagaggtgattaggccataagagctcctcttttgtgaatgggaacaaggccattataaaagaggctccgtgcagtgttcagctagcctgctgtcttccccttttggctttgccctgtaaggacacagcattccttctctctgaaggacacagtaacaaggcattatctccaaaccagagaccaaacctgctaataccttaatcccaaacttcacggtctctagaagtataagaaatacatttctgttctatgtaaattacccagtctgtgatattctattatagcagcacaaaatggactaagtcacaaatgtatcatttaaaatgacaagagctttctctatagctctcttgagttctttctgagccctcatcagaataacctttaatgtcaatatttctgccaataatctcttcaaagcaatctaggctttctatattaagtgtctcaaaattattctagactctacccattacccaatttcaaaaccacttttacatgtacaggtatttgtttcagcagcacctatgttcctaaaccaaaattgattagtttccttggatggctacaataaaatatcacaaattgtgttgcttaaaactggagaaatttttctctctcacaattttggaagttaaaagtccaaaatcaaggtgttgacaaagcaacacttctttttaaaaccgtagaggagaatatttgtttgcttctcctagcttctggtgttttctggcaatcttcggtgtttcttggtgtgaagatatatgacttcaatctctgcctctattatcgcgtggtcatcttctctatttgtgtctcttttcctcttcttataaggacaatagtcatattggattaaaaacctacccttctctagcatgacctcatcttaccttaactaattacatcagtagcaaccctatttccaaataaggttacattcttaggtactgggggttaggactcaacagattgtttgggagaacacatttgagccataacattatttgtctcaattcctaaatcacgtaagtacccaattagatctatttcaaagagtctcttccaactcttgttgttaaaataatttatcttatgttgactttggaactattttctgcaataatcatcttagaaaaaagtagaaaatttagatttaaaagaatgagctatagcaacaatttcacagacaagtgcaaagcatgtttctgtttcatgtttaatagtccatcattggcaaaccagtgtaaaactggtttttttttgaaacggagtctcgctctgtcacctaagctggagtgcagtggcatgatctcagctcactgaaacctctgcctcctgggttcaagcaattctcctgcctcatcctcccaattatgataaccaaataaaattatttctaaaaattaattttcattctagtttattttttcaggttttaaattttctgccttttctctccctcagagccccaaattaaaaaagaagcaaaaccaggtaacatgagctttattttatatagattcagagttgacattatctttattttattaagtactaaaagaggcttacatctcactagggagacatgcacatagtctccaagttcctcattattttgtcaactccattgctcaacatgattttatagcactggattaggtgagaatgggaatattccctagactaaaacacctagaaaatggccttaaataaatctcaacagagactctaggtttctggagacatttctaaggtttttatgaaattaataataatcatgcttaacttatggctttattttcataattctggtggctttgtttttataattctgaagtatttccagtaatataccagaattataaaatcataaagttatagactattgtggtttgaagggaatgagagcaagaatttattaagcatctattgtgagctaaggactagcataggatttttactttcatcatatcattatgagaaacagacagcatggccattattacctatacttaatatctgaagaagcagttcaatagatcaagttcagaaaataagttattattccaggattttcaagttaatcaatgttgaagctaggggtctgccccgtgtctgatttgcaccaaaccctgggtacccccattaagagattgtccctaaaatgctatcattttattagaaggtagcattgacctaaaaaaaagtatgacctttccaagtctacattgttttttagtgtttaagtcatacctctggtaccaactagcaattgacctgaggcaagttcaaaaaaaccctcaggctctatggtagctatttcttcattataaaagattacttagcaagattcttcaatatcaacaaatcaagaatacaaatctagacacatattcagtagtacctcagcccctgaattctcaccagaacttacctggcaactgatcataagcttgaatatagttgctcttgtgatatatttacaatatattaaggatcataacagccttgttacattacaaatattattatgatttattagtattttattatttattttcctgattatatttatctgctgtaggtggatatgttttaccagatataagcattttgtatttttgccagttttacttttctttaaccagaaacccagtactatttaaagctagttatgcctagttctatttacaataaccagttgtatttgttattgttaaatactccattttgcaggtaatttaatctaatatgttatttatttattttagctatatctgaaaaagtgcaaatacacagtatgtattaattttatcttttatgcttagactttcttacgaaaaaatattgaaacgttttcaaaatcatgtattttcaacctgtgcttttatatttatgttttattacagcctgtgttttgaaaactatagtttcaaaaattttgtaaataagaattcttggcatattgttttcatgaactaaaacctttaagttttacatagaaacaaggatgatatgaagatttcagaatattttttctctatgggcacatttgctaaaatctgctagctattttcccagcttctaaatacctaaaaaagattttctttttattattttcagaacaagacatagtgaaaccagaaaagactgtttctcatggtaaaccaggtattttgcaggtggtatttgtagtctcaaataacctctcaatgttctaattttagcagaaggaagagtttagagtcaagtctaaagttatttgggacaattcatgtcttaagtcataagcttctagaccatctccaattttagtcatcttcagaatttttttttgtgctgagaacttaaccagtgagatgtaactagacaactagtcttcccttcccaccagagagttagctttgcacaaaaaccatagtcacccagcacttagatgaatgggctctatactttctgttttattctgatttgggcaaggcattctgagcaaacttgtaattcagattggcttattaaaatatgatcattttagactctccaagtcccaaaaatgctgaagaaatcaacatttctccatgcttcttttcctgactctttattttcttcacccttccttccctttcttattttctttttattcctggtcttgcattttgtagaaagtagaagtaagctaatatgttctgcttgtaaaaaaaagatacataatttatcaaaacaaggttatgaattaatttttatttaagaataaaaacaagtttttatttcagctaattaaatatgaatttaattttgaggctacccaagccctgattattctgtagaatattatttttcattccaggctgaaatatgtacccaatttgtgaatatagttaggccagaatctttgaaaagtgaaaaacatacttgctctaaacaaatcttaggaaatcctttgcttacttttataaattgtacttcagaaaatctgtatacaatgggttttagtctgtgtgatttgttttgcatatgcttttaaaaaaactgtgatacaccaacaacagaaaatataggaataaggaaagcagggctggagtgtggagaggtgagaagagctgtctgtattgacaaaagcagaaccttagaaacaactttcagaagctcctcattaaatgaaacattgttattttcttatgtcccaaatattagccaacttgaggtgaaataaagagaagtgacagactttagtctctgagcgtacatcaaatgcattgtcttgtaggaacaactcttttacttcagttacaccaccatgctctttaaattctctgttatccagtgaaactttctacttaggatatttgatcagttgattcatacccagtgtgaaatgcttgagaagtttaatttcatgtagtatcagggcaataatctctttactttgacccaaacatctttgtctatgaaaaatcactgagaacaaaggacatcccacaaaggcatcaactttgttcttccccagcttcacactgtaagaaatttgggttctccacctattcctgggttcccagggaggtatcagtacaagaagataaaaaattgctccttcctattctaatttaataatagtaagggaacatatattttataaagcagtacctctgggcagataaatacactgaaatacagtgaaggcaaaaaatagggctcatattggcatgttagggaacaatttaagttaggaaaacttctatagcaagatagctgcaaaggacatttcagctggacagattttctttgtgctttcatccaatttgaatagaagatgtttttgctgttttattgaggcaacaagtttttcttggcattggcactatttcaaaagaatacaaaaatcatggttgaaatatgtcactgatgtattcaaatttcctacttgtgttaacattttttcctatcacagaagaaaaagttctcaagcaggtaaaagctgtcacaatagaaaaaacaggtaaataaggtattttatatttttttctatgtctcattatatgttatgtggtgcactcatatgtgtgcatgcagacacacacacacacacacacacacacagcccttcactgaagtgtgtaggctttcagtaccataacttctaacattctgaattcttgtgaataactaaaaatatgttcaatataatttttgttaaaaaataatagctagagtagcataactttaagtgtgattgagctaagcttatgtgtaattcatgagaaaatctatataatgcattgattaccatgtatacttaggtgtttaatcttatttttaaaccacatttcctcaaatcttaaaattacagaagtctgaaactttctactatttataaattagctggaataatttactttcatggaagctccatagagagggatatggttatataactttaaagtctgccttagagaatgatcaacagaacataaaatattaaagtaaaaacactccatctatcattagttcatatgagaaagaaaagatacatactcttgcaattcagaagtttttcctgtaaggaaaaagaaaacttatgagtcttgaaatcaattcacatctgagtcactgaacttcctctgtttgattccaagacagaaatcctacccacctcagccattaagagaatcccatctcttactaataatcattccaaaagaaaaactctgtgaaacatgtttttccctgagataatcagataataaggatttaaatagtttcttggaggaaaaaatataatagaattcaggagagatccaattattcctagaaattatagactagtttataagtagaaagaaagaaatctcataaggccgttttcacattacttcatatgaccattatactttcttccgaccactgcctaagtttataattttagtaaatgttcctttaatttgcaccctaaggtattaatatggccacctgagtatctcattcagttgtatggatgtttgggaattatgaagaagctagctcaatgtatttgtgactcaaatatatagattgttttaaattttatgtgcgtagcatgtgtcttactagttttttgcagtttgattaatgtatttgctgacagtaaaatattagtggtcaaagaaaacaggttaagtttaagctaaggaggtgacctaaaactaagaataagtaaatacaaatactaaacagttattttttccatggtttgtactcatcaatatgccatgtgcttgcctccattctccacagccaagcccaaaccaacaagtaagagatgaatagaataacacctgagaaatatcgcttgaccatttcagctttaacaattttgcttagtttttttaagaaaaatgttattttcagtgttgtctgtgtctaaataactgttaataataaattaatgttattgctatttaattgttagtgataaattaatgttattgctatggcattgatttaacattcttgttaaatcaatctactaattaatgattaataattaatgattaattaaatcactactaattaatgattataactatacaaaagaaatatccagaagtctgtcactgtggttaatattaaaagagggaatccatataggctataaaataccactcacagtaagttaaggtaggttggaaatcttttaaacatacgtaatgaataacagaaaatgaaatgatatacaattgtcagtgttatgaaccatatactgtttttaatttgtttgctttaagctgcattaattaaactgtaggtaactttggcatttagaaatccatttaattataaacattttgccatttgtccattacaatgatgaaatgtccttatgaatgtggactttgaagatccttcatttcactgtacaggtgtgacacagagagtatagtgatgaagagtttaaagatgacttttggactcaggaaggcataaatatttacccactgtggtagcaaatatattcaatattgtgtcaaaattgtgatgttggtcgttgaatggtgtacatttgtgaaacacaagcttagacaaatgcatgaatggctgttggtcaaatatattctggctcttgcatgcaaaatagcttcacaagacccaaaggtgaacgtgtgacacagcttaggaatacatataagtggtttaggctatatagcacaaatgaatgactctaatcagaacacattcacatcctagaatctgtgaattgtattttgaatatatattttatattattattattcccttgatttattattaatgctgttataacagtttaataccttgaatattggctgcattttcttttattttgaatgcttatttactataacatttatgcaaattcagttcatggaagtttattcttgaatgctatcagttcctaatgtacgaatatctgtttagtctgatgacacctggagtcccacatcttcccacctacttcagtgttggtgcataatttgggggaaaagtagtaagtttagagaaactccaaattcaagagtgagggaaagaaaggacaagtaaacatcaagaacagctcagaagaactgaccatagaggtcattagaggtaacacttggtctgttccagagtcctactcaattgacagatattctcaatcccattcaagatatcccacatatatggttgactttaaattccacttttgatgaaagagaatgatctctttaaaatttttaattcaaatatttttcagagaactaagagggatgtcaattactcatacatttttatttctttttgtcatatcctagaatagttgagattcagctatgagagttttaagaaaacctggaaagggagggtggtacaggtcaataaaaatacaaaatgtggcactctctggaatacagcagatttagtttaaattttcaataagaaactagtgttcagcagtgcattgcttctaactggcaagaaggttactaggattcaaagaggaaaaaagaggagttgataaaatgtcaaagacaaataccatccactaaaaatgtccccaaagaatgattcaactttcagcaaataaaacaatattcttattctcctttttgccatattctatcctcttatacaacacagcccccaaagggataaaaccctaatactgtctttcagccaaatgtagaaaaaagccttttcctgggtgtcctgagaaagaacctaaccctgtttataatttttttatggcaatatgctttctttgtttcaaattacatgaaaatgactttggggcatgcctcttgggtaaactgaggatcacttgcaaatatataaataagaaatatttgccaaagaatccacagattgccagtgaattttgatttctttctctagaaaaagctgaacatcgagaaagagaacctccatctataaaaacaggtattttaccatttttggtttatattctgtcttatgttcactatttttattatattcaaaaattaaagtaatgcatacaagtcattttcactgtgtttcctggtaatgtgttgtcctgtggttttgtagtgtaatctagtttatctgacctaagggcaatattgttgtcaatcaaacatagattgccaaacatgcaattatgatagagcaaaattaacaaattagatttgattttatgattcacaagttccttccaaaatattcagtatttcactgttgtcagtattaatataatttatcatacagattaagttgatagttttaaaatatcttgtcaaattacacaggttaaatttcacaaattgtgaatttcagcttgatatatcctcttaaaagagaagttaccccattctaaaagttagcttaattcttttaaaatgtcattcaatttttacaatatgtaatatttcacatggttcaaacactgaggcatataggaagctaactgcaaaaatctctctcttttggtaaattctaccagttctcatttcaaaaatatgtgatgatatccagaggtaatcactgttacttctttttttttttttgagacaaaatctctctctccaggctggagtgcagtggctccatctcagctcactgcaagctccacctcccgggttcacaccattctcctacctcagcctcccgagtagctgggactacaggctcctgccaccatgcccagctaattttttgtatttttagtagagaagggattcactgtgttagccaggatggtctcgatctcctgacctcgtgatccacccacctcggcctcccaaatcactgttatttcttaaagtatccttctagcattatctatctaccagtacaaatatatatatattataatatataacatatataatatatcatatatattatatataatacatattataatatattacatatataatatatcatatatattatatataatacatattataatatattacatattataatatatacatattatacatattattataatataatacatattataatatatattatatataatacatattataatatatatattatatataatacatattataatatatatattatatataatacatatcataatatatatattatatataatacatatcataatatatatattatatataatacatatcataatatatatattatatataatacatatcataatatatatattatatataatacatatcataatatatatattatatataatacatatcataatatataatacatattacatataattatatataatacatataatatataatatatattactatatataatatataatacatattataatatatataatatataatacatattataatatatataatatataatacatattataatatatataatatataatacatatgatatataatatatataatatatataaacacaaaatgtatctacaaaaaaagtatcaatttgtattccctctgttagctattagttattttacttaattttagatgattcaatcctgcaatcatagctaaatcttttctactttttatgaagaaatagaactttagatgtacgatgacacagttaacgtttttagttaatatattttagaagacatgttatattggaaaaaaatagaatgtctttacgattttttttacctaccacccattcattcttgagattttataaaggaaccttattgttcaacatacgggattgggagagttagtataaattaatattaataattaatattattagtataaattaatattaataattaatattattagtataaattaatattaatatgtattccaaaaggactgtggcagaatatatattttatgctatttcagaaacagtaagaagttcagatttttgtgagcattgattaatattgtatcaaatcaaatatgaggtttacaggaataaaaaagagaccaaaaaagattccatactttcaggctttactgctccatgagaaactcattgggagtatgatatgaaaattattaaaaacacatttcctactgttcattgttgatataagtttagtcttatttttacaataaaaagcaaaaataggaaatataaagggctgatatgtcacccatagatagaaaattatcactcattttctttttttttcttttttcctttttagacaaaccaaaaccaactccaagtaagtgtaccattttagaattttaaaattgtcctatttcattgttttaatttcacaatttctttgagttataactgaagttaaatagtatggtctgtttgttaatgtaatagccattatactattaccatataagtgagtctggttgacaaaggatattgtgtgcacaggcataccttggagacaaaaagcacaactaaaagaaaatgggtagagcaagaagccctagaccaataagcacatgaagagatgtttagtgattcaaaaaatgcaattcaaggaaaattagatgtcattgtcctggcatacctcgggggtattgcaggtttcattcagaccaccacaataaatcacaccattttttgttttcccagtgcacataaagattatgtttgcactatagtctattaagtgtgcaagaggattatgtctaaaaaatgtacatagcttaatttaaaagtattttgctgctaaaaatgttagtgatcatctgaaaccagcaagttgtaatacttttgctggtaaaagtattgtctcgatgttgatgggtgctaactgatgaaggtggtggtttctgaaggttagaaatttgtggtgattctgaaaataagacaacaataaagtttggtacattgattgactctttgacaaaagatttctctgtagttcgtatggctatttgacagcattttactcgcagtagaacttctttcaaaattggagtcagtcatctcaaacttggcttctgctttatcaactaagtttatggaatgttctaaatcctttgttgtgattttgacgatgttcacaacatcttcaccagaagtagattccatctcaagtatccactttcttttctcatccatgagaaataactcctcgtctgttcaagtttgatcatgacattgaagcaattcagccaccacttctaattcttttgttgcttccaccacatctgcagttacttcttctactgaatccttaaacctctcgaagtcatccgtaagagtcaaaatcaatttctttcaaactcctgttgatactgacatttggactccctctcatgagtcaaaaatgttcttaatagcatctagagaggtgattccattccagaagactttcaatttactttgcacggatctatcagatgagtcactatatatgacacctacagccttatgaaatgtacttattaagtaataagacttgaatgtcaaaattactctttagtcccacgggctgcagaatgtatgttgtgttcacaggcatgaaagcaatattaatctcctcgtacagctccattagagctcttgagtgaccaggtgcattgtcaatgagccataatatttgaaaggagtcttttttcttagcagtaggtctcaacagtgggcttaaaacagtcagtaaatcatgctgcagacagatgtgctgtcatctagattttgttattccagttatagaacacaggcagagtagatttggcataattcttaagggacctaaaattttcagaatggtcaataagcattggcttcaacttcaagtcaccagcttcactagcctccaacaagagactcagcctgtcttttgaagctttgaagccagatattgacttttctctctagctatgaaagttctagatgacgtcttcttttaatagaaggctatttgttaagttgttgttgttcttttaaagacagggtctcactctgtcaccaggctggagtacagcttggggatcatagctcactacagcctcaaactcctgggctcaagtgatcctccctagaaggctattttgtctacattgaaagcttattgtttattgtagtcaccttggtcaattatcttagctagatctggataactttctgcagcttctgtatcggcatttgatgcttcatcttatacttttacgttacgcaggtggcttcattccttaaatttcatgaaccaacctctggtagcttccaacttttcttctgcagtttcctcacttctctcagccttcatagaattgaagggagttagggccttgctgtagattaggttttggcttagggaacgttgtagctgctttgatcttctattcagtccactaaatctttctttgtctcagcaataaggctgtttccctttcttagcatttatgtggtcactggagtaacacttttaatttccttcaagaacttttcctttgcatttacaacttggctaactctttggtacgtgaggcctaactttcagcctatcccagctttcaacatgcctttctcactaaacttaatcatttctagtttttggtttaaagtgagccatgtgcaagtctttctttcttgtgaatactaagaggccattttaggttactaactggtctaatttcaaaaccatcgagtctcaggaaataggactagaggaaagggagagggcttggtgaatgagagtctcaatacacacattcattaagttttaccaccttatatgggtgtggtgtgtggaacaccaaaataattacagtagtaatatcaaagatcactgatcacagaccaccataacagatgtaataataatgaaaaatttgaaatattgtgagaatcaccaaaatgagacacagaaatgtgaaggaagcaaacgccattggaaaaattacaccaataggcttaatcatacagggttgctacaaactgtcaacttgtaaaaaatgtgatacctgagaattgcaattaagcgaagcacaataaaatgagtatgcctgtattacatttattaatccttgaacatgtatttattgagcacctcttaggtctatgacactggaccaggatgtatgagggaatgcctatcatgttttctgttgatatacctggtttgctaacacatttaccatgataactaatacctgtgcaaataaacaaacaaacaacaacaaaagaaaaccaaaacaaaacaaaaacaaaagacacagtaattgtgtctctctcttatctactttcaattgtttgtttagatgtattgaataaacacagtatggagatcttctaacagttattgtgtgggttgagaaaaattaagagcacataatatatgtcctcaatttatttaattttaacacattagctttttattttctaatttttttaaagccctgaggtacattttattttgtaattcaaaatcacggggctttcctggacatcttaaacaatagtaaatatgcaacaataaacagtgaagctgtttatttaatcctgttagaatactcagactgtaacctggattaaaaattgagcatttcaatccaaagtgtatctggatgttgtatttatatgttttaatacccagaactaacctgttttcttaacagcacatgacagattcgttaataatgcagctacaggctacttcataatggattcaatgccaattttaaacattaagtacagcctttaggctggagatattctctagtatagtttgtaatactgctactaatatgaacactattgccaaaattaagggttggaagtcaaaactagaatgctaatatgaaacatcattataaagccattttaaagtactatatttttatgaaacattatttattgtataccttcattgtcataaaatattttaatttttttttgaattttgaaaatagctactcaaaatagttatgtaagactgataaaactgataccacgtttgtagaaaacattgatattttatgagagatatttcttaaactaccagagaatttttattttctggaaatgttattatttgaaattatttgtgacacaaagttttttttaaaaaaaactttccaggttatacttagaaatattaatctgtaagtttactgaaggaacaagaagaaagcatggttctgtatgagcataggcaaaaggcaaatataattttatgtcttctatcacttatcagactgtagtcaatatgaactgagtttgtttttattaacttttaatctcatcccatgaccacactcaattgcatttctgacagcatcttataaatgaagctactttaataaatattatatgaatgaatgtttgcatgcatcaatgaagattaaaaatgtaacagatttataatttgtaactaagaaaaccaattttgaatttagaattcattaattatatcgtatgttttttaattttttacatttcattttattttatttttaacttggtaggtacttagtagttgtatatatttatgggtacatgagatattttgatataggcaagtaaatggggtatccatcacatcagcatttatcatattttttgtgttataaaaattctaatattttagttattttaaaatgcacacactaaattaatgataactgtaatcagcctgttgttctatcaagtactagatcttgtttattctatctaacctattctataatatttaaatataccattttagattaattgaatatttgttctattttcaaaatagatgtctagttacagctatcagaaatattaatcatcagtacatttctttgccattttgagtatgtgtgcctattgtaatttaggaagaaatatcagaagataagtttcaattgtttgctactgaataaaaaactatactttttctttttattttttttcctttctttctacattctttttttttttttttctaaagaaggaacatcagaagtcacagaatcaggtaaatatttactttttcagaggagataagatacagttgtggaaacagtatgtaaatttaagtttctagatgtataacatttagaaaatcccttagctgctcaaattccagatattctgttctacagaacaggcataatgacttcccaaaaggcttgttataaggagtaaatgatgcaatgtgtccattcttaccgcatacaaacttataagtcacccattaaatattgtttttcttctcacttttgtctaaaaagtgtagcaagaaaattattatttaccaagactgctttgaaaactggatccacattttgcttagaaatattatgttacatttttattgctttaattcattagtttacttatgaatccatcatgccaggcaaattcttatttcctaaaggtaaaaatgtaacatgtagttttttttcctattgtttctagtttaaacttgttaacaaaggcatggcttatcctagcttgtcttcaaagcataaaagaaaaggggaggaagtgggtagcagggtcatgcctgtaagtaaaccaggctactcaggagggtgaggagggaggatcccttgagaccaggaatttgagggcatatagaaagaccctatctcaaaaaaagaagataaataggaggaggaaaaaaagaagtaggaggaggaagaggaggaggaaaaaaagaagtaggaggaggaaaagaagaaggaagaggagtaaaagacttagaggaggaagaggaggccaaagaggaggaggaggagaaattttgaccctataggtgactacataaacagaatgaccaagcataacaaaaatgaaatgagagagccctgactccctccactcataagattaagtctcatctccaactgtttactccaagaatgagtaagaaagtcatgttttttaaaatgatggtttcttgttgtttttctttcccctaggaaagaagaaaactgaaatatctgaaaaagaaagtaaaggtaaaaatgacattttaagacatatacatcaaattagccacaaaaacagaggaacaaaaaacaaatttatacaaattatatgatttaaaaacagttgatgaaaatgaagacactgattttatagcacatatcataattatagtacattacagttcatcatgcaaaacatatagttattgcatttttattaaatatctaaaaggatcaggaatttagaactgaaagcagactctacctgttactactaaattaaaactacagacttcttttcatattactactgaactgtgaatattgcctacataaaattcaattcctcaccttaagaagacttgttaataaatatattactctgatacagagaaagtgggaaagatctaaaatcaacaccctaacatcacaatgaaaagaactacagaagcaagaacaaacaaattcgaaagctagcagaagacaagaaataactaagatcagagcagaactgaaggagtgagagacacaaaaaaacccttaaaaaaatcagtgaatccaagagctgtttttttgaaaagattaacaaaatagataaaccattagtcagactaataaagaagaaaagagagaagaatcaaatagacacaataaaaaataacaaaggggatatcaccactgattccacagaaatacaaactaccatcagagaatactataaacacctctatgtaaataaactagaaaatctagaagaaatggataaatttctggatacacacaccctcccaagactgaaccagaagaagttgaatccctgactagaccaataacaagttctggaattgaggcagtaattaatagcctgccaaccaaaacaaaagcccaggaccagacggattcacagacgaattctaccagaggtacaaagaggagctggtaccattccttctaaaatgactccaaacaatacaaaaagagggaatcctccctaactcattttgtgaggccagcgtcaaccttacaccaaaacctggcagagacataacaaaaaaaagaaaatttcaggccaatattcctgatgaatatcgatgcgaaaatcctcaataaaacactggcaatccgaatccagcagcacattaaaaagcttatccaccacaatcaagtcagcttcatccctgggatgcaaggctggttcaacctacacatatcaataaatgtaatccatcacataaacagaaccaatgacaaaaaacacatgattatttcaatagataaagaaaaggcctttgacaaaattcaacacctcttcatgctaaaaacactcaataaactaggtattgatggaaattttctcaaaataagaagagctttttatgataaacccacagtcaatagcatactgaaagtgcaaaagctggaagcattccctttgaaagccgacaaaagacaaggatgccctctttcaccactcctattcaacatagtattggaagttctggccagagcaatcaggcaagagaaataaataaagggtactgaaataggaagagaggaagtcaaattgttactgtttgcagatgacatgattgtatatttagaaaacccaatcgtcacagccccaaaactccttgagctggtaagtaacttcagcaaagtctcaagatacaaaatcaatgtgcaaaaatcacaagcgatcctatacaccaataatagacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttgggaaaattggcttgccatatgcagaaaacagaaactggacaccttccttatgccttatacaaaaattaactcaagatggattaaagatttaaacatgccgggcgtggttgctcatgcctgaaatcccagcactttgggaggctgatgtgggcggatcacgaggtcaagagatcgagaccaccctggccaacatggtgaaactctgtctctactaaaaatacaaaaattagcctggcatggtggcacacaccagtggtccagctactcaggaggctgaggcaggagaatcacttgaacctgagaggcagaggttgcagtgagccaagtatcatgccactgcactctagcttggtgccagagtgagactctgtctaaaaaaaaaaaaagaaagaaaagaaaagaaaaagatttaaatgtgagacctaaaaccataaaaaccctagaagaaaacctagggaataccattcaggacatagacatggacaaagacttcatgactaaaacagctaaagcatttgcagcaaaagccaagattgacaaatgggatctaattaaagtaaagagcttctgcacagcaaaaggaactatcatcagagtgaacaggcaacctacagaatgagagaaaatttttgtaatctatttatatgacaaagggataatatccagaatctaataggaacttaaacaaacttacaagaaaaaaaaaacacacaaccccatcaaaaagtggttgaaggatatgaacagacacttctcaaaagaaggcaaacatattttaaaaagctcatcatcaccagtcactagagaaatgcaaatcaaaaccactgagataccatctcacaccagttagaatgacaatcattaaaaagtcaggaaacaacagatgctggagatgatgtggagatataggaatgcttttacaatgttggtgggaattagttcaactgttgcagaagacagtgtggcgattcctcaaggatctagaaccagaaatagcatgtgactgagacttggaaccaacccacatgcccatcaatgatagactgcataaagaaaatgtggcacatatacaccatggaatactatgaagccgtaaaaatgaatgagttcatgtcctttgcagggacatggatgaagccggaaaccatcgtctcagcaaactaacaccggaacagaaaaccacacactgcattttctcactcaaacgtgggagttgagcaatgagaacacatgggcacagggatgggaacatcacacattggggcctctctgagggtgggggttaagggggagggatagcattaggaaaaatacctaatgtagatgatgggttgacgggtgcagcaaaccaccatgacacatgtatacctatgtaacaaacctgcatgttctgcacatgtatcccagaacttaaagtataattaaaaataaataaaaaaataaattaccctgttactgtttcttctatacagaaaaagcagacatgaagcatcttagagaagaaaaaggtaattttttaaaagaataaaaaatagaatgcaaagccctgaagctaaaatattttaagtcaaaatgtatttatatcatatgaaaaaaaacttttctaaatgtatgtgatgagtgttagcctgagtaaaagaagaaatatggtaagtaaaaaacacaataaaaatgattgtgtagtaacggcagtgtcaaagaagcaatggatggtaagccaacccatgcaaataagcatcagtttgttctgccattgatgagcaaagtataaactgaatcaaaatgctgccgtttttcttaacattgggtttatttatttggcaaactacaccatataagatgacaattactgatttgagtataattatcataaagcttacaaaggtcttaattatcaaatagtttattggagcaggaggaaagcattcttagacatatcagaattattgtcaataacaaaataactcttttttgtttatctccaaatccagttaatcagaatgacccatttttcatacattctagttaattttgttcctacattcatgttatacctctgtttataaaacaatgtctagtgctaacatttatttttgttaggtaccagttggatagaaaaatttttgaaaaccaacttgagaaaatatttataacacttaaattatcctcattcgttgatgtgagacaaaattttgatggaaatttactttaaaaatttatattttaatttacattttccttattaacagtctcaacaagaaaagaaagtcttcaattacacaatgtgacaaaaggtaatcttgaattacgtaactactatgtttgtatgaaaacatatgaattatgttgttgcttaatattaatattaaattattttggaacaaagaaatctagaagatgcaaacttctcttaatagcagaggaagtggacaggtagaaaatctagcagaaagcttatatttcaatagaaaataagaaaacatgaagaaatcagaactattagcaacattaacatgaacaaatattctgttacacatcagaagaaaaattatcaattacaaagacttttttagcatgaataatgtcaaaagtaatatggtagtaaaaataaatattactgggatttatttttatctatcactaaataacatatagttaagatcatgaatatattttttattgcttataaattagacctttaaattaattcaacctagacacaaaataggcaaatgccagcatgcacaatgcagacatttttttcttaaaaagagaatgatctattttgctgatattatcataaaactgtaaataacgtttatactaaattatgtagccttggcaacataattttagggaaattcaattactttaaaaaagtgctttaaattcgaaggtgctaggtaaacatatcataactaagacaactattttcattcatagcaaatacataaatctctagtagggagagaaaaagctttgtttttcactgactcccttttactgctcactgaaatgtgtatccctgaaatgactagacatatctagacatacctttcacacgtaaaattattaatgtattcataattatcactaatattaagaggtaaaactttcaattgaagggcaattacatttgtagaataatataggggcacaatttttatattgaaacattcttttaaatattgtttaatatcctttgagataatcagccagaaggatgagaaaaaaataaattaattagaaaatgtatggttataccttttcctattgtttacttgattcttagtaaggcccaattatcatgcccagtttaaagatgaaataagtgcaataagagaaaatctaacatctcaagagtatttatatggtacagacaagatttggctccaagtttgtatgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgctctagtgtttgggacaataatttcaccttagttattttgtcctaaatacagcttaataagaaagcacatttctttgaagaataataacctctcattagaataaataaattattatgaaaaagtaaacttactttgcatgttgttttttaagatgtattttatagtctggtaattatttattttatctatctttgaaagaaaaataattctaaatgatatattttataaagtcttggaattttaaagaaaatatttagctgttacataatgcaaagtaattttattcaagctaagtataataatagttgagccaaaactcttaatttaacaaagatcttgattttagtaagagtattttaaaagcataaatattttgtgacactttgatgaatagcttttttgatagctgacatattttcttagataaaatagattaaccaagatattcaaagaatcagccaggcatagtaactcacacctgtaataccagctactcgggaggcagaggagggaggattgcttgagcacaggaatttgaggctgcagtgagctgtggctgtgattgtaccacttcatgtcatcttgggcaactgagaccccatctctaaataaaaattttaaaaaattaaaaattataacaaaacaaagacttatgttgacaggcaacagatgactgtatttcttcattgattcttaaataataagcaagaaacaaaataattagatatttttataaagtccactgatttataatttccttgcattttatctcagttaaacaaaacttatttattttctctttttagcagaaaaacctgcaagagtatcaagtaagtacggtttgtattaatgacaagttctctttgatacatagtatcaattttaagatgaaattcataaaatatttttatttttgaagtgttcagtatagtttattctaaactgaatcctctgacaggaatttattagcttttattgttacttacgttgaaacttaaaaaaaaaactatgttatttgaaattacaacttgtaacagaaatatcttattattttctcaagcctgaaaataaaaatgacttgcatttaaataaataaatgttttcagtgattaaattcaagtgaaataaaataattctgtatctgcctttaactgtcaatcactagaaatttgttaaagaccacatatggtcgaacagtgatgcttttgctgctgttttctagtgttcgttaacctaaataaaattgtgtatctaagaaacctaaattgtaatttaattgtatagctataatttaattgtaaacctaaattgtgatataattgtatatctaagaaacctaaatataattgtgtatataagaaaaacagcatagttaggaatggatgtatctcctatagtataaaccacagctcccagaatagattctctagaatatcaggatccaggtacagatagaaattctatgtatataggatataactgtaaatattcttacaagttcctaagattcaaggaaataacaatttatccttttttatttccatatttatgaaaaaatattctaaataagtaccacccaatacaaatataaaatgtgacatatatgtaattttaattttaattacatatatgtaattttaatttcatatgtgtaattttaattttaatatgttattttaattttctagttgacacattaaaagacaaaacaaaacaagtggaaataattttagtaatattttattttatgtaacttattttatacaaatgttatttcaatatataatcaatatagaaaagtatttatccctacattctttttttgtattgagattttgaaatcttatgtgtattttacacttacactacattttatcttgtgctagtcacatttcaatttcccaaatccccatgtagtcagtggctacagcattggatagagaaggtcctactgtacccaatgttaatattgaagacaataaaaaggaaccattaaaatatgataccacatgtcattcaaaggtctttgattacaggtgatcatagacttgcttcaggaatttaaaaaaaggaaagatattgtaaggacacaaaattgtcccactgatggcaaggacaaaatgtatagataaaaggaaaggcccttggaagctgccctattccacaccattcccctacagccaaaggtaatgagagctgactacataaggaggtaatgccaagatttttgccttgaagaatggttaggatttggatagctggagaaaaggatagaaatgactgacaaagaaagatagcatcagaagtattggttgaagttgaggtgtagtgttggaaagaagtgggaagtaagcacatttcgggtgaaactgtcaggtagagaatattcaaggccaaaatattttagaatgtgccacagaaagctatggtttacttcctcctagaaggaagtaaaaagtcaaggaattattgggacacctaacttcatagtaatagcagtagtagtagtaagagtaagattatgagcagtaactgaaaagaaaaatatatcagaaagaaaaatatatcatttaaaatatatcatttctgtgatccatattaaaataaatgatcagagacatcatggaatgattgtttaataaggtggttttctgagtatatgaagcttatttcctctatagcacatattattgtttttattatgcttttttaggagcaatcatcaaaaaactgtcttaggtatttataaagaagagcatactatatatatttgaaactaaacaagtatcattctttttccgaatccttttacagcattatgtatatgtatattttgctagtggtggtggtaggagtgggttttggggctcagacttttttttcagtcatttgtttctctttaactaaaggagcttcatgaaatagctgtgctttgtggccatcactctcttcccctaactccactctagtgcctgcacctcttgtctagcagggaccaggtcctccaacttttacagccatgagcaagtcatgtcttttgtttgtgttctcttcaatttctttaatcagtgtttgtagttttccttgtagagatctttctttttcttgattagatttattcctaggtatttttcttatagctgttataaatgcaattaccttcttgatttcttcttcagctagttcattattggtgtatggaaatgctactcatttttatgttgattttgtattctgcaactttactaaatttatttatcaaatctagaagtttttttggtggagtccttaggtttttctagatataagatcgtatcatcagcaaagtgggatagtttgaattattttccaatgtggatgccttttatttctttatcctgtttcattgttctggctgggacattctatttatttctttctcttgttttgattgttccggctaggacattctattcttcccccttttgaaatcatcatgtctattatttccatctttatgtccatgtgtacacatcatttagctcccacttgtaagtgataatgcatgataaatttgattttctgtttcagttatttcacgtatgatgatgggcttcaactccatccatgttgctgcaaaatacatgattttactgttttttatggcttcatagtattctgtggtgtataaatactacatgttctttatctaattatcccttaatgggcacttaggttgattccatgactttgctattgtgaatagtgctgcaataaacatagaagtacaggtatctttttaatataattatttattttcctttgggtagatatgcagtagtgggattactgggtcaaatgttagttctaatttagttctttgagaaatctccataatgttttccataggaattgaaccaatttacattccaaccaacagtgtataagccttccttttctccacatcctcgtcaacatattttttttgactttttaataatagccattctgactggtgtaagatagtatcttattatggttttaatttctgtcataattagtaatgctcagcatgttttcatatgtttgttggctgattgtatgtattcttttgcgagatgtctgttcatttgcccacttttcaaatgggttgtccttcaatctgttgatgtgatgtatcaggtttattgatttgcacatgttgagccatccttgcatccctgggatgaatcctacttggtcatggtgtagtatcttttcaaaatgatgttggattcattttgctagtattttgttgaggatttttgcatctatattcaacagagatattggttgggagttttatttctttgtgtgtccttgtctggttttggtatcagggtaatgctgaccttgtagattgagttatggagggttctcacctcattaatttcttggaatagttttaaaactggtattaagtttttctttctatgtttcagagaatttgactgtgaatccatccagtcctggaattttctttgatgagagattgttttattactgactaaattttgctacagttggtctgttcaggtcctatttcttcttgattcgatcttggtgagttttatgttttcaggagtttatcagtatccaatattttttccagttaattagcatgtagttgtgcatataagtctctgatttttatttttattttttttgagatggagtctcactctgttacccaggctggagtgcagtggcgtgatctcagctcagtgcaacttctgcctcctgggttcaagcaattcttctgcctcagcctctggagtagctgggattacaggtgcccaccaccacacctggctaatttttgtattttcagtagagacagggtctcaccatgttggccagtctggtctcgcactcctgacctcaggtgatccacacgcctcagcctcccaaagtgctgggattacaggcttgagccactgtacccagcttgatcttttgtatttctgtggtatctgttatactgtctcctttttcctctgagtttatttggatcttatttcttatattcctgcttaggctagctggctgttttgattttattatttcaacgcacaattttattgatcttttgtttaattttatttcagtctttaatccatcttcagttaattttttgtataaggtgtaaggaaggggtccagtttcagttttctgcatatgactagccagttttcccaacactatttattaaatagagaatccttttcccattgtttgtttttgtcaggtctgtcaaagatcaggtggttgtagatgtgtggtgttatttctgtggcctttgttctgtcccattggtctatatatctgttttggtaccagtaccatgctgttttgtttactgtagctttgtagtatagtttgaggtcaggtagcatgatgcctcaagctttgttccttttgcttaggattgtcttgactatacaggctcttttctggttccatatgaaatctaaagtagtttttctaattctgtgaagaaagtctgtggtagcttgaccagaatagctttgaatccataaattactttaggtagtagggtcattttaacgatattgattcttcccctccataatcatggaatgtttatccatttgtttgtttcctctcttattttcttaagcaatggtttgtagttctcccttgaagaggtccttcacattccttgttagttgtattcctagatattttattctctttgtagcaattgtgaatgggagttcactcatgatttggctctctgtttgtctattattggtgtataggaattcttgtgatttttgcacattgattttgtatcctgagactttgcagaagttgcttattagctaaatgagtttttgggctgagacaatggggttttctaaatatgcaatcatatcatctgcaaacagagacaatttgacttcttctcttcctattaaaatatgctttctttctcttgcctgattgccctggttagaacttccaacactatgttaaataggagtggtgagagagcacatacttgtcttgtgccagttttcaaagggaatgcttccagcttttgcccattcagtatgctattggctgtgggtttgtcataaatagctcttattattttgagatacatgccatcaatacctagtttattgagtgtttttagcatgaaggagtgttgaatttaatcaaaggacttttccgcatctattgagataatcatgtggtttttgtcattgattctgtttatgtgatggattatgtttattaatttgcacatgttgaaccaaccttgcatcccagggatgaagccaacttgatcgtggtggataaactttttgatgtgctgctggattcggtttgtcagtattttattgaggacttttgcatcaatgttcatcagggatattggcctgaaattttctttttttttttttctgttatgtctctgccagattttggtatcaggatgatgctggccttataccttataaaatgagctagggaagagtccttcttattctattgtttggaatagtttcagaaggtatggtactaactcctctttgtacctctggtagaacttggctgtgaatccatctgctcgtgggccttttttttttggttgataggctattaattagtgcctcaatttcagaacgttttattggtctattcagggatttgacttcttcctggtttggtcttgggagggtgtatgtgtcctggaatttatccatttcttctagatttcatagtttatttgcatagaagtgtttatagtattctctgatggtagtttgcaattctgtggaatcagtggtgatatcccctttatcattttttattgtgtctatttgattcttctttcttttcttctgtattagtctggctagtggtctattttgctaatcatttcaaaaaacagctcctagattcattgattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttttacttgattttcttttacttgataaaggtttccaatgtgttttgtattttatcaatgaattcctcagtttcagaatttcaatttggttctattttaaaatagctatctcttttttaaatttccgattcatatcctaaattgttttcctgacttctctgtattgtttttcagaattctcttgtatctcactgaacttctttgaaatcagtattttgattgtttttgtgggattttgtgattttcttttccattgggatctattgctagacaattattgtatttctttgtaggtatcatattttcttgttttgttttccatatccttatgttgctatctatgcatctggtgtaacagttgttgctttgattttggctgtgtgaaaatggcctgccttccctctccctccttagtgaccatggtgatgttagccccagggcagaacacagtcctttgggcctgtgctatcagactggtgacagctgtgggcctgccactaaggatgatgggaccactctcaatagagtggtataggcaggcaactagggacacgtagttttcttgcaccttggttctgtagcaaccttcagcagcaacagtggaatttgtcttcggggcacatcatgaaagtgccaggccttccttctccctccttgaccttgtcaaggtggcagtggcagcattgactccagggcaggacacagtccttttggagctgagctctcagaatgatgtcatgctatagctgctcagggctcagaagcctgtggggctcaatatgagttccttctttggagcaatgcctttgcataatcttcaggcagctctccatgttaatcttgaggcctgcaagagttgaagaactctcccatatctagtattgttagtctgtggctgaaatgtggggccctgggaaacacttacttacactttccccatattccagagcttctcctggctgccagcccatcacagccagacagactgctacactttcttttctttctttgcttttggtgcttcctgtcacttctctgttgaattccagtgtaatctcttagaccatctattcaaagtctgactatctacttgatacttttgtttctttccatggaagaggctcgtattagccgaatctaaacagccatcttgctcccagcctcttgctttctaatttctaaatattcatttgatttttattctgtatctttatttttgtatatatggtaaatatatgataaataatgtgcttctcatggagtttggaggaagacattgggaggagaatgtgtgagattttattatatttagtacttattattttaaaaattaaaagcaaaaaaatcccacattcttaaaatttaaataacaccacaatctattcctgatattaacattttaaattttttgaaaactttttctctaaaaaagcaaaaatacatcctaaaatattattttccaggaacttgcccaaaggcaaaatgtgaaataaaaccaagggatgataaaatacattcttaaaaggcaaacaatgctgcgggaaggtttttcaaccggaagagtcataaggctcttgacagggggatggccctggcaagatatttatcccaatggatgttggtatatcaaagaaaaagattttataggtgtgcatagttattttgttgctgtagtctgggagtcaacatttatataaagttaggtttgttagatcctcaaaatgagtatttcaaatgaaatagtgtagtaggaacatttcttgagattattgtatgcggaggtttaactttgccatgtttcctgtaattttttttttcttgaataggggagcatttttgccattagcacttcatcaaaattacctgaatgcaccaagttgtgagatcattataatctttgagatacaattttgatattagtccaagataataaatttaactttgacatctccataataataaatttagtcttttctagaagtttactactttataatgaagtttcaaccaagcctgctagaaaagtagttaggatttccatgtttttaaacaactttctttctatcttacttttgtgatttttcaaaagctttctaacttttaatattctgatctagtattttggttctgcatttttttccttcctttataaatatgctaagtaaataaggtagttctttcaatattagagtataatagatattttagatgtcagaattaagcactttgaaaattagtctgaaatttaagcataagataaaattaaatacagatttcatagatataaaagtttatattctttttctgaatttacatgtttagtgtatcttacgtctgaaaagaaaactgtgaaatgaatatctagtaaagattcttttaatgactataattaaccataactaaagcatcatatttgtccttataatatataatgatgaataaataaaagtataacctatttttattgattatattttcccaaattgaaaattttcagtaatttcagaaaactagaatttcccaataagtatgtcattcccatttgaagtaatatttcaatttgtcaaataataatgttactattaatgagtaagtaaattataaaatgataattcagtggcagaaaacaactaatcttcttaaacacagaaattcttaaacacaaacagaatatacttcattttatgttgatagcatctttgctttccttttttacataattaaattaatgatactttctagcataaccaaattcaacctaaaagctacttcagagtaaattcacctcaaaaatcaagtaacttctgttatcttagactaagttgttgataaaaataatatgcaatgattaatgatgacacatcaatattttgacttttaaataaattaatcaattttatcactttacaacatatgccagtcccatatctagcactgcacaagaaaatttaatagtctaattcggatgtagttatagaacaagtctttaaacattgtttgcttaactttacaaaatgagtttgaataatgttattcatgcccaattatgttttgaattcatttgtctaaaattagatctaaatgtttccaaaaaataaactgaattgctgaaactaaaatgactattaagtctcttttactactttgttaatattgtttgtgaaaaaaaatccattgctataaatatataactgttatttatggctttttttttacgttgtttcagcaagtaagattgattatatactgaaatcaaaaacagaaagagaaaaaaagaccttcccatttctaaaataatttattggaaaatgaagttttgggagagagatcataattttttttcatagctttcatttatatacaaattaatatcaaaaatgtgaatttcctatccctcttactaatataaattattccagtctattttgttctttaaaaatactttattatgtagtttctgatacatacaaagtaacatatatttgaaaactggataatacaaatactgtaacttcactattccaacccttgatttctatcagaagtaactactacaatgagtttcattttacaattgattcccttgattacttttttctaattttatgacatgtattggtctctcatctctgtgtgtgtgtagcacattgtagaacatactctgaaattttttacttaatgttatgcttctcagatttatcagtatttttgagtagttatattttacttattttcactgccatatatagtatattactttgtgaacatacacatttaatcagttccactcttgatggacatttgcaatgcttcccatttatttgaggtttttctgtttcctttataaatatcaaatatgtatgcttattttattaatctatttcctttctacttttacgtatgtatgtaacagcaataaattttcctttaagcactatttcagcagcatcccacaaacttttatatgtagtattttcattacaattcaatgttaagcatatttaatttccactataattaattttaactagtgtattagattttatttatagagtatattttaaaatttctaaacctatgagaattactgacgttattcttatttaaccgaactccaatttaattgtgtagtaatcacaggaaaagtgttttctttgaaatgtgttcagtgtttatcttgtgaactaatatattagtttcagtaaatactgtatatatgattgagaagattgtgtctttgctaatggttgaaagcacaattctatagccgttaaatcaagcttaattgtctttttaattaccctgtatcttctttgactttttgtatatttgaagtatcaataactgaataaactatattgacatctcctcctatgatgagaaattatcagtttatccctgtagtttaatcaatttttatatcaggtgctatttcatgttatacgtaagtttatatcaattttgtgtctttctgatatattgaacatttatctttatatgatgacttctatatcccttacaaagctctttttaaaaagagtatatggctgggcatagtggctcacgcctgtaatcccagcactttggaaggccgaggtgggcagatcatgaggtcaggagatcaagaccatcctggcctacatggtgaaaccctgtctctactaaaatacaaaaaattagcgtggcgtggtggtgtgtgcctgtagttccagctacttgggaggctgaggcaggagaatcgcttgaacccaggaggtggagtttgcagtgagcagagattgtgccactgcactccagcctggccaaagagtgagactccgtgtcaaaaacaaaacaaaataaaacaaaaaagagtattatgcagtatgtctgatattaatataattattccagctttcttttggttaatattttatctgaatctattttcaattaaacctttactttatgtcctttcataacatgatgttttatatatgtgtctatcaaacaatattgagctaaattttattttacgttgtatactaaaatgatctttagttttaatctgatggacgtagactatttacatttatcatgattattaatatcttaggtctggttctcactgtcttgttgctttctctttctcatgctctctcaatgcttcttcatcatctttcttgacttctataaattgagggttttttccttttatatgtttttattattccattttgcagagaccataccttatttctattactttagtgattatccttacattttaaccatacccacctaacaaagtataaaattgctacttgaaaaccccttctaaacaagagaggaatatgaaaacatctaaattccaacacatctaatcttgacttacatggtaattttgttcaaaaacctgaatatgtgaattttattagtattatttgtttaatcagtatgtgcctatctgtacttatatgtttgccagtttaattgtttaccatttcttttgcatttttgactttcttttgatagcatacttttcctagtagtgccttctatgaaattgccttgggtagagttctattagtagaaaacattctcagtttttacttacttgacagcttttctatatcatttcattcccgaaagccttttattttttctgtcacataatctaggcttccaattatacacttttaagcatcttttaatgtattattcaactctattgttttcttttctactgatagaataggggaatgctgttatcaatttaattgtcatttcttcctgtgtaatatatgcttttctctctgccttcttcaagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcacgcctgtaatcccagcagtttgggtaggctgaggcgggcagttcatgaggtcagtagttcgagaccagcccggccaagtatggtgaaactctgtctctgctaaaaatacaaaaattagccgggcatggtggcacttacctgtagtcccagccactcgggaagctgagagaggaaaatcccttgaaccagcgaggcagagtttgcagtgagccaagattgtgccactgcactccagcctgggcgacagagcgagactccatctcaaaaaaaaacaaagtagtagggtataaagttaatacagaaaactcattatttcccacatgcaacatgcaattggaaacaaaatttaaaaaaattagttcgtgttacctaatatgaaatacttatgtataaattatgtataaatcaaaatgtatatatgatctatatgttgaaaaccacaaggtgatgataaaaattattaaagaaaatctaaaataagtagagctataccatattcataaattggaagattcaacatagcaaagaggtcagttctccccaaatcgatctataatttaatgcaattacaatcaaaatctcagacagaatttcttaatatataaaatctcttttacaatagctaaaacattttttaaaagaacaaatttggaataatcatattacctaattttaaatgttactgtacacttacagtaatcacaagagtatgggatttgcaaagatatagccacatagatcaatgtagtgttaaaaatccaagaaatagacccacataacataaccatttgatttgtaataaaagttccgaagcaatttagtggagaataagtagactttttaaccaatggcactcaaacaattggacatctatgtattttttgaaaataaactgctatcttaacctcacatagtgtgcaaaaattaatcaaaaatagatatctctaaatgtaaaacatgaaattatcaaacttttaggagaaaacatctttgagacctaacattagacaaagagttacaagacatgacaccaaaaggactatttgtaaaagaaaaaataataaattgtataccatctcaaaattaaaaatgtgtgctctgtgaaaaagactacatatccaacaaaggccttgtgttttttacaaattgggtgaaataaaatgttagttaaaattaattttaaaaagtaaacaaaagattttaacacatagttcaccaaagaggatgtatgaatagcaaataagagccagaaaagatatttgacattattagctgttagagaattgcaagctaagccaccattatataacagcacacatttattaggataagtaactttttaaaacatggaaaaacaaaaacaagtgctggcaagcatttgaaacaaccagaactttcatacattgctgtcgggaaggcaaaatggtactggcactatagaaaactgagagttgcttatgttgtgacccaaccatctcactcctgaaggatgagagaaataaaaatttatgtttgcccaaaaatgtgaacataaatgtttattgcagctatattcacaatcgccaaatctggaaataacccaaatgtccttcaacaggcaaatggatatagaagctgtagtacatccacacaacagaatatttctcaggaataaaaattcatatgtgcagcagttatatgaattcaaatacgttatttcttctgaagctaagctccaaaggttccatacgggaagttttcatgcatatgagattcttccattgggttacagctcagtagttgcccaaggttagggacagagggggagtgtcactataaaggaggagaacaaaggtattttttggaggtgattttggttgtagtcacacacatctatacgtgtcttaaaattcatatacatgtcttaaaattcatagaagtttgcactgaaaaactcaatttactgtgtgattattttaaaaaataaaccttaaaaaataaaattaataacgtacaaaacttgtgaaagatagctttttgagatttcctagctgggttgctttttctcacttacctgaccttatctttttctttgtctttactgaccctgtcttgctcaacttttattccactcccagcagttccttaccatttgtgggaatccatcctgaaagtgagccctggcttgtcagtttcccaaggtcacagggtatctgaaggttccagcaccttcagctctcaatgcttacctgctattggacttgacaaagtccctcataactttagctgatgatctcatcagtctaacttcctttgggaaatacctattggctatctgagagactgatccccatctctcagactccccatggtttccctctgcttcctcttccacagactttgattccttgtagatttttgactattcatttgtctcaatatgtagctatcttagggttcatctaatttgttataaatattgttcatggtttttgctgtctacctattctatccattttggggggagaaatatgaaggaaatttaagatctctactgctattatgttctcacagtcccctaggacaattttatcattgtcccaccctccctggcttaacaaacgatcctagcctctacacccccattttgctccttgcacacttaattactgaatttcagttttaatataagcacttgtcctaatgtgaccccacttttcatgtatcagcagggttagttttttattttaatttccctgggacagaagggtcaattctatttgaagatttcctttacttcctctaaacccagtccttcaacaaaaggtattagtttttgttgctgtgaatgagcactttagtgtattcagtctatcatattttcagaagtattagtgtccaatagtttttaagattttatccacaagtcttattttaaccaagattattgcctttctttttctaaattaaaaaacaagatatcttacgtcccagttctagacaattgtgtaaaactaattatgtcattaaaaatttagcgagtgcttcatcacagaatcctaaatttaatctttattaaagcaaaaccattctcaactaatacagatatgtacaaactgaaataaagtcttcttataatgaatggatgaaagcttatttctggctacacatgggtgtatatatatttaatatatgtgtgtttataaacatatatacacatacctatacataaatgcacacacatatatatgatatgaaagtgattgtttttataaaatgacttctgttttgttagaggtcacatgctgaaatggaatggcaacattactgtagtttttgctaaacaaattagcactaaattcataatagacatatgtatacaggatggtatcatagggtagtagtcgataccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccttaatatgtgccagtgatcatacctcaccactctgatcacccccttttgctaaactccagagaaaggttgtgtataaggcgcatttggtgaaacgtttgtcactgttcattattagactttgggtcccagcactgtggcctcattcatttaagggtgatgttaagttgttctgacattgccctcaagagagccgtgtttatcctgggagtgatgggacagacactaagaaagggtcgcatacattcattgaacactcctggcttcactgtgtgctgcctacaaaatcccaaatgtgaaatttccctgcatagtttattattccctagagtcaattttaagaatcttcagtgagttctcagtgtagcagttcattttctttaaaactcgttattactttaaataatagcacatattgaaggagcttctcacacctgagagctaaaataaactggctgtcaaatgttgctttgaactaccgtgggtttttaagatttcttaggaaaatgtgaactcttagaaagtaatattctgttaaaccggttacacacaatttggccagttagttgagaaaataatttggagctttgggtatctctgcagaaacagagagaggcagcgaatttgataaaggaagagggctgaggaagaatacaaatattcatgctaagctttttttgcatctatgactaaggattccacatgtttacttacgaggatttcttgaaactgcacaaatcaaaatagactgctggtagagatgaacatagagtaactgagctggtacatatacgtgcattatttagggggctttgatttatttatagtgtttgctaagagcatatagagcagactggacactacacagaaaaattttatgtttaaaactgagaaaaacaaaattaatccatgccataaatgtgggttcttcaaagtttgccttctccccaaattacaatctctttttactcttttgtatattccctatcatcagcctcccattctcatatcaagaagcattgcttctcctaagatttacattctgtattcctttttgattccatcctctcttgctttctccctcaatcatgcctctgcagttcttaccataagagtttctcctacctctgcctacaaatattcctttgtacaaaattttccttgccctttctgcttctcagagctgttgtctttttgctctgcttgcatttgcagccacttctgaactagatctcctagcaatttctctctactctttcagtttaattccatgcagcttggatatctgcccccatttctgccccaacagtctccccaaatagctaacctcaagttcaacacagcgttccaaattgtaaagctgaattaccttttgctcacttctcccctattgttaacctctctaatgccttccacattgtgggtcgcctgccctttttgaaatgttttcctctcttggctttcataatataggatttttttttttcagtctatttgctcagtactgggcttctgctgtttttccccagaggttgaattcttccaacctcagctctctttcctactcttctgtgctattcctcagtggggccatccagttttgttttctacattatctacttctttgtggataagacccaaaattcttctgaagcttaacctattttttcagctccagtcacattcaattcctaacttcgccctttgtctgcacaagtttacaactgatcttcatatcataaacttcttcttgcccttatccttctacgctctccatatcccaagaggggattctactcttgccatctgacttccactctttagtcacttagacataaaactttgaattctactttgaccaatcagtattacttgtcccggaccctaattttgttttaagtcatgtaggcttttactgtttctcctctaaaccattgcattcactccccagcaggcccttttctgacttgtcattcttcctttttatgtccactgacattaaattttccaaactttaaaatgattgggccatatatgtgagaaacactgactatttcttcattgtaaatttggaataaattctacatttctaagcccaggagtctagggcctctataatccaggtataaactacattaaaattttttgtgtgtgtgatcattttctatacctattgtaggtgctagcccaattgaacattctatattcctaatactgctgcctcctagatttgatcccatcattctcttttcctgaacaattctttgtacctctaacaatgcaattcattacgattgttcaaagtccatcaccagtggaagagtgtccataaaaaacttctttgatctacgtaagaggaattgaccatttcaatcttgaaactacctcgcagttatactatcaattgtcatatactatctcatacttcagagtcccttctatttggttgggtactttttcattttctctatatgggtttgtaaattacttctaagtagcatcctatttccttttggttcctccagggcacagagcaaagtgctttgcaagtaaagatagaatagtttagaggaaagagtgagggtcttgatgttgaggaaagttagcttcatgccttctttcaacactttttaaaatgtgttgctgcagggaagttcttttcaaatactttggggctcaaagttctcttgtaaaatcagatattttccccataattcataagggtattggtgagacttaggttaaaacacatgtgtaaaatctagtacctagtagcatacctggcacagaaaaatatctcattgtagttctcatagttgttgctggaaaagtaactttatcttaaatgaataaatcataggaaaccttcaaggtaatattcactttgactgtaaagctagactgaaatttttaaaaatctgtttatgattttacttttataacataaacacacagcctacatcacaaaatatacattatgaattaatcttttgtatgaagaagaaactgagattccaaccatctatgaaaaatgctatgaatatgtttctagtaaattgttttgcaaatatatgataagggtgttgaatatattccaattatccaaatttagaagtggtggttttatcatttttctttttattattattattattattatactttaagttctagggtatatgtgcacaatgtgcaggtttgttacatatgtaaacatgtgccatgttggtgtgctgcacccactaactcgtcatttacattaggcatatctcctaatactatccctcccccctcctcccaccgcaagacaggccccggtgtgtgatgttccccttcctatgtccaagtgttcttattgttcaattcccacctatgagtgagaacatgtggtgtttggttttttgtccctgcgatagtttgctgagaatgatggtttccaggttcatccatgtccctacaaacgacatgaaatcatcctttttttatggctgcatagtattacatggtgtatatgtgctgcattttcttattccagtctatcactgatgaacatttgggttggttccaagtctttgctattgtgaatagtgccgctgtaaacatacgtgtgcatgtgtctttatagcagctttaatttcaattatggtaactattgatagatataattcataaaaaatattttggggtctttaatattttaagatgataaaggaattctgtgaagaaaaaagtgaaagccaccgctctagagaataaaatgtagaaccaagataagattgcttgctgagaatgagaaatctgcattttagtataaaatttgcgaattcacttatcaaacctacataattaagaataaacataattatataccatacctaccattggtgctgaggctggactttacattttctcatatacttggaatttttatcagccaattgtaattagagtccatatttattagagtccatacacacgcagtctcctaaataccaacagatcaagtctttaaatcatctgtgtcttcaacctcatagaaccaagtccacccttgactccaaagagatgaagacttaacacctgaaccctgttaaaaatcccattggccatgaaacttttttgacccatggctgcagaacagtattggagataagtaaaaactttcaggcagagaacagaggtaatttcttactttttcaggcattccacttgatcacagaataacacttttcttaagtgtagaaacagacagttatgtgaaatgaagcaagtcatggatttaggacaaaggagaaagtccttcagttaaccagaaaatacaaggactacttgaccaaacaaaatccaggactttctattgtaaatttattgatttttaataaactgatagctatttaagaacccttgtgtcagtaggcccaattaaataagtattgaagagttatacaaaacctagtccttgattaaaatgacagccatacagacaagatggcccattttttcatgactctattatagtgcagacaactgcttggataggaggatggattcactgctatctctgattcctctggaatctgtttctatgtaagcgaagaatgaactctagaatttgaaagtcaagatagtacaattttattcttcaatgttagaaataactgtagcttacactacttataatgtttaggcaaacagaaaaaatattatgcttacctcttcattgtctttattttcaaagacaactaagtaacttttcatcgccactgagggagagtagattgttagaagtgcagagggacacatttagcaacccctctcattttaagggggttagtggaatgccttctccttcatttctgttctgcacaagtgtgtgtgtggctcatgcataacttgactctgtcagagcctgccagcaggtatgttaggcaacataatgcatgggtactagaatcagagagaagtgggtttagaagttcatcctccagaggcagtgatatggtttggctgtgtccccacccaaatctcatcttgaactatatttccatatccccacatgttgtgggagggacctggtgggagggaattgaatcaagggagcagtccctccatgctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccagttccttcacttcttatagctctgagacattgaatctctctgatttttaattgtcccacctataaaataggaacaataagagtatattcctcacagatattctgaggaggtgaaaagtgttaacatttataaagtgcttagaacagtggctggcacatagcaggtgtactattcatgggataaatttcaacactctttcaagaggccctgatataggagatttggattatgttcttgttctgtctctgccactcatgagttttgtgaccttgggcaggacctctctctcctctatttgtacagtagattcagtataaaagtcctcacctcggaggttgcagtgagccaggatggcgtcattgcactccaccctgggtgacagagtgagatcttatctcaaaaaacaaacaaacaaaaacaaacaaacaaacaaacaaaaaagtccttgcctcatatggttgttgttcaggatcaaacgtgttaacacatatgaaataacttaatagggcctagcatgtagaaaatcttaagaaatattaactattttgcaaaaattaaaagtgatgatctcacaatttactgagttttgcccattaacttgatgcatatcacttctaaccttttcagacatcttgccagctctgtcttgtttcctactaagcatttgcaactgcatgactggcctagcaccacagttcaacccatagagaattgaacttttcattatccccagcaaatatcagtgtcccctagggacttcattgtagttgggagtggcaccactgtctttctccaaactcaaataacatatcgttattttccttatagtaccaatctcttgttcttacttgtatttagttctatttcattcttttggcaaagcctttttttgtatttaactccttcagtgactcctacttggagaatgtactatttctgtgctattagaacacttgccaaattgcattctctgcattcattttctcatgctctagtcttatttatttctaccaagtacatctctaaaacattatttgtctcttgagcaaccttgactagctatgaaatttagttgagggtacttagcctgatgtataagatgttccacatgataatcttatccaagttttccagaacgtctcctctactccctgaatatctctgtccttcgctgtctctagccttttttcatattgttgccctcactttaattttggcatctccttcttgaaaatattataagtcccatttcaaattttacttccttcattaaacattttcctgacagtccgacaaagcaggtcactctttaaaatttcattggcacattttgacactcctttcactgccatgattctaccttctcagagtcaaatatttgttttatcaaaactaccactcactcaacgtgcaagttgtaagaataagtagacagtaagtgccttattcctttcttgaattttattcctagttctgtaaatgtttgctgctaagtctcttccacagaaaatgcatctctatagcaactgtcctaggtttgccgtttactttcttgtgcttctgtctcctgagcgattgacatgtgactcagctcttgccagcttttgtcacttatagccagttgatgctggatcagaatatagaatctgaagacactgaggtctttattccttccatttgtatttatttttctagtggtaataaatggatccaaagaataagtttcaagtgtgctataatctacaaaaataaaatatatgttccttttggacacggactttgcctcattttatttttgtacagaactttcataggaattaataggaccttattacacaattaagatattatttgatttgtttaggaactgacatcatttttaaaatatagatattaagttatttcacaacatcatataacagtttgtactgtttcattatttatagcagttgattaagcagttcaagaccatggtcattttatccagtatttaattgagttaaacctatgtttaaatattatttacaactgaccagatcaaaagtttaataatatatagtaaaaaaaattctagtaattttgtttctttttctgttgtgttcttctacataatagcatttttctataaaggtcacattgctttcctgttagacgaaatttgcatactgaccctatcttacccctttttcatttattagtgaacagttagtatgcaaaatctaaataaataagacaaaactgaccttctttcagataatttcaaatgttaaaaattaaagcatcattccgttatattgcattagaattgcctcagacttaaaattacttccacattattccaatatgtgcttgtaagttgaatgcagaaaagaccaagtgatttacacaatacaacttaagagtcattgtgtatgtatttgagctttagttcaaatgtagtgtcttcctttccccactaattttattgagatataagtgagaaataaaaattatatatatatttgatatacaatgtgatattttgatatacatatacattatgaaatgattaccaaaatcaagctaattaacatggccatcacctcacgtagttaccaccattctgtgtgtgtgtatatgtgtgtgtgtgtgtgtgtctgtgtggtgagaacatttaagatctactctcttagaaagtttcaagcatacaatatatttgataaatatttggatatatacccagaagtgaaattgctggatcatatggtagcttcttcttaaatatgttgaggatgactattgtctagtggtaaaataaataaataaacaaacaaatttttgaggaacctccatactgctttctataatggcaataccaatttacattcccatcaaaagtgaacaagagttcccttttctcttaaatcctcaccagcacatctcatttgactttttgataatcactagtctaacagatgtgaggtaatatctcattgtggttttatttcatttcatgataattaataatataaggcatcttccacgtgcctgttggtcatttgtatatgtctttggaaaagtgtctgttcagatcctttgcccatttatttgttttttgttattgagttgtatcaatgtcttatatattttaggtatcaacctcctttggatatatggcttgcaaatattttctcccatttcataatttgccttttcattttgttcattgtttcctttgctgtacacaaacattttagtgtgatatagttccaatcgtttatttttgcttttgttgcctatacttttagtgtcagattcataaaatcattgccaataccaatgttaagaagctcttccccagtgcttacttttaaaagtgtttcagttttacatttaagtctttaaatccattttgaattgattttggggtggtggaagataaaggtccactttcatccttttgcatatagatatccagttttcccaacagtatatattgaaaagactatctttcccccattgtttattcttggtacctttttcaaagattagttgactcatgtatgtgcatgggtttatttctgggctttttagaattgtcaaaaaggctaaaatctaatcaatctgctaataaattgtgtgggtagacactgatctctttatctaggctgtatgcatgaaaccatttaccttaactttcctaaattctataaatgattatgatttttgaaaggagctttaggagtcagaggaggagggaaacctgggggtgggtgttggaggtcaccacaagccttttccctaagtaacctttaccagcctgattaccatagtgcagcactcatcattttctccacatcctctctccaagtcagagaagtgcctgttttggtcagacagctcttatttatggagactgtagatgctgagtttgtagattcagggatcttgtgactcttaaaaacctttaaatacaatacttcctctgggaaaactgaaaaattgactgtgattctatgtgccttttttctgtactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggaaggaagaaatggaaggctggactcaacccctgcactcttccagcccaagccagaggacaaacagtcaggaaaacctgcgatctccagatgtacgaacttcataaagtatttccaggacaaaatttctccatctgtagaatgagggcttcagctaacttgattttttttctgaaaggttcctggctttttcattagggctgctataaaataggcattatgttaaaaagaaatgaacttttactttaggtttaggggtacatgtgtatgtttgttatataggtaaactcatgtcatgggggtttgttgtacagattatttcatcacccaggtattaatcctgccatccattagttattttttctgatcctctttctccttccactctcaaccgttgggtaggcctcagtgtctgttcctcccgtctttgtgttcatgttttctcattatttagctcccactttaagtgagaacatgctgtatatggatttctgttcctgcattagtttgccaaggataatgacctccagctctatccagcaatgggattgctgggttgaatgatagttctgtttttagctctttgaggaatcatcacactgctttccacaatagttgaactaatttgcacacccaccaacagtctacaagtgttctcttctctctgcaagctcctcaacatatgttattttttgactttttcataatagccatgcttactggtgtgagatgttatcttattgtggttttgatttgcatttctctaatgagtagtgatgttgagctttttttcatacgcttgttgattgaatgtatgtcttcatttgaaaagtacctgttcatgtcctttgaccactttgtaatgaggttgtttgcttttttcttgtaaatttgtttaagtgctttatagatcctggatattagacctttgccaggtacacagtttgcatataaaaaaaaagtattttctcttccacttctaaatttgtctgcaggcaataagtatttgcctaagcattgttctagccaacgaagtataaattctttgccagtgcccaaaattaaccaacaatgtggaaaatagtgctttgagaaaacacacacaggtcaggaccttatcaaataaaagttgagatttacacttgtattaagacacctttctgaatactatattttatatatatattttttaattgaattaagactagccaccctaataggttttttactcatagaccagtgcttctaaaactttaatgtttatacagatcaactgtaggtctccctagaattaaatatctgagttagaacctaaaaatctgcatttatataaataaatcaattgatgctgaaactagtggtatatagattacactgtgaggggaaccgctctagaaccaattgaaaaattgataagatctgtaaacctaactttctatgaaacacacacactaacacacatgtacacacaaacacacacacacactctctcacaacttctaattatttcaatgttttatagaaaaacccccaaaaccccattcgtggataccagttaagaacttctaatcggaagaaagggattcaaagaaatagtttcaagctatgcaacactacataaatttgcgatggatattactacagcaaaaataaataaatagtcagtgaatcagacgtgaaaagggaagaatgcaggatactgggctgctgctctactttcatggcaaggatgatcacgaaaaacatatgtccctccaaatttgggattattttgactaaaatgttcatctttagccagattttacccttaccaaattgtaattctgagcatcaaagatcccttctcaggaaagggatgcatgtcaactatcctcattaatgaatatctgacacatcagggccagttttcctatttaaacaattgtttgtagcgtgacatttttttcatgggttccctttctctctctggctcttgcctattaaattttacagtgaaaatatgaatagaatctgtgtacaaatctggagtatactataaaaagggtaactcctgtttctttcatagtgtgcttctgtttagacattctcagtcccatatatatttatataaaagttgtaaatgtacaagttatttacttttatattttttatccactagaaggaactgaagatgtgtctcccacaaagcagaaaagtaagtttataatgagattaaaagtaataaatcattctgtattaaagatgctacatctatgtaaaaatgttagactctcttaagaccagtattcgaagaaaaaattttttagcatagacatgaagaataacattaaagtaggtcatttatattttaaaaagaagcgtatcacttttgtgttaggcaagaggcagatagttggaagagttacaagtaatggttgaagtggcatttatcgcaaatccttctacatatttctgatccttagtactctggctgaatctatgcttaaatgtgtcttactgcctgctttataataggacagctgaagtaatatgccaaatttttttatatcaggtagaaaaaatgaagaaataggttttagcaattcaattgcttggaaactcacttctaagattcaagattctttttgattttgctagatgtatggtaggttctaaatattcaaactttgggatcatttattttagaatccaatcaatattcatgtgcagttacaaaattcaatgcccaagtttctcattatttcggttcttccaaattagacatttttgttcatatggtaaagcaataaattttaaatctgtatttgcattaaagtcattgcagaacagaataaaggaagcaatttttgaaataggtataactgaagtttgtgtcacataatgcttttaaagtaaagagctagatatttgtctgaagaaatgacgtctcttgattctccagtgctttttggatgtttttgtgcaggaaattactaaagtgccccttacaatagcaaatgcctcctactctgtattaataggtgattcattagacagatactgaatgcctactatgttccaagtacttctttggatgctggaactactgcagtagataagacacttattataatccttcatataataaggttgtgagaaatatagggaaataagcagagtcttatgatactttgagtaatattacaaaatccataagaaaaagaattataggtcaatctggacatattttcattttatatagcaacgctttcccaattattaacctactggtaataatttgtggctatgtcacataaacatttgaaatctcatatattttaaataactattaaaatataattcaatgagacaggtgaattgtatcaataccagtttcctagttggaatattgttctatagttttacaatatgttaccattgaaggaaactaggtgaagatatgtggtatctttctgtattaactcttacaattacatgtgagtctacaattatttcaaagtaaaaattttaattaaaaacaaaacgcaaatacttttagtaaaatggtgtcaaatattctaacctcagttgggggatctattgcatcaaaatgatatttgctatcttcgtcttacaagaaggcagttctatagcctgatattcatgagcctttaatttaagctctaatatttgcagtcataataatattttaatgagtagcttattcaacatcaattaaataaatgtgtcaaaacagtgtccacttctgataagcagctggaaggcagcctgtcattgatgggcccttctacttttagcaatggatttccatttctccttgtgcagggccggctttactactgtccctcttgtagcctgcctaacccccaagctcccataacctccacaaacttgaagagacggaagttgtattattgcttcggtttgaagatagaagaaaagagaaatcattccagatgagatgcattggaaaagataactaaattcaagattcttcaaactattgtcatccctgaaaacccagtgacccatggaaatggaatcagaatactccctggttgcttctccagcttccttttttcctatcctttgctttattctacttcataaacccctagtctcatatggatttggccatcttctttatctcccacacaccactagctttaactatgatttttctttcctggccttctgcaaaaatctatggctggttgacagaatgcaaatggataggatagaaaacactggaagtttgtaggcacccaagattgtgaggagatgctaaactcgccatcttttaccaaagctgctacctgggagcaccggcttactgagtccagagtccttacttgcaccacactcccttaactttcctgttttgctttctactcagagctgctacctggctgctacctttgttgctcaaagagcaaccaagccaccttaggaaagctcttgcctctaaagtaagggcaaataaaacttctagatgttggcaccacctctctgtgacattataaaacacacacacacagtctgttgctttgcatattgataagctcatattttgaaacctgtgactatgtctctatgattgctatgcacatcaacagatgtctatatgatcagaactttgactttctctgccaggccatttttattatcacttattaaaggcttattacataccaggaagaattttaagagcacatgtaactcatgtaactcatttaactgtcataatatttctgtgcggttttcgttgttttgatgttatacataaagactccaagacacagtgaagtttagtaacttgccaacagctacggaggctgctggcagaatctgtgaccttatctgctgcactgcactgcctcactgtgcttttttgctcatgttctgcatgttttaacaaactgtcatgctctgttccttaggtcccatcagtttcttccagtgtgtctacttggatgggtacaatggctatggatttcagtttcctttcactcctgcagaccgccctggagagagctctggtcaagcaaattctccaggacagaagcaacaaggacagtaaacacacatgtatgacccttacaagtgctttaagattttaaaaatgtgatgttttgtccacaatagttcaggcaattaagaatatgcaacccagagaatttctgtgaaaacattttgctctttggcctggtgtggacggaaagggtggccaaatggattgagtgatgagcagacatgtttaagggtctaagtctcaagaatctgttatgtgtgtttgctgcggtgggagggggtgcttgtatttatcttatttccagtcactataaggttgtacacaaactaatttaaagtttacttaataatggtatctttaaaataattgacacaattgcaaaatgaattcctggcttcagttagctattatttttttaatgacaacatagactgtgctctaagtttaaaagatggggaagcttatataaaagtgacccttttgcatcatatgggtatctaaacttaatttacccaataagttgatgcttaatgattttattttatttttgtctatttctattttagttgtggctttgctctaagaatgggtaatagttgtactacagactgctataaatttcttgtgatactcttttagagctcaaaatatctctgagctttagacatggtaaggtggagagtaaatgcttgataaatctttaagatatgtcttgaatgataattaggacattcagtccagtggaaatacaccattcaattagtcaggtctggtgaatcgtttgtttaaaatattagcaaatgagatgtggaattctgaaatttctccagactgtgtcttaataaaaatgtcacctgggtgaaattttagatcaatcactaaatttgggtgacaaatataaaaatattttcatttcactttaatacattctttctgtgaagtaaaatgtttttctttctcataatggcaaaatatgaatgccatcaaagtttaaggaattcattttagccttaaatgccttcgtgagatgtcttacttgtattttaggtaactggtcatcagtgccaatgacatggataacaatttttaatctactcgacagtgcatccctgggaatgactgttatgtttttgtcatattcctggtaatataaatactcgtgttctttactacattgtttttatcaactctaaaagtcatgcctctgtgacctttatcatgtttacaattgcaactgaacttatgacaaattaactcaggaaataaattgagttatcctttctagcattgtaattaccatcagcaaggcctgagatagccagagccaatactagccaagtgatttattttcaaggattgccactaactacggttctttaggaccaagatataaaacagtcactaaaaatcattaggctaggtatcagtaatacattcattactaataatgcatttttggagacttttgtgaaagaagttggtctctgccaaaagctggtggaccacattcacaccacgaaagccagtgtcacatgaaccagattaatgactctctttatggggtatgtgggacatcctggaagtgtataatttcaggaatgaccagacaataccatcttgcaaagccccttcaggtgacaatctaaacttgtgggtaggagagtgcataaagtttattgctcaactgctcctccagcctgctgaatttactgagtaaagaaatagcaaatatgatagatgttttagatttcatagaacagaatggtttgtccattaattctttcattcaatgactgtttattgaatacctactcttttagggcgctgtgttaggtgctgtattgtacaagaaaaatataataaattagattcccagcgctattctgacatagtgaatgaccttgaaaaatttactaaacatactatgtttgtttctccatgagtaaaatagggatatagggacaaacagtctaatatctcatagaaataccatggagacaaataaaatattttaatataaatatgatattaaagtaaatttctgaagtaatacttttgggtatggcactagtttttcctctgactattttactgtttctttcactctccaatataaaaactatttgataagataaaacgatatattttattgtaattagaatttagacaaatcagctataatgtaaaaatgttaataataattacgttttatctgattaaagttacaatgatcatagcactttaaaaatattatctgaactgtcatttgtttatatattaccgtctaataaaatagttatagatcttccaagtttgatgccttacattttaaaaggaaaagataaatggttgattaagaatctttgtctttaatggttcattcataattcaagttatactggccaggaatatgtaagcatttcataattgttttagttattttgcacaattggtacacactactcccattacatccctgcgtttacccacccttcatcccctcttaatagataaagatctgaaaataagaatcgatttttccttaggtttttgatttatatttagttttcctaaagcctgataaatcattattcaaatggggcaagtgtttttttgtttcttttttttttttaatgaaccctagcaaaagcacctgtatgttgactcattctggcatatcttttcaaaaccttttaacttcttgcagaaatattttagaaactggtattgggatactgggtattttagagatttaannnnnnnnnnnnnnnnnnnnnnn

SEQ ID NO: 12558 - DNA, 42235 bp, Human
  misc_feature (1)...(42235): n = A,T,C or G
cttgaacgtaggaggcggaggttgcagtcagccgagtacatgccattacgctccagcttgggtgacagagtgaaactccatctcaaaaaaaaagaagaaatattttcattaagatattcagccatcactgtaagctttctcagattttacgtgtgagagggaagcaactagccagtttgcctttctcagggtagaattcaagagttttgttcccctgctgtttatgaatttgatattccttgactaatgtattcagtttctgttctagacatgagcatgaatttctgatttgcagatgtgaatcactgcctatgcatatcgtgctgctttttgttacaggtcctgccttaccttgctgtctctcctcttgcagggtctgacatttcaggaggtggagaacttctttactttcctaaagaacattaatgatgtggacactgcattgagtttttaccatatggctggagcatctcttgataaaggtaatgaaactcaaaaagtgtttttttgaaggtatgaacattggatctgtaatctcttaggtgactgcccctcctggaacagtaaaagataagtttttcttggcatccttgaaatggtgttttgatttgttgacattgtatgagccttgcatttcaccctgagatgccaagttcagtgaatatattttcttgtgctaaggccgtagtctgggcaggtgcctatctttaaatgactaaccttgaaaataagcatctaagctgaggcacagggcatgaagctgcagaacttcccctatctgagccagagtcattatatatacaatgtgaagctaaagtcactatacaacttaagttgcgtctttgatgagaaggaatgctttagtttatttcttatattaagactttttttaagacaatatgactctgagaataacaccccgctcctttggcttacttcatagaaattcagttacagtttgtacaagcaacgtgagagcacggaggaattgaaagcacaatttttccctcaacatttcattatgaaaatttttaaacattcagaacagttgaaataattatttaaataacatccacatattcagctcaactgacattttgctatatttgcttgatcgtatgactatgcatattttcacctctctaagtaatcattgatcttatttgacatgttcaaagtaagttgcagacgtaagtatacttcactcccaattagttcagtatgaatattaactaaagttcaagattcatttaaagttctttcagtccccttcacagtttttgcccccactcaccaagaggcaacctttgtactgtatatttttccaccatagattaattttgctttttctagaacttcatacattggaattatataaatgtacactcgtctaaggtttcactcaatgtttttgagatccatctccgttgtgtgtcagtagtttaatccttttttatgatgagtagtaacccattgtatgaatatagtcaggcatggtggttcatgcctgtaatccgaacactttgggaggctgaggcaggtagatcacctgaggtcaggagtttgagaccagcctggtcaacatggcgaaactccatctctactaaaattgcaaaaattagccaggcgtggtggtgtatgcctgtagtcccagctactcggaaggctgaggcaggagaattgcttgaatctgggaggcagaggttgcagtgagccaagattgtgcaggattgcttgagcccaggagtttgagaccagcctgggcaacatagtgagaccccatctctctctttttttttttttaataaggagtatatgaacatatatgaaagtcctgaaatgtcagctattgtaaatgctgccaacttggtcttctttttcaagattactttggatattctaggtcatttgtatttccatataaattttagaatcagcttgtcactttctatgccaaaagaagtggaattgtgattacagtaacattgagtatgtagatcaatttgggaagaatcaacaccttagtgtaatatagcatcttataattcacgagcataatatatctccccattttttaaggtctcattttctctcagcagtggtcttatagttttattaatacaggtcttgcacatatatttttaaaatttgtgcttaagtattttatggttttcgatcccattataaatggaattggttttattttattttctaattgtttgctgctaatattaaaatataactgatttttatatattaactttatattctgtaattttgctaaattcacttattcttctagttgttttgtagattcctcaggtttttctatgtaaataatcctatcatcttcatacagagatagtttcatctccttttttaaaaaaaaatttatggctttttttttcttgctttattgcacttgcttaccccaccaatacaatattgaatagaagtggtgagagtggacatccttggcttctttctgaactttagagaaaagtattcaatattgtaccattaaattggatattagattagatttttcatagttgctcgttgtcagattaagaaaattattttctgttatttgaaaagggtttttgtcatcaatggctcctgtattttgtcaaatttttttctatatatattgaaatggtcatatggcttttctgctttattcttttaatatggtagatgacattgactattccttatcctgaaataaacctaatttgtaatgatgtattagcttttttaatgtattactagacttgatttcctaacattttgttaaatattgacagatattggtctgtaatttttttttttttttgtaatgtcttttcgggttttatgtcagagtattttatcctcataaaatgagttagggactgggcacagtggctcacacctgttatcccagcactttgggaggccgaggcaggtggatcacctgaggtcaggagttcgagaccaggctggccaacatggtgaaactctgtctctactagaaatacaaaaaattagctgggcatggtggtaggtgtctgtaatcccagctactcaggaggctgaggcaggagaatcactggaacctgggaggtggaggttgcagtgagccgagattgcgccattgcactccattctgggcgacaagagcgaaactctgtctctaaattaattaattaattaaattaaataggccaggcatggtggctcatgcctgtaatcctaacactttaggaggctgagacgggcagatcacctgagatcaggagttcaagaccagcctcgccaacatggtgaaaccccatctgtaactaaaaataacaaaaagtagccgggcttggtggcacatgcctgtagtcccagctacttgggaggctgaggcaggagaatcacttgaacccgggagatggatgttgcagtgagctgagatcacgccactgcactccagactgggtagcagagcaagactccatctcaaaaataataattaaataagtaaataaataaaatgagggatttttccttctctgttttcagaagtttctgtaagatgagtattgtttctttctgagctgtatttgatagaattcatcagtgaaactatctggacttgccaatttctttctgaaaaggttttgataatttaattttttaagtaaatatgtaaggtttgtgttttatatgaattttaggttatatttttgaataatttgcccatgtcatctatgttattgaatttattgacatgaagttgttcataatattccattattatccctttgatgtctgtagaatctgaaatccccttttactcctactgttggcaaattatgaattctctttcttttttaaaaaaatatttcttactcagtctacctaggggtttagcaattttgttaatcttttcaaagaaccactttttgactttgttaattttctctatggtttgttgcctattgagttgatttctgctcatacctttgttacttattccttcacttattttcagtatatattattttgtttttctttttctaagcttcttaagatgaaaccttacttaccttttctaaggtaagcttgtgaagctataaatttccctataaacactgctttagtctgggcgtggtggctcacgcctgtaattccagcactttggaaggtgggtggatcacttgaggccaggagttcaagaccagcctggccaacagggtgaaactccatttgtactaaaaatacaaaaactagtcaggcatggtggcacacacctgtaatcccagctactggggaggctgaggcaggagaattgctagaacccaggaggcagaggttacactgagctgagatctcaccactctactccagcttgagagacagaggaagactctgtctccaaaaaaacaaacaaacaaaaaacacataaccaaaaaataaaacacacacacactgccgggcgtggtggctcacgcctgtaatcccagcactttgggaggctgaggtgggcggatcacgaggtcaggagatcgagaccatcctggctaacacagtgaaaccccgtctctactaaaaatacaaaaaattagctgggtgtggtgatgggcgactgtagtcccaactacttgggaggctgaggcaggagaatggcgtgaacccaggaggcagaggttgcagtgagccgagattgcaccactgcactccagcctgggcaacagagcgagactccgtctcaaaacacacacacacacacacacacacacacacacacacacacacacacaattttggtatgtaatattttttacatcatcctgttcaaaatattttctatttattaggtaaatttgtggactatttaaaagtatattgtttaacttccaaatattttggttttagctgcatgtggtggcttacacctatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttcaccatgttaggcaggatggtctcaatctcctgacctcgtgatctgcctgcctcagcctcccaaagtgctgggattacaggcgtgagccaccatgtctggccagatagttaggtttctaaaagaaaaaaaattaggctgttaacagatagatacatttaatttttcttttttacatttattgtttattttaaaaaacagagatggggtctcactgttgaccacgctggtcttgagctcctggtctcacaggatccttctgccttggcctcccaaagtgctaggattatagtggttggtattgtaatagttaaattcacattttttgtttgcttttgtttttgtagactacatatgggtgggttttttttttttctttttgagacagagtctttgtcacctagactggagtgcagtgatgtgatctcagctcactgaaacctctgcctcctgggttccagtgattctcctgccccagcctccccagtagctgggattacaggcatgtgccacgacacctggctaatttttgtatatttagtaaagacagggttttaccacattggccaggctggttatgaactcctgacctcaagtgatccacctgccttagcctcccaaagtgctgggattacaggggcccagcctcatatgggtaatttttaattcttggttgctgtagtgggttacgtggtggcccccaaaaggatatgtctacatcttagtcctcagaacctgtgattgtgaccttgttggacacagggtctttgcagatataattaagttaaggtccttgagatgagatcatcctagattatccagctgggctctaagtcaggcatgattacaggcatgagccactatgcccagccaatagatgtttattaattgaattactcttcaaatattcaggagctcaaaaaaataggcactatcagctgggctctttggctcacacctgtaatcccagcactttgggaggccaaggtgggctgatcttgaagtcaggagattgagaccatcctggccaacatggtgaaaccctgtctctactaaaaatacaaaaattagccgggtgcagtggcagcgggcacctgtaatctcagctactcaggaggctgaggcaggagaatcgcttgaaccagggagtcggagattgcagtgagccaagatcacaccactgcactccagcctggtgacagagcaagactccgtctcaaaacaaacaaacaaacaaacaaaataggtactttccttgattccttagtctcactcacatatttacttcttcaataaatccttgagtttacctccagaacgtaccctgcatctgcctccttttctcgctctcctaccacagccctcgcctctttactgactgtggctttacacagggctacctatgccatggcccctgtatactctctgagttcataaaatatcgtttttttcccagttcactccactccacattgttctttttacattccaaatacaccaagcttactgaaggccttagctattggagttagttaaggcctttgtatcggttgtttctacctcaagcgctcttgcctgggatctccatgtatttagctccttgtaacttaggtctggtataagtcatttcctcgggaagaccttttcattctaaagtagttccatcatcctgtatcatattatcctattttttatagcatttatcactccctgatattttctcaggtttatgtgtttgcttattatttgttgcaccttactagaatgcttatctgtcttgctcatggatgtattccatgtgcctagaacaacacttgggatagaggaagaactcaataattatatagtcaacaaatgaatgagtgaatgaacatattgatatatctgaacaagacataaacctctacccttctacccttcccagcagcccagggaacaaactcatcatgttcttctgtaaccctcatccttggacttgacatatgtttcaccttcttccatgtaaaagaggtgatgatagtagtaattttaactgttcacctgctgaggtgtgcacagaagactagcatgcactcagctagcctttccaaatccttccatgctcccagatgtccctgtctcttacaagcactccttgggctctgcccaggcctttgcttttaaacctccctcctcctgacccggactagtgattctttccattggtttgagttctacatgaatgacaggcctctcctccttgctccacagaacaaaggaattttactgctgagatgaatcttagaaaagaggaagaaatgtgtaatggttaagagcagaagttctgaagtcagactgcctgaatttgaatgtctccatcatttactagctgggtagctttgagcagtttctgaacttagtttctgtgtttattttatttttttaatttttttgagacagggtctcactctgtcacccagactggagtgcagtggtacgatcttggctcaccgcaacctctgcttcccagggtcaagaaattctcctgcctcagcctcctgaagtagctgggattacaggcacatgccaccacacctggctaatttttgtatttttaacagagatgggggtttcactatattggccaggctggtcttgaactcctgacctcaaatgatcgcccacctcagcttcccaaagtgctaggattacaggcatgagccactgtgcctggccctctgtgttttttaaataaagataaaaatagttgtcccttggtatcttcaggggtttggttccaggaccgcctccaccccccgaccccgccacacacacccagagttacaaagtctttgggtgctcaagtcccatatgtgaaacggttgcatagtatttttgtatataacctacacatatctttccatatactttatttctttatttttaaatcatcatcaaaatatggaacacttcacgaatttgtgtgtcatccttgcacaagggccatgctaatcttctccaaatcattccagtttgagtatatgtgctgccggacgagcactagatgcgggtgacccttgaacagtgagggattagctgttttcaccccacacagttgaaaatcctaggataactttagactccccaaaaacttaactactaatagcccactgttgaccaaaaaaggcttactgataacatacagtcaattaacacataaactagtatctatatattttttatgtattcactacatacatttttcctaatttttttggtacgtctatgctgtgtggtccatctatgaggttttccaaatagtcataagcctccaaaaatttttccaacgtaatttattgaaaaaaaaatctgcacgtaagtggacctatgcagttcaagcctgtgttgttccagggccaactgtactttaaattatctcaagattacatataatacctattactatgtaaatgctaagtaaatagttgttatgctgtatttttaaatttgtaatagtttattgctgtgttgttactttctactggttttcttttcttaaattttattttatttatttattttttttttgagatggagttttgctctgtcgaccaggctgggctggagtgcagtggcatgatctcgactcactgcaacctccgcctcccagattcaagcgatcctcctgcctcagcctcccaagtagctgggattacaggtgcctgccaccatgcccagctaatttttgtatttttagtagagagaggatttcgccatgttggccaggctggtcttgaactcctgacctcaggtgatccacccgccttggcctcccagtgttgggattacaggcgtgagccactgcacccgacattttaaatatttttgatctgcagctggttgaatccatgggtgtggaacctacacatatgaaggaccaactggacccacctcatagggttgtgagactaaatctacataaagcacttaactttgtggctgtcatgtggtgaacgattagtcaatgtcagctgcttctattatgaagttgataatttaaacaaaatttagtgtggctcaagtatttattcacccaaaagcaataggtactgtgctaggcacagggttccaccctcaagaagctcagagtctaatgggggagaaagataagtgtagaagcagttccagttgggtgtgataagtgctaattagaataagaggttctaggagcttaaaagtggaggccctaatttataccagtggttgggaaagagtgaggccagagtagagacaggaatactttttatctggcttctgctgtgagtctcagctgtcttcattttttcccaaaaggttagaaccttcagaaattggcaccttctaggccctggcactgtctcttccttggctattttagaggttacaaaccagtctttaggcataatttagcacagaattttccaaacagcattgtgaagaacactgtatactgcaatatgatgatggttctgtggatttaaaaagaaaaaaaaaagtattccatggttcaaataagtttggaaaatgccagagttatatagaatttcttcttgcagcactcctgctgccaactttttaatatatgaaggtgcattattaatctctggaagagggatatagtttccaaatttgatttactccagaccatcttttaataacttacagagttaatgttccttggaataatttgaaagatccaggcaggtggccactgcagatttactgtattagaacatagtccagttcctccagagtaaaaaatgtcacatttcttttttttctttttctttttttcattttttctgtttgcccctcctaccatttgaaaaaaacatcaaatttaattaaggctatttctttagttctgcatgacccatgtgagaataacaaccatcaggtaataatgaagtgttttcaagagttctaaccatctgaagaaagaacctttctccacgaaatactgtgtgtctccactatcaggcgtctcttcgtttagcacttaagaagaactggttctattgctcattcgtacgcacactgggcataaaattagatctatgacctctcagcggctggctgattgatttaagtggtctgctgaagaaggtaatggaaaattgaacatgactcctttcccaatggctttctatgatgaaaaagttagaaattatttgagctggagctctagagtgagcttcagcccatataactcagaatattccaatttctgccaggagaatatccaggtacaataaagctccactgtaaagcacctcaggatagtacagatgcagtaaacctgtgggttcagttacgtcctcggtgtactttgaactataaaatcagaaaataatcacacaaatatagtccctggtctttactattcacgcccctgcacaattctacttacactgaaaattataatttatggcatagttggccttgattctttgtagttattctatacgtgcagtttaccttattatctgacaagccgaaagaaccaataataaaatctatggcataactcctacaggagctttctgcaaccccaagtattttttctgaagttttagtcacatcttcaaatggtctcagtttcttttgtctctggagggacaaggatggcagagatgacctctgagaacctttgcagctttcaaattctttgagtctaataattggaatgagtaagggagcctcaagtcttttgtcatttaggctctaactggattgttggggaagtcagaaattactgatggagtcagcaatttctagcacacaacaaactcttatattctgaacaactgtctttaacagacaagctgccacccactcctgaactgtaataatccggtagcactgtcctgtccaggactgtgaggccatcacacatctggaacactaacagcaactctcatttcatagtagtttctctgtgccaggcacaatgcttagtgctttatgcatgttatcgcttttaatctttaaaacctgaattatcctcattcatcttcactttatggatgaggaaaatatcaaatgaagccacttgatcgtggttatccagcttagtggtggaaaagccaggattcaagctcaggtctctctaattcccagtctgtgttctttccacatcgtcgtgttgcctctcagtatactccacaattctgttagagtctgaaaagctttgctgaagcacaatccagaggggactgtggctttaccatttcaaaccatgcttcacagtagcattgggaagacagactctggacttttttttcccagttgcttttggctaagagttgaccattcttagggtgagaatgaagtccttttgataaactatgatgttttagagatagtgcccttctcttgaatatgaaatgtgacctttttttcccctacaattgtctgttctgttcaggtataggttctacagctcagacacagacatccatagtccttaccttacaataacagactcttggagttgtctaatctagcttcttgtcctgcataggaacgccttagtagacacatctgtgatctttacctttggaaccatattacttttcactgaggaaaccaatacacaaaagcctgaagtcatttaaataaagtcatgtagcaagaaagttgatatccttttaagggataccacagaccagaaaaaggcatgtatgctaagctgcgcttttctcaacatcaaaatacaggatatagatacaccttccaatgaccaaggtgttcctcaccacctccgctcattggtataccagtgctctgttgcacttttagatactgttctaacatctagcatttattgagcgttaactatatgcaagaaattgtgctgaatataaattttggttttaagttcaaacctgagtttgagtccccgctattcactagttttgtgaccttgaacaaattccttaagttctcaaagcctcagtttccagatctgtagaatggtgatagtagaatacttgtttcagggttattgtgaaaataaaaagagataatactatattaatatactaggttgacattaaaattgtaccaaactgcctgttctggttttcaacccataggtgctggctttcttctgcctgtttatcttattagggggctggaaacaacctataccaacatggcaacatcataaaaagtgtttttttttttaaatcatccttaaaaaaaaaaaaagcaccagataaggcttactctttgttctctgaggaagtggaatctactgcttttttttagtcacttttgacatttttattagcttagaagttctaagttgtttatactcattaatgaggattgaagcttctagattctcctaagtttcatcattcatccaaaaattattggtgtctctgccttcagaagcctttattaaaaaagttctctgttcctaggaatatctaacccctattgatatgtctcatatcttcagcattcaagggggaattcattagactgtaaattctcaaagacttgaaccatgttttctacaactttgtgtgctattcagagcctagaacaactctttatataaacagatgttcgtttatgttatgtaaatgaattaattctagacctttccagatcctgcaaaggatgatgaaatactctagtaagagcgtagggtgaggggaagagtgttaggactgtagcaccttcccatgtcattaatttcctttgactccttgagcaggtcactactctgaccctcaggttggagttataagtatctctaagggttcatgcagatttgaaattgtatgattataactaaatcagctttttactgaatgaagtaatgttttaagtgacatgtcatagcctaaaattatttccaaatctattgcctcacagggactgttagcccaacttgtttatgtgaaatctttatgaaagtgaactgacttataattgtcaggtacatttgaagtaagagcaagacttgaattcccaaaagaagtgtggcagttttaatttatttccttgttaggaaatgtaaaacttaattagaccttggctagtttccctgtaagatctaatttatggagtttggtatagtaggtaaaacagaatgatggttctgtaaagtgcactctgtcaaaaaatgagtgcaggccagggacagtggcacaaccttgtaatcccagcactttgggaggctgaggagttccagaccaacctaggcaacacagtgggactctgtctctacaaaaaatactttaaaattagccaggcatggtggcacacacctctagtcccaactacttaggaggcggaggcaggaggatctcttgagcccaggaggttgagggtacagtgagctatgatcatgctactgcactccagccggggtgacagaatgagacactgtatcaaaaaaaaaaaaaaaaaaaaataggtggcgggggatgagggatgagtgcggctctatataacgtagaagttgaggaacttcaaaaagatagtcccttgtccgggcacagtggctcacgcctgtaatcccagcactttaggaggctaaagcaggcagatcacctgaggtcaggagttcaagacgagcctggccaacatggggaaaccccgtctctactaaaaatacaaaaattagcctggtgtggtggtgggcacctgtaatcccagctactcagaaggctaaggtgggataattgtttgaacccgggaggcagaggttgtagtgagccaagatcacgccactgtactccagcctgggcgacagagcgagactccgtccccctccaaaaaaaaaagacattcccaatcataaatgccttccccactggccagtttctgtgattcagagtgttggcacagcatagctgggttctctgcttaggatcttaacaaggatgaaatcgcagtgttgttggggggccttcattttcatccggagttcagggtcctcttcaaagttctttcctgctgttggcagaattcaggtcctttcagttgtaggaccaaggattccttttccttgctggctgttggccagtcattgctctcagcaggtgactacagctccttgccaccaggcccctcacagcatggcaactcacttcttcagagccagcaacagaatctctcgcctcagtctgctaagatggattcttacataacatagttatgggactgactagcccatcacctttctcatatacagtaacctcatcacaggattatcgtagtcacaggttctgcccacctgaggagaggggattacacaggatatgtggaccagagggtggaaatactgggcggggggcacgtcagaattctgctcagcacaccagccatcattttagaaacctacacctttggttttattattctgaagatagggacattttaactgatttaaattttagggctggaagataacttaaaaatcattttgtttaaacccttactttgttttttggttttttgtttgtttggttggttttttttgagacagtcttgctctgtcacctaggctagagtgcagtggcatgatctcagctcactacaacctccgcctcctgggttctagtgattctcctgtctcagcctcccagttagctgggattacaggcacacaccaccacgcccagctaatttatatatttttagtagagacagggttttaccatgttggccaggctggtcttgaactcctgacctcaggtgatctgcccagctcggcctcccaaagtgttggatttatagacgtgagccactgtgcccggcctgcttgtttttaacattcataaagggaaatgacttgctgaaatcacagaccagaagttcaggttcagcgacttccacaccagggttctcattagtaccctggcacctactgctgctagaaggagctagagaattacatcgaggactcaatgcttttatgtgatgccggaaagtggggcaaattcacagcaagaatgtagggagagcatcccccagacagccaagacatggcaggaaggcaggagtgtcacaaagacatgtaaggaagagattacaacaggaaaaaagctcctattttataaattcttttaaagtttgtgggaggcaagctcttgcacttcagttcatcattacatttggtaaaaacatttatatgtgaagaggagtgttggccaggattccattcatttaagacagagtcatcaatttttaaagtaaaattattcatgatgtaggcaaggaagctcaaattctgaaataaatgtttgctttatgaggcattttctctgcagaggcctggtttattttcccaaatttaaagtcacttagcaattctaaagattgattctggcttatgatcactttgaatatattatgatttagtaaaattaggtaagtgccctaaggaggaggagagctgctttagggattcatgattaccatcatgaattacatcacaaagagaagagatgggggtaggataaactgttaaagcatccacataaatagataaggaaagacaaaatcagccaacattacatcccactgagaaaaagatcagaaaaagaatgattactagaattacatcaatatcgggaaagtgtagagggagtatttattataagcattgcttctttgggggtttcaaggtttactaccttgagaagcctcggaaggtttaataagacactgtggctgggcccagtggctcatagcctataatcccagcactttgggaggccaaggtgggtggttcgcttgagcccaggagttcaagaccagcctgggcaacatggtgaaaccccatctctacaaaaaaatacaaaaattagccaggcatggtggcgcgagcctgtagtcctagctacttccgaggctgaggcgggaggatcatttgagcccaggatgttgaggctgtggtgagctgtgccctcactactgcactccagcctgagcaacagagcaagaccctgtctcaattaaaaaaaaaattttttttaataaaattgtttaaaaatgcaaaacctagccaggtgtggtaatccacacctgtagtcccagttactagggaggctgaggcgggagaatcaggagcccaggaggcagaggttgcagtgagccatgatcttgccacagcactctagcctgagcaacagaaccaagaccctgtctcaaaaaaacaaacaaaaaagacacttgtaaaggtgactatttagtctttaatttcaacaaactgaatttaaatatatcagttactctcagtttagccatcagagattcagactctgttatagctgacccccacagaccacaaaggaaataattttttaaagagaaggggaaaaggtaccttcttctcaagattgagataagaataaataaggaactggttaaataaacaaggaaattatgatccatcctgtcagtggaatactatgcagctattgaaggaagctgctcatgtccatctggaattatttctaagatatgttgttaagtgagtaaagcaaaacaatatttagtacaccaccattttgtgggaaaagggaagaagcgaagagtacatatttgattttatatctacaaaatatttctggggaaactagtgatattgattgtctctgaatgactgggtgactggggtataaggttgggagagagacttcaccccttttgtaccattcaaattttgaagcagatgactatattagcgaatcaaaaacatcttttttttttttttttttgagacagggtcttgctctgttgcctaggttggagtacagttgtgcagtcatggctcactgcagacttgaactcctgggctcaggtaatcctcccacctcagtttcccaagtagctaggactgcaggagcgcaccatcgtgcccaactaatgttttttaaaatttttcgtagagatgaggtcttcctctattgcccaggctggtctcattcttggcctcccaaaccactaggattataagcatgagccactgcacctgtcctaattaaaaacaacttttaaaataaagctaacagaatgaatatttaaacaatgtgagagggaaaagcaagttactattggacggaggcttgctctgtcgcccaggctggagtgcagtggcgtgatcttggctcactgcagcctccgcctcccgggttcaagtgattcccttgcctcagcctcctgagtagctgggattacaggcatgtgccaccacgcctggctaatttttgtatttttagtagagacggggtttcgccatgttggccagtctggtcttgaattcctaagctcgggtgatctgcctgccttggcctcataaagtgctgggattacaggcgtgagccaccacacttggcctgttttaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcactccttcctgcttttaatactgtattcaaacagaaacccccaacccacatcactcactaccatacatgcgcagttggtctcttttctcccttagaattcagatacaggccaggcgcggtggctcatgcctgtaatcccagcactttgggaggtcaaggcgggtggatcacctgaggtcaggagttcgagaccagcctagccaacatggcgaaaccctgtctctactaaaaaaaaaaaaaaattagccggacgtggtggcaggcacctgtaatcccagctactagggaggctgaggcaggagaatcacttaaacccgggaggcgaggttgcaatgagccgagatcgcaccactgcactccagcctgggcgacagagcaagactgtctcaaaaaaaaaaaagaattcagatccaaaatgtaactcataccaaatacacactattccattatttcccatatgtgtgtattaatatatctgatatctgtctcttctacgtgtttctccatcttaatgtgtgtgtgtgtgtgtgtgtgtgtgtgtgtgtgtgtgtgtgtgtgtatagatatatatatacacagtctcctccaccaaactgtgattgtcccatgggtgtgtcagctgaaatcattgactacctaatgatgcttgcagaaatgctagccctttgtggaaaagatgtgatggggatttttaataaacccagatacaatactagacaatggcaataaatcttactgccaagttagtttgtaccaaattaagcgtgtaagcccattgaagccatcatctgggatgatgcgctcaggctcagaaaacagatcttctccgtggtgtgtcctggaagttaggagctaggattagcagcatcacctctgacagtcaggcagcctgagtacacagggggtcagcgggcatagggcctaagagcaccgtacagaacaaggaattgttatcatttccattacttgtaggctgcattgctcttggctccttaaattgctagttctcctaaatgttgtcgtttcccctcccctcaccccagaactaggttaaaatgtgcatttgtattaacaaaagctcatggaaggagatacaaaagacaggacacatgctctttaaggaaatatcctcccccttgttccacccaaagccatctagggatggacttaagaaaacaagacatctgcatcagcctttccagggctgaagcagaaccatctcccctcacttaaccttggccgtcaccagtcagcttttgattttctccactgcagtccggtaaggcaggaatagtacatggccacacagcttagagactgtcagcccaacttgtcataccacctttccaaacacttttgcattaggaagaggcaggtagctcctaactgggtcatgctgcctaaagctgtatctgtgcatcagaggcagctgtggagaaaaactcccagggccacattcgttacatgtgcttttcgttggattgctgttgaatacactttttaagttgtccctaaaattgtcggtatgagttcctagggaatactcagtgtcttccactgtagggggtagtcagatccacggccaacctataattaatgctggtgcctcacaactcccagttattcaattattcattcatccctcaccaaaaggacttgagtatttcccatgtgacttttctttaatctaaaccctttctcctcagggtgacagattcatgtcatggaggaattgatattgtccatatatggaagggatcatgtggacccagtgtgtatagggaaagggcaccagccaaaattcgagacccagctctgttaccatctagcattgtgaccctgggcaaattatttaacgtcacatttcctctgaggtatcttccagttctaagattctctgattccaagtggacatttgggctctcatcacttcagagctcttctgtttaactattgtggtgaatagatttatgtatgtagtttctgatattatatcacacaaactcagggtttctttttactgttgaaacagccagtcatgaatcatgctggagagtaaattggggacctgacacaactcggattctgcctggactttgcaaaaagccagatggtgccagatttttgagtactagttgagcccacttctacaaattctctcccatcccaatctaataggaatcacccaatcgcacttaaaccctttgttcaggcagctgggccagatttgtacaaaaatacgtagtatttagaaagctaggccttcgctggggtgccttcttgctccctgtagacatctttcagattgggagctggaatcccaaccatcagtcagcatcatcaaatagggaggccagaattccagtaccaacaactggtctgcataaaaaagttgagatctgggaggaaaacttgttctgcttgctgtgattatgactggattcagagatattggaagcaaatatgaatgaaccaactctcaggaccagctgtcaagcacttggcttgtaatctgccgtcatcccactcatcccaggtgctcctagtttgacagctcaccagctattaaatgttggcttcctgcacgactctgattcgtaccccaggggcctataatgaggatcttgtaccaggaaaggggaccccagctaggctgtttgctggctaacatcccagtggtttgggctacaataacttagcagccctagttcttcctcctatggtaggaaggacaccagagccctctccatgtgagatggaacataatctataactttctgtgaagagatggcatctgtaatgaggcattcttgctggaggcctccagaagtccctattctacaaccacttaataccaatttaatgagcctctcattagaaattgtcaagagctctcactgacatccttgagtattatttaattaatggtttatttacaggaaagggcaccatcttcatggggagaagatgagtacttgaaatatcaagacaattgcagaaggctgtgccctgagagaatggaagaactgggaaagagaaaaggaagtcagaagcttaaggttgatgtgaaatgcagaaaaaggaatggttaacagaaagtgttcatgtttatctaatacagaacaggttccgatccccttctcaggacacatttctgtggcagcaaagagtaaagctgtaggcaatcacagtttaagcgcttccagttccttctgatctcattctgttttcactgagtaatcttttgaggttaatcttctgaggtgaatggggtttccttagtagctttcctactgagaagtataatgaccagctgtcatcattgtagttctcttaacagttactattcttattgcaaattggcctgatttctgttccttctgtggacagtttagttagcaggaataagtttttcctgagccaaatcaagtatctagatttgtgaggctaaatttctaaactctagagcgctatagtcttgtagatttcccaacacacatctcatgaatatccaccacaatatcttatacttcagtcttttagtaccaaagaatgttaatttcctcttcaccctaactcagatcctgggagaaaagatgggatatttccaccccatcctcaccctcagattctagatgacaccaataaacccttctttgtgctagtaagccgcctcagcagttgtctggtggcatccctccacttgaacatgagaaaattaaatctaaagagatcaagtgactccatccgggtcacacagcacgttggtggtggggccagaactggagcccgggtcccgttactccaagccttgttttctaccgcattaccttgctcctctgcattgctccagtgtttgcatctgctgatgttgggggcactgtggtgatgtattaattaattcttgcattgctataaagaactacctgagactgggtaatttataaagaaaagaggcttaattggctcacagttccacaggctgtaaaggaagcatggctgaggaggcctcaggaaacttacaatcctggtgaaaggcgaagaggaaggaggcacgtctcacatggccagagcaggaggaagagagagaggtgggaggtgccacacacttaaccagatctcatgagaactcgcttactatcatgagaacagcaagggggaaatctgcccccatgatccagtaacctcctaccaggcccctcctccaacactggggattaccatttgtttttggattttcagggtttttttgtttttgttttgcttttgtgagacagagtcccgctctgtaaccgaggctggagtgcagtggcacagtcttggctcactgcaacctccgcctcccaggttcaagtgattctcatgtctcagcctcctgagtagcttggactataggtgcgcaccaccacgcccagctaatttttgtatttattttagtagagacagggtttcaccatgttggccaggctggtctcgaactcctgacctcaggtgatccatcagcctcggcctcccaaagtgctgggattacaggtgtaagccaccacgcctggcctgggaattacaatttgacatgagatttgggtgggggcacaaatctaaaccgtatcgggtaaatatatggaggtgatagaggcaaagtgaaagatcaaatgcaaaaaatgacaagatgggctgataataggaactgaaattataggaatgcgataaacaaggcacagtggttctagtttaagttcacttggcttctggatgaatctaatgtgatgattatagagagctcttcattaccagcataaatggaaattaatccttttctttccctcatattttacctcacttaagaatgtgtccagaagcaataacatgatttataggtgtagctagaccaggtttgaggataaatgagagagaaggcagtggaaattgcctcgtccttcctgtcttgtctttcatgagaacccaattctaacataattgctagtgtttgacggtgaatgtctgggaaagagaaaacggcaagagaaaagtgattttttgctgaggtctaaaaatatatattttttaaaagaaagatatgcatcctgaactattggccgggcccgctgagtgtggtggctcacccctgtaatcccagcactttgagaggccgaggtgggcagatcacctgaggtcaggagttcaagaccaccctggccaacatggtgaaaccccatctctactaaaaatataaaaattagccaggcgtgatggcaggcaccagtagtcccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccacatggtgaaaccccgtctctattaaaaatacaaaaattagccaggcacagtggtgcgtgcctgaaatcccagctactcgagaggctgaggcaagagaatcacttgaacccgggcaggcagcagggagcagagatcgtgccacaacactccagcctgggcgacagagcgagactccatctcaaaaaaaaaaaaaaaaaaaaaaaaagataatagtagatggcaaaaccaggatttgaactaaaactgtactgccccctctgttttatttactatattaccaccctctcttaccccacagccagtatttgttgttcatcatcctccagaaagctgggctaatggaattcaagagcctgctcaaaagctccagcctatggagcttcccttttggtcccagcataagaatcacttctgggcttttttattccttaacatggttccctgagctttttaagggtagttgcaagtccttttcaccttcctaccccccataggaccttggatagtacttctcacataataggtgttcattaacttgaattatttatgttattaagttgaacttgagttatttaaatctctagccttggcctggcgtggtggctcatacctgtaatcccagcactttaggaggctaaggcaggaagatggtttgagcccaggagtttgagaccagcctgggcaatatagtaagaccatgtctctacaaaaaattttaaaaattagccaggcatggtagcacatgtgtgcctatagtcccagctactcaggaggctgaagtgagaggatcgcttgaagcggggaagtcaagactgcagtgagccatgatcacaccactgcactacagcctgggtgacagagtgagaccctgtctcaaaaagtacaattaaataaataaaataaatctccagcctatacctacaaaaccaaggttgaactcaaaggaagccctagggctaggttaaagagatggcctcactctcaggtaggggtgggtttattctctagagctgccctgtccacagtatgataccaccaaggcacatgtggctattagctacatttaaatttaaactagctagtggctactgtattgaatagcacaaatataaaacatttcccacatcgcagagagttctaatgcacagcagtgctgtagacatatattaactttctccagatttttgttttcactccaatcacttctaggtggtttaaattttttccaaaaaacatttatttcttattatttttataatttttgaagccaatatccaagacctggtctgtgaagtaaatatgggaataaatgcaactagcttctcaagtccccccttttccctagaagtcctggaaaatgatgtttgattttctagctttttagaaagaggttctgtcattatctacttaaatcacctttggaaaattatttaacatctctgagatttattttcttaatctagaaagaaaaagtatacttaacaaaaagccgttgttatttttaccactgcaagatcttaggtcaaaatgccaaaggaaagcctgtagagtggctcacaactgtaatcccagcaacttgggaggctgagatgggaagatcacttgaggccaggagttcaagaccagcttaggcaacatagcgagatcccatctctacaaaaaataagtttagccaaggtgtggtagtgtgtgcatgtagttctagctactggaaagctgaggtgtgaggatcacttgagcccaggagtttgagactgtagtgaggtatgatcctagcgctgcactccagcttgggcaacagagcaagacctcatctcaaaaaaaaaaaaaaaaatgaacaaacaaaataaagtgccaggggatggagaattcgattttcaaatagacttcttcatcacagattttagaattgaactcacaaatcacacatgcatgcaaataacatacagttatagacctggttcacagtaacaaaatccactcatagtggtcatgtggtccttacggaagcagaaggtaaacccatagtagtttgaatgaagtgacttcatattttttcattttcaagcttctttttcttttttcttttttttttttttttgaggctcactcttgttgcccaggctggagtgcaacagcaacagcacgatcttggttcactgcaccctctgcctcctggggtcaagctcttgttgcccaggctggagtgcaatggcatgatctcggctcactgcagcctctgcctcctgggttcaagtgattctcctgcctcagcctcccgagtagctgggatcacaggcgcccaccatcacacccggttaattttttttgtatttttagtagagacagggtttcaccctgttggccaggctggtcttgaactcctgacctcaggtgatccacctgcctcagcctcccaaagtgctgggattacaggcatgagccaccacacctggcctcaagcttctttttatacaaagtgtaagaatcctgtttagaactttctgttctcttaattacatttttttttaaatttgtttttgtttttttagagagaggtctcactatgttttctaggctggcctcaaactcctgactcaagtagtcctcccttcttggcctcccaaaatggtggggttataggcgtgagccaccacacccgctctgtcaccaggcaggagtgtggtggtgcgatcatagctcactgtaacctcaaactcctgagttcaagtgatcccctcacctcaacctcttgagtagcttcagaggcacatgccaccacacctagctaatttttttgaattttttcgtagagaaagagtcttgcgatgttgcccaggctcgtctcaaacttctggcctaaagctgtcctcttgctttgacctcctgagttgctgagattacaagcatgagccaccacacctggcctacatttatttttttcttttttttttttttcgagacagcatcttgctctgttgcccaggctggagtgcgggggcataatgttggctcactgcaactcccgcctttcagactcaagcaattctcccacttcagcctccaaagtagctgggcctacaggcaggcaccaccatgctcagcttattttttaactttttgtagagacagggtctcactatattgctcatgctggtcttgaactcctgggctcaaatgatactcccacctcaacctcccaaagtgctgagattacaggtgtgagccaccatgccccaccttggcctatatatatatatttttttctttgagatggagtttcactcttgttgctcaggctggagtgcaatggcacagtcatggttcacggcaacctctgcctcccggggtcaagcaattctcctgcttcagcctcccaagtaggtgggattacaggtgcccaccaccacgcctggctaatttttcatatttttagtagagatggggtttcaccatgttggccaggctggtctcgaacttctgacctcaggttctccacccgtcttggcctcccaaagtgctgggattacaggcgtgaggcaccgtgcctggcctcggcctacattcttgataagccaaattattcattacttttcagccaagcaaggcttttttttttttttttttgagacggagtctcgctgtgttgcccaggctggagtgcagtggtgcgatctcggctcactgcaagctccacctcccaagttcacgccattctcctgcctcagcctcccgagtagctgggactacaggcacccgccaccacgcccagctatttttttttgtatttttagtagagacgaggtttcaccgtgttagccaggatggtctcaatctccggacctcatgatccgcccgtctcggcctcccaaagtgctgggattataggcgtgagccactgcacccagcccaagcaaggctattttttaactttttattatattgcaatataatatatggaaaagtacaatttctttttttttgagacagagtctgactctgtcacccaggctggagtgcagtgacgccatctctgctcactgcaacctccatctcccagattcaaatgattctcatgcctcaacctcccaagtagctggaattacaggcgcccaccaccatgcccagctaattttttgtatttttagtagagacagggtttaccacgttggccaggctggtcttgaactccgggccttaagcaatctgcccgcctcggcctcccaaagtgctgtgattacaagcgtgactcactgtgcccagcctaaagtacaaatatcttaagtgtacagcttggtaaatttttaaaaagctgaacacacttgtataaccagcattatttagaaacatcacattaccaggactatagagccctacttggtacctccagtcacttccttccccaagagtcaccacttttctgacttctagtaacacagttttacctttgtactttatataaataagccaagtgtttttttgttttggttttgggttttgttttgttgggtttggttttgggttttgtcttgctgtggggggtttcctgtctctgaggatgcccatactctcttcagccagaaaacatgagccagtttaggttttgggtactctacagaagtaaaccatttattccttcttaccacactcttcccagaccaatcatgagtagaggtaggtttgtgggtttcctgctatcttatcaccaccagtaatgggtgtcattattttaatcaacaggcccctgggtgtcttgcaaagggtgactgtacctctgctattacagtggttactgttctgtgtggcttgggtggtttctaattaaaacagatgctcttggccaggcgcagtgtctcacgcctgtaatccagcactttgggaggccaaggtgggcggatcatgaggtcaggagattgagaccatcctggctaacacggtgaaacccatctctactaaaaatacaaaaaaaattagctgggcatgatggtgggtgcctgtggtcccagctacttgggaggctgaggcaggagaatggcatgaacctgggaggtggtacttgcagtgatccgagatcgcaccactgcactccagcctgggtgacagagtgagactccgtctcaaaaaaatatatatgtacaaaaattagccgggcatggtggcatgcgcctctagttgcagctactcaggaggctgaggcaggagaatcgcttgaacctgggaggcggaggttgcagtgagctgagatcgcgccactgcactccagcctgggcaacagagcaagactccgtctcaaaacaaacaaacaacaacaacaacaaaaaaaaaaacagatgctctccaaagtttcttccagccctctgacactgaagagggtggattaggaaaccatgagaaaatgggctcaatccaaagccaaagtttgattttggttttcaccacgaaaccccctcaccatctctccattacagcagagagactattgcagcagtctcctaactgaccccaatattccaggtgtgccgccttccaatccatcctcacacaaccagccagaaaaatctgtccaaaatggaaatctgcctgcttcttactcccctgcttccagtttttttctgatgttccattgcctggaagagaaagtgccagacctttaggagcaatacagaccctggggggacctgtctcctgcccacctcttttttttttttttttttccaagagacatggtctcactgtgtcacccaggctggagtgcagtggtcatcatagcacactgcagccttgagctcctggtgattgccgcaatcaccgggtggtaatcaagcgatcttcctgccttagcctcccaagtagctgggactacaggtgtccaccaccatgcccagttaatttgaaaaaaatttttagagacagggtctcgctatattgtctaggctggtcttaaactcttgacctcaagagatcctcctgcctcagcctcccaagtagctaggaaatcaagcacaagccaccacactcagctccctgccttcctccttagtttacttcccatgcacctgcttctttagtgtccagcaatacctaactgcctacttgcagttccctggcagccacgctgtatcctgcctgtactcatgcttatgctgcttctcctccctggaatgcctccctcatctccccttaacttggccaattgctgctaatcctgtgagattctactcaggagtcacttccaggaagcctttactatctgtatttgcattaccctcagccagggtgggagattcttcctctgtgccccccatagcatcctccgtttaccccacactgtggtataataatttgtctctcctacagcctggaagtatttccagggacaaagcacaaagctcatttatctccttgttctaaacacctggcacaagacctggcatatactgtattttcattcaacttttgtcacactacactgaactgtcactgagttgcagttggaaatatcgaggaaggaataaactaatgaattctaggataagagaattgagtttggctgtggagaatgtctgggctttgaaatccactttgtgtggacaatggaattatatcagtggtgttgttccaaggccaacacttatccctgttgtttttgcctcttcctctaggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtctcccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttggaggttagtggtggcattgtccccgcacagtttggttagcatttcattctgggccaaggtacacagtccttgcttattcatgccccacagtaaagaactaagatggggagtatgtgaggaatcatctagtatggtggacctaagttgtgtggggttttttggttttgcttttgttttgagacagggtctcgctctgcaacccaggctggaatgcagtggcgcaatcctggctcaccacaacctctgcctcccaggctcaagccatcctcccacctcggcctcctgagcagctgggactataggtgcacgcgaccacacctggctaatttttgtattttttgtagagacgagttttgccacgttaccctatgcatttcaccataaggacctaagttttaagaaccataacaaccggcctggcacagtggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12559 - DNA, 51711 bp, Human
ccgagatcgtgtcactgcactgcagcctgggcgacacagcgagactttgtctcaaaaaaaaaaaaaaaaaaggcttctcactgtttatcactcctaaggactttccttaacatagtcacgcaggggactgaaacttcttgcttttactttcctggcctcccgttgaatcacactcccccttgctggtgacggtgggctcttgggcagctcctccggctcccacactcatgagggcaactgcatcatcttgggccagatcagatctccatttcctgggccctcacagcaccgctttttcatacaaccctgttgcttcctcccaccaggctgtagcctttgcaccctcagcagttaccagtaggtaaaaagcctggaaacatctgttgaacggaggagtcccataccctttagagctgaattctgctttgggtaaattagggagccagtagtggaagttagcttatttatttatttatttttgtacagatggagtcttgctatattgccaaccctggtctcaagctcccgggatcaagcaatcctcccacctcggttcccaaaagcgctaggattacaggtgtgagccactgcattcacccagcatttttgttttatcaaaatttatgagggaaatgggagaagagtcttctgtatgtaaactaagatatcgctatgaaaccaataagttttaaactataattaagagactaaattctcctatttgtatttgccccatttaaaaacaaattgtgcccttccccagctccaatattacctccctgctttatgtatctccatcagacatactctatatatctcatttattttgtttgttatgcatttttcccacgagaaagtaacctccaggagggaagggatatttgtctcttttgctcacttctgtatctcccagtctacagctgtgtttggcacatagtaaatgctctttctgtatttgttgaatgaatgagtttagttcagtagtcttccttgcccagagatagcaggcaaaaacatcaattaaccccgaagtaaattttcatggaatccagttctggattttttaaaggctcttaatgcaactatatttagctgtgatcccttcacattaggcttcctaatacatcaggggtcctcaaactacaggccatcagaatcatctgagagcttgtaaaagttgcagattctcatcatcaaagattggaattatgcagtcagaccccagctaagggcagttccaggagctgcattcggactgtggcccaagggccagtttgagaaacacgggctgtgacccccagcacgtgccgagtgaaagctcaattcctctaaggcagtatttatcacctacattggctccgtacccatgcgggttttagcaataaataaccaatgtccaagggacaggtacccttcgctcgtttttacagatctggaaacactgaccatcccttcctctccgcttcccctccgttcccgcaaatttacgtggttcccgccaggataaaagacaggtaaaaagtacgcagagctaccaagaaaaagaagggacgctcaaggcacactagggtccaggccggacacctccgccaagtaaatgccttgtgacctttgcctttgcacccggggccaatagttggcgacttttcggcgcttcccgctgggaacgtggaggcccgtgggggaaacattccagccttcggcggaggaggcacggggcggggcgggggggaggagggaaccgagggggcgggacagaggagaggcggggcctgggcggggcggggctagagggcggcctgaggctgcggccacgaggaagaggggcggggggcgcagcctgggaatggggcggggccggagaacagcccgtcgctaaggcctgcgacccagacagcggggaggaggcggtgccgcccgctctggccccgcccctcggggggtgggcccagcgggagggcccggctggcggagcgcgcgggagacagttcgctccgactgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacgtaagctagacttgcgtcttgccgtcgggctggccgcgggagcgggctgcggaggggacccgccgcgagaaagtgtcaccccgccttgtcaagtcggtgcctgttctgtgctctttaaacgctttctgcagagtctccggattttcttggaggtggtgtggggatagcaggactcgcagtttggggagggagtttgaattttggaggagtgactcttgattaccttttgcctggggaccgcgggccagcgcaccaggcgggctccggatcggtcgcaacccgtgaagggaagccctggttcactttcctccttgagccgggcgggggctcgcggctctggctcgaggggcgcggcgacaccgccttctaccttcctttcctctggggactgctctgcgctcgtactgatctcctgtcattcaccagcttagtccaaaatcaaagtgaactccgggagagtttactgtttgggaacattttagaccctagtggcgcttggaaatttttttttttcatcactgcctgaaagttcaccaaaaacttgttttccttttcaaccatttttgggtaagatactttaagcgctgggaattaactcagacctggccagggaagtctcggtttggtggccgcaggtacctggagagtgttggggtagtttagcaagcccccgtggcttgcaaacgtgcttcttgctaggaaacacacacacacacacacacacacacacagttttggtttttttcccggagatgggtcgctgaatcgtgtccctgaaatgcccccttggggatgcccacccccttgacccggacaaggaggccgaggagcgagttcctgggccggagagaggaaggaagctcgcctcccgacccgactattttcgtaacaaggcgacagcttcttggaagcctgcccccactccatgtcgctgtccccacctccagagtcctggggcgagcctttgatccctccgaaggaggtgcacccctcctctctgcagcaccctgctgcgtgtagtttgctgcgtccgcgagcgtccttcagcgcacagcccctggggcgaggaaagtgagaggggacacggggtcaggctggtggggtctcatcctggtcagcagcctgctagctgggcgaacttgggcagtgacaggacctcgctgtgcctccttcatctgcaccaaaggggtgataactgtattacctccgcgcggggaggttgtgaggatcaaatgagctcatgcaagtaaagtgattagcaggttgcctgttcccgatgttcaataaatacccagtgtgtgctaatcaccgcagaaggaaacccctgcttgcagtcattaatctgcacttaaagaaagcttcgtcccactccccaccttttcccatccccagtcttgttttgagtgagtctttttacacccaatatggatgagcaaatggattcattctcaggattcagaggttgtttcggcgattactggtgacatagaggaatgcagcctaggctggtggcattgatgatgtatttggaaaaaacattgcagctcgggagaaggcagaatactgagtctcagattacattttttttttcctccaaaattctgtttgctgaagggatgagggaaaataatagtccagcagactgcagccctctgaatgtaaatctatcagcagctccaagaggttgactaattcgccatccatctggactacagactggtcctcggtggaaataatttgcagactgtaagtgtggaattaatggagttgccatcttggcttgcagacggcagcagatggtcagaggggtgccctgtaaggcagcagcccctctaatcgaagaactaaagtcctggggaaccagtgtcaaatggttagcagatgtgtgcacaaaagttattttgagacattttctgagaaaatgttggcgattgcatgtattcacatttcttgtggcatgccagatttacagcgtggcctgagcgcagatgcatactttttgcattagtactactgttcagagtttaaaatgaagcacagcagactgagtttctctcctggctgttttgaaaagtttgcttttgacaaatacttattttattttaatttacacagagtagcaccagacaccaaacagcctggaagttcaaaaaggggactggggataaatagtttccaacttaaatctttccctggagtgggtgagaaaagtggttttggtgacttatgtcataacttcccaattgcagatttcatgagaaacaccactcattccttaaacagtgaatagatgagcaattaactattgctaactatgaaggcagtgtttcaaattttaatgcactggaaagattgaaggattttcttagggctctggagtaaaggtgaaaggcaggttacccttcaacctaaagcccttgtttgcatgtttttttgttgttctgtactgtagttgagagagcaaagactaagcaaagtttagagcatttctacattaaaagaggtgtttgggtgcttctggaaaatataccagaccagtagaaagacatgttgtgattcaacaagctattactgtgaagtgagtttaaaaatgtatatagtacttaaactcttatttgtagaactattatgggacttaaaggggatatgggaggccacagttgagatgccttccaatcagaggcttggtgagattccaagaggtggtttcaaatacagcaataagtacttgggtttcccttggtgtccccatggagattttaagccatgacgcaatgtttaaatcagagtggtatttttatgacttaagcgggtaaatatgcaattggaaaatattcagggaagggtgatttggtccagaagagtgggggcatccagagtacagtgggtgaaatggatcggactttttggaagagagccttgtgctggacaggatggtccagtattgtcaacacaagtttctcatgcttcactctccttcctagcaacaggaagacggaaatgaggccatgcaaaaataaaagaccctgaaagactccagacaatacctgatccaccctaccattcaccctgtatagccagaagacttttacaaaagtaaaaataacttcagatgtttccccttcctccctggctattgccaaatcattaaagaccgaattctcagtgctttacaacatcatagcaaaacctggccccatggtgtgactggcatccagacccacatcatgccaagcctgttcttgagattataaagcagacctggggagaaaggtgattttcatttgtaatgtgtgcacagtccaatgatttgaattacatgagttgggatctagtgggagagaactaatttctttagtgtctagacagttgtatctctgacttttctcagaatgctcattttatcaggatctgctcctgaaattcttagtttggagctgtggggctctaatgcaaaggagtaatctgtacgtcattcaagacactaaaaaatacgttccttcatgttgcagtctgggtgaactaatgcccaaccatagagtgtaaatatccagtgtgtcctagaaagcacaattccaagatcctcttttccatggctatgaaattagaaggaacatgcttttctggagcactttcacaactgtctctatttctgactctgtggcctttgcatatggatgaatgcagagggaggtgaaggctgttcctctttgaaggaagacagtgctgtagggttgaagtatgttttataggaatgagttactgcgttgaatgagcgccatcagcggtgttttctttcagcttcaaattagttagagatccagttaatgtaaaagggtttagattcccagctgagaaggactccttctgtcctctggcccttttccttctgtgggaccttgtgttattagggattaccatgatcagtgataagaactgcggagtcctcctggggatcctctaattaggtctactctgtcttaacgttttgttcacttgccatcataattaatgttctgccttgccatcataatttgttctgccttgccatcataattaatggagaacaggaagaaagccttcacattaagcttatatattttcttttttctcttttttttttttgagacggagtctctctctgtcgcccaggctggagtgcagtggcgcaatcttggctcactgcaagctccgcctcccgggttcacgccattctcctgccccagcctcccgagtagctgggactacagtaggcgccgccacaatgcccagctaattttttggtatttttagtagaaacagggtttcatcgtgttagccaggatggtctggatctcctgacctcgtgatccgcccgcctcggcctcccaaagtgctgggattacaggcgtgagccaccgcgtccagcaagcccatatgttttcttagtgtctcccaggcagcaacgagacttctctattgtggcccttacggagccttatagttactttgtaatttcctgggaggcttgtgtgcgtaggtaggcagctgtaatgttagagtgcaggaatgacaaattttttgtgagtcccctccatggggggagtctagtgagaggagacttggggctctgtctttaacatttgggggagtgttctgggataccattttctaaaactctggcccgcgttgactgtacgaaataatgttttcttcagtgaaagtactttcaaatattatttctaaaggaaacttttctcccaaatgtgactgaaaatatgtgaatgcctgcctataaggaaataaagttttgagcaccaaaaagtgaactattacatccttctaaagtgaagccaagacacagtggaaatcagtttctcttaatcattcatcagccttggggttttttggttgttgtttttttggggtttttttttttgttctactagacttactttcctcgtgaaaagtgtgcttattttcattttatacatttctctacttggtgccttttggtgtctaccccttcccccgtcggggaaaaatcaaaagctcattgaaggctgaggtcagtgaagctgagtcctcagatgcctttggcacctcccatccacattttgttctctgccctgccccacctttgagtgtcctgtggagaggactggaggtcacttcctgaagcttgtcagaaaggcgccttccttctcctcgcaggagtctctaaaggatgtttaagggacaaaagttttccacaccctggggtggtagcatttcccaggctggcagcactttaggaagccacggaagaagagacttcagaagtgaaatggcctgtggcccatgcacggtgctgccccacagccacgctgtgtccctcctcacactcaagtgacaaaatagaagatgctgaaactgaagtgatttttacctcctgattctggagaaaccataaactcataagggatccaatctccatacagttctctttttcaaattgtatagcacagaaagggcattttatgtaatgcttggacatctgtaaaagtcattttcatgggaagttccagaacttggcaaaggcagcctggaaaaccagtgccttttcccgactgaggggcggctgagatgcagagaggttcagtgaccagtccaagatcacatgtgagttgactggaacctcagaccccttccagtcaacatgtctaaacaaaatgaaggtcttaagttgtttgtaggaacctgaatcacaatttgaccattagattaatttctgttcattcattagtgttcatttagggggctgggtgtcccaagcaatactggtgaaaataattccttagctcacctagaacacagcaaatcttacttttttctcacactttttggcacaaaactgagaacgtctagttgaatagtgtttcctctttgaggtttggcatagaaatggctggaggtggcttatactcctaacaagtacctgccatattttcattgtcattggtctttgataagggaacttgatatttcattcattttcttttttctgttagaatggacgaaaatatgggtgagcagtttttttaatagacgttcctgctatcacctttatttctaatttaaggttttacagtgttgcaatttgcacactattttattttctcctgtgctatcgcagaactataaagcaaaagccaatgttgcgggagatgcccctcgtagaataagctttgctaacatatgtaaaagaaagagtttatttgtatgccaacttttaataatagagacagggttactctaggtttgtaaccagatattttgccttgaataataagtttaaagagggaatggattatataatcttaaaacacgtgcttcattttaccaaaaaaaaatgagactcagaaaaataaggacctttaaaactgtattaattagatacttttctttcttgaaattcttaatctatgcagttatcatcttcaaaggacttcgtactttatgagctattccaaattactgttgttagtgcatagtttgaactgcataaatatttgacgtggaatactagaaatacgtacacgtgtgtgtgtgtgtgtgtgtgtgtgtgtgtgtgtgtatggatagagagatatgtgtgtccctgtagcagcaatttatttttatcctgccccaggttgaaatgaaatagaaagatgtgatgattcagtatccatttccttcttagtttattttgatttcagtttgacctctttttgctgggtaataagtgccaatttttgattagttgggagatattttctgttcctggaaataactggatccgcacaagcctagagggcctgatggagccatgtccctcatgggctcaaattcatccagagctgttgcctttgccagggaagagcacatattttgatgtgagctgcttgccttttcctggtttatgtgttaaaaggagtactttgcaaactcttgtactagatgatccccaaagaggatttcaattggtttaaattctacatggctaaagtgtcacttgcagggcttcaccccaggtataggcttgcagggcctgtctcccagtgtttcctcctttcaaggcaaaaccatttattaagttgtcatcacatcacagggaaaatgggtcctttttcccctcctttctataatttctaggaatgttctttaatagaaagctgtatatgtatgtctccaaatctcaagcagaagaataagagaaaaaaaaatgaacaaaacttaaaaaggaagctccccaaagcttccattccttactaggactgaaaaccagtatggtgatttacaagtgagggcactgttgaaataggcaagaagggcctaacctggggatgagagctgggtagctttagccccttcagcaaatcacctcaattctgtaccagcttcctcatttgtaaagagaaaagatgaaaagcttcaagaggtatttcagcgcccaagtcacggattctttggaagacaacatgctgctgtaaacatgaaagatcaataaggaaagtaaaactcttaagagccttctatgcattgaagtgttttcttcctctcaagttgaaatttagagggctatagacacgcacagaagcaaacgtcattggttttgtgttgtctatgatatgaatacaggcttcatgggacaaatcaagaagtcgatctcttaaaaagcaaattaggccaggtttggtggctcatgcctgtaatcccagcactttgggaggccaaggcggatggctcacttgaggtcaggagtttgagaccagcctggccaacatggcgaaaccccgtctctactaaaaatacgaaaattacccgggtgtggtcgtgagcacctgtaatcccagctacttggaagggtgaggaaggagaatggcttgaacccaggaggcagaggttgctgtgagttgagattgtgctactgcactccagcgtgggtgacacagtgagactctgtctcaaaaaaaaaaaggaaaaaagaaaggcaaattggaaatgttagcttttaaaataaaagtaattaaaactttcgtaaatttacaaaactggggatctcttgtagcagtttctagtggtccagttttttgagggaagaagaatgtttccatgtaattgataagacatctggaaaattaacagcgggcatggaaccctttctagaggtggtcttagagagaaggtgaaatgggcataaaggaaatattagagtcaaaaacttagggaatttacaaagccactggcaagcgcaggttttatagatgaagcaacagggccagagaaattcttttcttaaggccacctatctaggcagtggattctttcctggagttgttttcctgacttgttacagtaatgctttgtcctctgtgatagagtatcagaaggactccagggcacccaggtgcaaaactgttttacatctgaggaaataatgttggttgctcattgtataaccaggctcagaaggtgcttccatctgatccatgagataacttcctttctgcttcatactcctgctttttggtctgtattgtagtaaatccagactgcattcctcccaacacttctgcttcccagcttacctcttacttcattcagggtcctttacaccgaatcccctctcctgcaatccagtttcatatccaagatcataatgcttccttaaataaaggagtacagactgggcccaggcagaccccacttgtccactagcgagaagggacacccctcccactctgatgtcacacatgtctttcctatgtcatatcacattcctcttcctactgtacagaagttcttcatgcttagaagaaaaactatgcatgagaatagtgcatttcaaattggtcacattggtatataacacagcatttaaaaatatataaaaatataagactgtatcacttattgtaggttttatttgaaacttcttttataatagttacatatacagacacgtgtttatatgcatgaatgtgtacttatatttatacacacatatatacatgtacatacatgtatatgtgtgtaccatgttacaatgtagaatgtatttcctattggggatcctggtcagaaaaattaagaccacttactagaacaaaaattgtatgagtggtttatttctttatgtaatatttattgagcaactactgtgtgctgttgtaggtgcttgggatatatcacagaataaaatggacaaagaagcttgcccttttggagcttacaaagaggaaagacagaaagtaaacataataagttttgtggaagaagaaaaaataaaacaggaaaagagggagagagggcccaggtgccacggcccacgccagtcatcccacactttgggagggaggccgaggcaggcagatcacttgaggtcaggaattcgaaaccagcctgaccaccacggtgaaaccatgtgtttacttaaaaaaaaaaaaaaaaaaaattagctcagtgtggtggcgggcgcctgtagccccagctactcaggaggctgaggcaggagaatcgcttgaacctgggagacagaggttgcagtgagccaagattgtgccactgcattccggcctgggagacagagttgagactccttgtcaacaaccaaaaaggtgcgggggcggggggtgcagggagcagggggacagggcatgagaggaggccggtgtggctggatcagtcagaggcaggcagggtcctgacaggggccaggacatgtgggacattgttaggagtttggctttcaccaatgaaaggggcactcactaacgtgacgtgtacagggtcacttcgggcttaacaaacacgtggaccttgcaatagcccttaggaaaccagttcgtttctaagtggaggatagagggtcctcatacgcgctgtactccactgtgaatttcctttccacttggcttcctgcttcaagtcaggagcttgtgtctttgattttccccgagagctgctggcagtacgcctagttggatcaataaatagtgaaagggaaaatgtaggatgattagctttagctaaacataggactgtactaaaatatacctaacagtagatttgagttagctattgttaagccagatagcctaagaaactgacttagtgactgaccagtctcccagaagcttcttgttttttttttttttttcagactatgcatagcagatgtttggaatttttttaggcacctgagggcaggaatgctgtcagttgctggtgaaaatctttactgtgattagataacattagagtttaataaatattaatatatgaagtctgctgtctgtcttaaccttactaggaatttattttacatagataactcctgataaccagtctttggcaactgcgtatgtttaacagttggttgttttttaattgcaaagagtaagagattcaagtcatcgttttcagtctgcctttaaagaaaggaaaatagtaatagatttttttttttcttttccttcttcacaccaacctctctgtaattcctttgtgcaaaaagttgtctttcgggatatacaaatgaattaaaaagtgagaagttggtggagtgaagaaggggtaattcatttgagagaactcagggcttaaggtatgagagcttggtacgtcctcagaactccaaggagtttggaaagcctggagcaagcttacatttggaggccttccaagagttgagtggataggcagatgccaaactgtgaaggctgtggtctttgctgaggagtttggattgtatttgaaaggcggtggaaagtcactaaagaattctaagcaggggagtgacataatgaaatatgtgtttcataaaaccagcccagtggctcggggatccttgaaggaggacggatttgttgggggcagggaggggtgaggcttatcagagttccgtgaggaggctgttaggataatccaagggtgaaaaagtccaggacgaaggaatacaaagaaatgttatctggcttagtggtcctcaatcctggctgcctttaaactgagggagcttttctgaaatacaatgtccaggccctacctagactgagtgaatcagaatacctggggaggggatggtcggtgtttttaaaaagctccctggccaggcacgggtggttcacgcctgtaatcccagcactttgggaggccgaggcaggaggattgcctgagcccaggagtttgagatcagcctgggcaacatagcgagactctgtctctataaaaaatagtataaaaacttagccaggcatggtggtacacacctgtagtcccagctactcaggaggctgaggcaggagggtttcttgagcccaagagttcaaggctacagagagctgtgatcatgccactagactccagcctaggtgacagagtaaaaccctgtctcaaaaaagaaaagaaaagaaaactccccagcgcaatgcctgcctacatccagggctgggagtcaccaagatttccttaccttactacaagtatttgtggtcgtgatttgcttctcccagtgaacgccctctggaacccacccatcaggtaaagatgggttgtaattaaaaccatcgtatccacctgcacaacattcctgccaaattggtcaccttgatgtcatcagaattgataagcagtatcttccttcccatttgaaggaatctttgtcaccacggggaggagaatgcatcttggtttggatcaaaaagcaccacctgcctgcacacagctgacacggttctctagcaataaaagcatcaacttttccatgaatctttgcccatatgtctatcaaattttagggaatccagggaatctgcaaagtgcttgaattttcttacattcctttaatttcttaaaattgcatttttaaaaaaaattcactgtaccatttgcatcgaagcctgattttggtggcatattatcacagaagagaggaaatccaaaagttccccctgtgaagctagagcgaatggtagattgaagtaatcatatcttgtttagacccaattactgttgctcaaccagctaagataacagagttccacagaatgatgctgggggtggggagtttttgttcagcttactgttgaggagtgatgggaagacaggatcatcccgtcatgccaggaaatgtgcaaatatggcctaatggttcccagccatacacaaaagggtgtccgggactcatccatctaatgtccagaactgctttgtgaaatgactttgactaaagctgtttccaataaaaatttcctgtttcctccttacggcatttgtctgttgtttgcttagagaaaacccaggtataaaagtttcattgtatttccattgtatttttagtttctagtggcatttttgttcagtggggaatgttttttaaaaaaatcatcctcgtaattttcacatcaccacccacatacattgaagggaaaatcacacattcagagctgtgttagaggccccccaaaacaagcatggggtagataaacgtgtccaaagtaatataatatatatgcggttttcagtaatattttagattttgttcattgttacataatatattatatgtatttgttacataatatacattttatatatatatatatttatatattttttttttgcgacggagtctctttctgtcatccaggttggagtgcagtgacccaatctcagctcactgccacctccgcctccccggttcacgccattctcctgcctcagcctcctgcgtagctgggactacaggcacccgccaccacgcctggctaatttttgtatttttagtagggacggggtttcaccgtgttggccaggctggtctcgaactcctgagctcagatgatctgccttccttggcctccttaaagtgctggtattacaggcgtgagccaccatgcccaagctgttacatacagtatttttaaagggaagaacctgtcttgcaggaagaaccttgcatttttgtaagtaattgttccttctctcactatggcatttgaatgtagaaatctcatttttaaaaatttttttataagttttttttttttttagatagagtctcactgtattgcccaggctggtcttgaagtcctgggcccaagcaatcctcccacctcagcctcctgagtagctgcgaatacaggcagaaagctcttttttctttttatattttttgtagagatgaagtctcgcaattattgcccagagtggtcttgaactcctggcctcaaatgatactcccacctaggcctcccagaatgctggggttacaggtgtgagccacctcgcttggcctcagaaagctcatttttaaggagaggtggttacttctctatctgtttcctcatgtgtttatctcagagatattagtaatccacattttaggatcaatgtgaggtgtaaatgaactaatatgcactagcgcttagacagggccttatgcgtattaagcactcagtaaagtgacccattgatatagaactgttgagaggtaaatgggaagactgcatggaggaggtggcatttagttgggatcttgaaggatgagtgaaatttcatcttcagcatttcaggccagataattcactgaagtgcagtgtgtgtggagatgagcaccaaatttactttggctagagtgcttgggtacagggagctgaacaattaggttggatgccaagtggagagccttgaaaaccttgccagggtgtttagacctatttttttttttttttttttttagacagggtcttgccctgttgctcacgttggaatgcagtagtgtggtcacagctcactgcagcctccacctctggctcaagtaggtccttccacttcagcccctcaagtagctgagacaacaggcatgtgccaccatgcctggctaatttttgtattttatgtagagatggggtctccctatgttcttcaggcttgtcttgaactcctgggctcaaacagtccacccaactctccctcccaaagtgctgagactacaaacgtgagtcaccgcacagagctaagacctcattctttacacgtggagctccagcgaagtttgtgaaggagagagaagattaatactgtaactcagaaagtttgatgagccaggattgatggacagattctcttaagagagggttgtttacagacccagagttttattaatacttagattagagagaaagtaatggtgtgaatcggggaatgaaactgtgtgactcgcatgtagatataggttcatttcacattaaaaaaataaaaataattgatttttaaaaatcagtacgtacattggattgttagtactttctcttgacctatgaattggaaagtgtaggcgtgaggtcaacaagtattccattttctaaaaaatatgtgacaactttttacagttttccaattctgatttctacaaagcagtgggttagggtctcatttgaatgcagcctaagttttcagagtggactctttgtgttggtaaaatagtcatatgcttgtctatttcccatggtttcatatcaaaaggaaagacaaattgtcatttttttttagggtgaagaagagaaaggataagatgactagatctctgctgtttggggagtactgtgttttagccattgtataaactgttaattaaattatctgctgaagaagcaaacctttgcctgtttacattctttctaactaagtggccctaagagtgactattttgacacagcttttctgatcagtttatgatcatttggagtcattttatttgttagacagggccattagaaaataagagagacagccaggcacagtggctcctgcctctatctcagctacttgggaggcggaggtgggaggatcatttgagcccggaaggtcgatgctgcagtgagctaggatcataacactgccctttagcctaggtgactgagcaagactctgtctcaaaaaaaaaaaaaaaaaaaaaaagaaagagaacaagaagacaggaatatgcatttttgtgttgctgaaatcacatgggaccttaaataaatactttgtaaagttattatataaaaaatataaagattgcttaaaaaactagtatcttacatcttccatgcctcttggcatgaaactatttctcttagtaaagcaggagcatgctctggcaggattggctagtgaattggtatctaattaaggcttttgtatgtgggctcacctactgccgtgtctgactatcgtcaaaaaagggcgggcactgagaatttttggttactcaccacttattaagttaaatattaagaaagcaagcacatttactttttaacaatctattgttcaatgtctaacagtctgttcaatgaaaataacctctaagtagccaaatgaaatgagtttttaaaatatttttaaagacaaacagccttttttctttccatatctatgttttgtgggagggggcaggcacacagatagggcaaaagtaagttcctcttttttttttagcggttacagagtcttactctgttgcccaggctggtgtgtggtagtaccattgaggttaactgcagcctcagccttccaagctgaagcaatcctcccacctcagcctccagagtagctgggactacaggagcacaccaccacacctgactaatttttgtaatttttttctttggtagagacagggtttcgccatgttgcccaggctggtcttcaacttctgggctcaaatgatcctcccacctcagcctttcaaatgcagggattataggcgcaagccaccacacccagtctaatttccttgttttttaaaataaaatattgagcttgtatatgtttttccagcaatatagttttctaggaagtgtctattttataattttatttaaaacatctttatttccttgctgagacaaaatgtggatatacacatacgaaaaaaaagtaagctcaaataattgactttggacaattctacacttttattcagtgtaaacatcgaagttcttccacactgatgtcactatcattcgctcccatttcggtcctaagtcttgggttgaataatgctactttcactgctgcactgaaaagattcatgaagttaactttgccatgctatttatttccaggctactgccataatcgtttttagtttgggtattaagaactcatcaggagatggcaggttattttttttctctttcctgtgttcattgatcaaattcccacttgctttaatgaatttggatttgcttaattacctttcttcaaaggccaaggaactcaggaaataataggtgaaaaagtgctttgaaaacataaagttactagacaaaaataagatgtgttacacttctgatatgaactattagtctcccacttgcttgagagagatgcttaatgaagatttgaatctggcataaattatgcaatgttgagacctttataaatgagtgaacagacttgtgtaactgagtactctcatggcctgaggaaggtgggaggaagagttgaaaggaatattctttgtgcaagcagagacactaactaatgttcccaggacctcctctgtgagtcagttttaacgggattgtaaatatgtgctccagtgagttttaacacagtgtgtcagttgctcttggcctttctgtttatcgattctatctacaagatgtgaaaccacagggaggtagaagctttattagccatttctgcctgccaagattgtgggatttactgacttcgtgccctccatgttccttgacagcctgggcctctcctactggattaatacctgatgagtacctgatcacgcaacagtgaaacaacacaaggtcaggggcttttgaaacacccaacccctgggtgtcagaaagcctgtgactttactcagataaattctattttagcgtgttggtggaggtactttgtggccttttgttgaagtgaaaagtagtacaataggccggccaggcttcaaatgagttattaaatctctcttcaactttctcatgatgccttattttcataaccgtttgtaatcagagcacttcagaagcagcacaaaatgagaaacttactctcaggaccccatttctattttttgtaaagggaaaatacatcctcatgtacacgtgaaaaaactggaaacgatgcatacaaaatgtaaaccattcgaattaagcgtgtatgtctgtttgcttatctgtattttctatggcagtcatgttttgcttgtatcataaaacgaaagcttattcaggaaaaataagcatggcgaggtacacatggctaattttgtctttcttctgttctgttctagaaattgaagccaaggaagcttgtgattggctacgggcaactggtttcccccagtatgcacagctttatgaaggtaagctgggaatgccactttttaaaagttggcataatcataatcccttgttcgcgagtattactgatctatgacttattttcagcagttttatcgtttaaatgttttatttttaaaaaaaatgttgtaagcatgcaagacccccaccgctgaaaacaaaagctagcaccttggtaacacgcccatgccactcccccatctgctgcctgccactccctacccaaagtaatcagcatgctgaagactatcattttcttgctttctttttgtataattctactccatttcctgaaaagtacatttttacaaagtaatttttacctttataaaaagggtagtgtgtcgtatgtaatttcatggggtttttatttttcacttaatattgtattgttaagattcttctatactgtatgggcctgttatgcatttgctttggctgctgtgtaatacaccattgtgtattacacaagaaaccactgtttattcatatccacactctggttggtgggtattttggctttctctgttttgcttttataagctgtgctgttgtgaacattcttgcatctatcttttgtggtacatgcataatgattcatcttgcttctatccctaggaacagaattactgggtaataaagaatatgtatgttcaattttaaaatgcaagcttttcgaaagtgcccgtaccaattttcactcttaccaatctgtgtatccacattccctcaacgcttgatattgtcagactttaatttttgccaaccaaatggatataaaatgatatacagattttgactgccatttccctaatccttcatggtaatgagcatttattcatgtcactcggccacatttgtttgctcacattatgcttctcttaatgatttataagggctctttttattctaaatactaatctttcattggtcacgtgttgcagatatctttcccaccatttgtaattaggcatttcacttttctctaggttgtcttttaatgaatattatgttttctgtggcattcagtttttcaattgagaaaaatggttcaaaaaaaaaaataggatctgtgctgaattcttaacatctcattttcttatcagtgccctggggattgcttggatactgaggtcattctctcagcttctgcgtaccctggggagtgcttgtgctccctgcatgtcaagataaataggctgttcatttatttatttatttgttttgagacggagtctcgctctgtcgccctggctggagttcagtggtgtgattttggctcactgcaacctctgcctcccgggttcaagcgattcacctgcctcagcctcctgagtagctgggattatgggcatgtgccaccatgcccggccaatttttgtgtttttagtagagccggggttttaccatgttggccaagctggtcgtgaactcccgacctcaggtgatccacccaccttggcctcccaaagtgctgggattacagacatgagcaaccacgcctggcctaggcagttcatttaaatgggagtttcattatactctatatgaagtcaatttaaaataattacagctatgaactaatgcattccattttatgggtaactttcaaacagaggttgggtgaatagcaaagtgattcccaagttagaatacccggtcttccttatgtagcctagactgattgtgatattttttccaagaagatggattctgaattgttttattgttagaccgtgtaaaatatcttactgtttcttcattccagagaatatctccaatttcttttgattaacttgcatgcttattttggtggagttacttgtctttcctttagagagaagttttaacctgttaacatttagaagggctttggggaaagggggaccagcattctattggattttcaattcatagctctactggagataaggaaagacaactgcattggcagtaacaccaaagtggctgtccttttgttctcctatttagaaactaagttttcttcaattatgctcgtttttggcattgatttgctgccaggtagcactttcttgtgatatatatgtttgctaagacccaattccattccctgtgtctcctctttcctaatcctaaaatgcagggtgcatttgcacaagttacatttggggtcccttcatgttcccaagtcttttgaagcataagactacttttggggtacactgcgtattgttctgggccattgcctccccccgtttttcctgccactgtgtgctgggtgagtacatacactatacaccccataccaacccacacatgtccccctgttaagcttgatttgcgtacttggcaatttatacttcctgcctttcaacccacagtggaagttgagttcagagaacatcttctatacatcagtaaactatcatcttttaaaagccagtcctttcagaaaggagtccaggcaaataaaagaaaattactgatttaattcttacactcctcacttgcatttaatacctaccagattttttaaaaattgttaatttggattagaaaaggaatctaaaatatggctctgggtatactaacttagaattcctaaaataacatagttactttctcacatataggtaataggcatatgaaaatttcaatttacatttatagatctgatattatactctgtaaatattaaaaaatattccttaatatcagctctgttatttcatcttggtgtgtattcagagtcaaatattggccaggaatggtggctcatgcctgtaatcccaggactttgggaggctgaggtgggaggatgacttgaggccaggagttcaaggccaacctggccaacgtagtgagatcgcatctctatttaaaaaatttgaaaacaaacaaaaaaaagcaaaatacagtgtcacaaccttcaaacaatgttacaacctgtcttccctcatttactagtgctccagtttccattgactataagtctttctatttccattataatggttccatgaatcatttgtctaagagagacttggtctataaattagtgaagaaatgtcattctgtgatactaaattttatgtattcataaatctctggactatagccacttccttggtctgcttatattatcatttagggaacaatgtcagtaatccaactgtagccttcagaaaaaaaaggatagactataactttatactcattctgatatattatctctagaaaatagattactaagaataagaaattccatatcattccataaaaccagtaatcataagaaacaataaaaacataatgaacagttgtgcacccgcaggagctggagcaggactaattacctgcgtctccaaaactgctgacagccatgtctgttccactgtgtggcattagccattttgaaggccaaagggatttttttactttttatttatttttttcagatagggtctcactctgtcatccaggctgaagtgcaatggtataatcagagttcactgcagcctcaaactctggggctcaggtgatcttccacctcagcatcccatgtagctgagaccacagcccgcatgccaccatgcccagtaaaatttttttagattttttttgtagagacaaggtctcgccatgctgctcaggctggtctcaaactcctgagctcaaatgatcttctgtccttggggcctcccaaactgctgggattacagatgtgagccacagtgcccagccaaagagaattttttagcttgtggtgattctagtttcctgctgtgatgactgatttcacccaggtctggtccaaagggttaccctacaccgagacactcctcttcctggtattgtagtagcactctactgaggaggcccatgatttgccctcatagttgggactccaagagggtgataacttgcctttatccagtggcaatttcagagctgttgtaaatttccacagcggctacctccgctctccttttcttgggtatatttacttaccaagggatctttttatgtagtccagagaaaggaattcctccattgagtcgactgttttccccctctctggttttcagttctgatacagcttcttcattgtctcgagagaactgaatgaactcttctacagattaaaggatttgagattctgttgttctatagcaacttcatagctagccctttctttttaggggagttatatcaattcctgcaaggccatattgcagtgctaatatttgtttttaaaaagcatatcttgaattctccttagctcttgatgccatgtgagtggattacattccatttcctaccacttttcattgttctctagatctttctgtggctcagttttctttccgtgacctttccctgatcacacgtgagcaaagacacacacacatacacacagcccagccacattaaaacggagcattcttctgacagtctttgtggcttaaattataatttctactggggactcattgcctgctgatttgtttaaacatataacaatgttctgaaccacttctccttgaccagaagcaatattttgagtttcccccacattaaagccgaagctcctttaggacagtgatgcccgattggcttcaattgccttatagtcccatagaacttgacggggaatgaggtgtcctacagtaggtgcttagtatattgctgaagagttttatccctgctttggtaaactgggctatttggcaaattgggttttaggcgctcaacaaatacatctgtttatttttctcatagatttcctgttccccatcgatatttccttggtcaagagagagcatgattttttggacagagatgccattgaggctctatgcaggtaaatggacacgttttgagtgttttccttttttattttttaagaacacagtacttctcacaaagataggctttgtttgcttttgttcttgctaattgtgttaggtttttattggcaaaccatagagtgatcatagaccttttaattaaaaactaagtaaaatattgttatttagtattgccattaaaatagcatccacgctgtcctaggaagtactcacacaatagcattccatatttgatataattggtgtaacaagtaacaactctcaggtggtttggaaacgtggattaaggtttcctaaaagggtacgatggaaattaagcatgttcagaggaataaatggggggtggcatataaagacaggagcatcatttgaattccaagaacgctcctctcaacctcttcagtttcccctcgtataaaataatgataggacgaaataaggctataaaataactcagcatggtctttaacatataggcaacagacagttaaatgatgagaaattgaataaaaccgtcagaaattcttgatcattgtggttttgggtcttcaagctgagaggcagcttataggttttagtgaggtggaagtaataaaacctgtagcagtcgatgatgggacactgataatcctttcaagctcttcaagacatgtctactcattttaagtttttcatcctttctaatttttctcaaaagctaaaatccctaaaagctgaattctgggggaaaaaaattatacacagacaaaactcacataggttgatttgattatgaaactaagtattattttaatttcagggtttttttgtttttgttttttttgtttctgtttttgtttctgtttttttgagaaggagtttcgctcttgttgcccaggctggagtgcagtggcgtggtctcggctcactgcaacctccgcctcccaggttcaagtaaatctcctacctcagcctcccaagtagctaggattacaggcgcccaccatcacgcccagctaattttgtgtattttcagtagagactgggtttcaccatgttgccaggatggtctcaaattcctaacctcaggtgatccacccacctcggcctcccaaagtccagggattacaggcgtgagccaccgcacccagcctgttttttttttgttctgttttttattttatttttttttatttttaaagacaaggtctcactctgtcgctcaggctggagtgcagtggcacaatcatggttcactgcagccttgacctcccagctacaggtgatcctcccacttcagcctctggagtagctgggactgcaggtgcacaccaccatacccagctaatttttgtattttttgtagagatgcggtcttgctgtgttgctcaggctggtcttgaactcctgggctcaagcagtcatccatctcggcctcccaaagtgctgggattacaggagtgagccaccacaccccatctcagtatttttttcaacttggaaaaacatcatgaaggtagaatgacacccagtatttctttcctctttgtaggcaaggaaagcagtggtagttctgttttctgcctttctcatataatacagtgttatatgaagcagccaaagtaagcagtggtttggggcagatagatgggatatttagcatagtgtatggactagactagttctcatggtttaagagaggaaaaaacaaacagtcctcttaaccacagaaacgctgtcacttttgtagtccaattaaatgactgatagaaacgtacagggtgtgtacccattttctgaaagaaacctaattccaagaacttcactgtggagtgtaatatcattactatatcatcgggaatgaaaccagatgcagtttcgggaggggaaggagtctgcatctggaatatgaactactccagacatttttttaatgttttcatgcttagctgtggagcagaattaatctgttttcaatccatcactgctgatcatgcatatgcatgaggtcacttctgagatgcatcttaggaaatatttaagcattacatcatttcacgcagttagagagtgggcactctggacagcagcaatagcttaggaattcttgggtcataaaaatatcactgcagcatttcaggccaaagggtcatgattaaattcttgaatgctttttcagaatatcagtttgaaatgttgttttccatttctgggaaaaaaagtatcctctgtactttgcaatttacactggctctgagtaccttttgagaagccacctttctctgaagcgaataagtctgtgctgctagatctttggtgaaaagaaaagcctagaagaagcagactctgccacatatgctagttgggcttcagttttctctcctgcatagaataacatcttataggaaatgcagtgatggatgtcagagcgctttaaaaattaaattatcaggccccaatttgagtatgtgcagaaaggcctagggttggattttcttttttaaaaaaggaaattcttcagagttcacagtaatagtcatcaactggtttgtaatggaaaaccccagggctcttgtccacatgtccacataaatggacttttcatgaaaatgatgcccctttcgagaggcctaaacaaatgttcagaagaaaagggacctctatcgggtgtatttcaagcagcttcctttattttatttttttatttttttgagatggagtctcactctgtcgctcaggctggagtacagtggcgtgatctcggctcactgcaacctccgcctcccaggttcaagcaattctctgcctcagccccctgaatagctgggattacaggcacccaccaccacgcccagctaattttttgtatttttttagtagagatggggtttcaccatactggccaggctggtcttgaactcctgatccacctgccttgggctcccaaagggctggggattacaggcgtgagccaccgcgaccagccagcaactttctttaaaacgtagtacaagttctgagctgtcagctgcatagtgtagttgagatagttgttgtactgattatgtgatagtcacttcatttgctagacctgcctcttccaaataccttcttggcctatggaattcaagggccagcaaataacgaagctccagtattatttgaaattttgccctgtgatttagaagttctctctagactgacagactttttatagacttttgtctttgccttgttgatattttctgaacagttgattttaaatacatgtggtaatatggttgcagaaattcagcttaaacattttacaaaatctttcccacctacctcctccccttgtactggaccatattttatgcagggatcttataagtgatctcgtatttactctagcattattcttagtttagagtgttcatgtacctgtgacatttacagatcttacagctcctttggtcaagaagtaagtaggagcttctttttctactcagggcaagaagacttgtagagttagtgggttttatgagaacaatgacatagtcttaaatataaagtttggcaataaccaaaagttacaagtgtgggactatagattttttggatttagattgctaaccagcatttttacattcacactgcaaggggttcatgtgtctgttcccttggagaaacggctttggcctgatcttgctagctttactatataatgcaattccaatgataaggccaatattatgagagctatactcaatggtaatcctggaggagtgattcgctttgtcttgaagcatgtgcacgtagtattgtgaactgtgattcactacgaggatacctcttgtgaaatgttctttctattgcttgccttcctacagcttctgaaaactattccaaattgctattttcctttggaattaaaaatgactccttctataaacacagcaaagaagtatgtacatcaagtgacagttgtataatgaaaaatagatttccacactgtcacctgcagtattcactttgttgtaaagcagtccatcagatgcctgagccatgcaaagcagcccaccttagagcagattttaactttgtcacaatttctggtctgttaaaaggtaagcacgtagccgggcacagtggctcaacaatttgggaggccaagatgggaggatcccttgagcctccaggagttggagaccatcctgggaaacatggcaagaccccatttctataataaagaacaaaaattagccaggcatgatggtgcatacctgtagtcccagctacttgggaggctgaggcgggaggatcctgtgagcccaggaggtccaggctccaatgtgccatgatagcaccattgcattccaacctgagtgaccctgtctcaaaaagaaaagaaaaggctgggagtagcatgtaattttttaaagcaattgcacagattccaagaaaatatctttaagaattgtaaccatttttatttgtgagagtcttacttggaaaattgtatctttcccccttctccctcttctcttctttgtttttggcttgtttttacttttaatacaatggggcccaggtccccacctgctgtgcttttatctgggttcctgcagctccatgcagagaagctcttgaacctctgataggccagccttgcactcctccctcttcagagcagggtagaagttgcccaggagataagagggacacattcctgtggagcccagcctgggagggtccttagggggatgggaaaggcccaggcttctggacggatgggttacgcccagcatatcagccactgtgtgaggaatcccttaggatataagttgctttcatttattactaccattaatatttatattagaaaggaacacagattgccgggtgcagtggctcatgcctgtgatcctagcactttgggaggccgagatgagcggattgcctgagctcaggaggtcgagaccagccgggcaacatggcaaacccccacttctactaaaaatacaaaaaattagctgggcctggtggcgggcacctgtagtcccagctgctcaggaggctgaggcatgagaattgcttgaaacggggaggcggaggttgcagtgagccactgcactccagcctgggcaatagagcaagactgtctccaaaaaaaaaaaaaaagaagaaaaagaaaggaacctagaagttactgggtttgagagccaccatgttttaatcgtgtggacttagacaagatctgtgacctccccgagccccatttcctcatctgtaaaatctaggttaatcataatatctgtaccatagggtcgttgggaagatgaagtcatatataggaagtgcctagcatagtgcctggcccgcagtaggcctcgtttgtgtagctggaactatgatttgatatcagtactgtctctgtaaggaaataaggtcccagcagagtacattctttgggggtcctccaggacaaatgaaaaccacagaaaccctagggtataactctgggctttaggtctgtaatgccattagctgggtgctaccaacataaaaaggtaatgttgacctttatagaactggcctcctgggtctttttagtttgactaaaatctggagtttgtgaggctaaacccctctccagccccataggcctctggctagtaaatttggttataaacaccattcaaccattaaagcccaaatgaagtcaagtgactatttgattacaggtttgattaatggaacccagacctaagactaactgtaaccattccggattctttaaatcttgaaagcatttgagaactaaaacactgtgggtgtaagtcatttaagtaattgatacccccaatagagggaccttatatccactcattttaaagtgtgcagactttttcttagttatttgttttcttttcttccccatcaacagagagaacttttctgaacctaggcgctctgggctatctttatttattctataaacaggctaccacctaaggtatgaaggcaaaatcgggcttatcaggcaggcaaaaatgctttctattctgttgcatcaacattgttaggcaaacagcaagaacaggatcaggaagataaagccctgaggaggtctcacggttcccaggaatttgtgtgaattaaatgatctgatcttatgaaaatgtagaattgcaattcgtaggaaaaactagaaaactggtgatagcagatggcaaacagacacattacaggttcatttgaggaagactaagtgatgatcatctgggagatggcaggaaaattggggccttgaagggctgtcattcatagttgtacataccgtttagttcagcatatttaaagtgtttcttttttcaactgttgcattatttctccatgaggttttgggttttttttttttttgtaagtattttattttcaacgaaactaaatttccctaattttaaattgatattgctgtttggcagaggtgaaagtattggtatcaaaatgacaataggatggctgttgcaaaaagagtcttacctgagtgcttaattttgaacccggtaagatttggatccttgaagttacagtacgcaaattctttaaatgatcatttgccgtgactatagcacacattatattgtcctataacaggaagctgttctaaatattggatattaaagagggcttcaatttccattctgtgcaaggactctaaaattttagacaggctgtccaagattatgattcatcggagataactaaaactaattttttaaatttgagttttgatttcaaatacaagacactgtttattttgccaaaaactctacttggttctttgttgctgttttgctgtttctatttctatgaaaggagacatcacaaacttttcttttctttctttcttttttttttttttttttttgagatggagtctggctcttttgcccaggctggagtgcagtggcacaatctcagctcactacaaccttcacctcccaggttcaagcgattcttcctgccacagcctcccgagtagctggcattacaggcacccacgaccatgcccagctaatttttgcatttttagtagagttggggtttcgccatgttggacaggctggtctcaaactcctgacttcaggtgatctgcctgcctcggcctcccaaagtgctgggattacaggcatgagccaccgtgccgagtcacaaacttttctttcttggctccatgtgcggcagtccataatggctcaacctaagagttattggaagaatgatttttcttagtaagaacaactcattgagagttgaagaatcagagagacttgacagtatcatagctgtgtgccatttcacactaaaatataaaaattaaagtgaaaaacttacaaaacataaaggtatttatttatttatttatttatttatttatttatttatttatttattttgagaaggagtctcactctgtcgcccaggctggagtgcagtggcgctatcttggctcactgcaatctccgcctcccgggttcacgccattctcctgcctcagcctcctgagtagctgggactacaggcgcccaccaccaggcccggcttgtttttttgtatttttagtagagacggggtttcaccgtgttagccaggatggtctcgctctcctgacctcgtgatccacccgcctaggcctcccaaagtgctgggattacaggcgtgagccaccacgcccggccaaggtatttttaaatgactcactttttaaataagtttctaatactcctctaggtattaggtattactgagtttcaagaaactccttaaatatatgaattgtttaaaaacaggtgtttatccactcattagagagtggttgcctatctttgctaacgttatttctttgctctataggcgtctaaatactttaaacaaatgtgcggtgatgaagctagaaattagtcctcatcggaaacgagtgagtatacaaattgcataatagaatgagggggaaaaggggcaaacaaaaaagtgaatgatgtgttttgtaataggttttgtttctccaactcttagtttgttgttccgtaagcatctacatcttgaatgatatcgcctagacttgatagccttatgtagttgaagccaatagttgcaactagtccattacattattttatctattgtttttgacctgatcacatcagctattattttgcctaattactaactcaatgcctattacataataaagggatcatgcttaaggaatcccagtggatttttgcattgctcatagaggaaataaactgaggtttatttccaactcttctgtcttcccaaatataacaataactgtgcttcaaagctgtagagatgaaagcgaaggccgatttgtgcaatattgaagaataataagagatttggagggaggaaaggaattggaagaggaagaggagaaggcaggagatcccacacagtttagtcaaatggtggtacacaaccgagctggatggtattttcttctgcgtgtgagttgtgaagactttttatgagatcttaggagaagaggtgggtgtagtactgggagtaagtgtcacaaattagagtaaacaggaatgagtctggtcaaagaacatatttctgacttccgggttcaaattttaattatgccagaatccctgagctgcaaaaagttgccttcttggggagtcaaagcttttaaacaaatgaactggaacctcagcgcccactgagctatgcagaagagtcctagaagccagcgctccatgcttgccactcattgtcctgtgaaacttgggccacaggatattttccacaccagtggaaaagacatgtatcataccgaattgtgccctttgatatcctgccgaaaaggccaagatgcaatagtccgtgtgacagcttatccctgagtcctgtacataaatcgggcataatcagcaaagacgttccttagtgtttatgaatgccgcgagctgtcagggctgggtatttgtgaagccttgttcaattggctggagcatgactgaggttgaaacttcacaggtcagctgtggcctgagcgctagccttcatgtcttgtgggggaggggaagaaaaggtactggtaagagtctccaaagcactgatagtggactgaatctgcttgatgacccaccttgatccagggcccctttactccagtgggagaccttatacatttttagtgtctagagatttaagttgccactcttcttagtgtttgaaaactacctttttaattgcaagagggaatataaacatacaccaacaaaagacagcacaatggaaggcagcccagaggcagtcctgctcattgctgacttcagttcaaaatattttgcatgcctggaattttcaccatctcagaggtttcctctatgagcaattaaagaacagcctatggatcccagagtttccataaaatagttcttatttaacttgcaacatttggtcaggcactctcctgttaaattctttaaatacatctttgttatttaaagaacaaaacaaaacaccgggcactgtggctcatgcctgtaatcccaacactttgggaagcccacgtgggaggatcgcttgaggccaggagtttgagaccagcctaggcagcatagtaagactactgctctctacaaaaaatttaaaaaagaaaaagaatatgtaagtggggctgggcacagtagcttatccctgtcaccgcagcactttgggaggctcaggtgggaggatcacttgaggtcagcagttcagaatcagcctgggcaatacagcctgtacaacagagtgagaccctatttctaaaaaaaaaaaaaaaaactttaaaattaaaatcatgaagtacaagggggaaattgatactactggcatattatgagcagcctcctgctcatgccctgctccctgctggctgccagccccagtgtgtgaatggctcctttctgtctttgcagagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggtaagaacttttctcctgcctccgggtgtggggcactgggggtcagaaagacattgcctgtgcttgttctgtgggaagaaatgggattaagtctggcattcttagccatgtccattcctaaggaaggtgtcaaaccaggaagcaccaaaattcaaagaaatcgataggattgaatgggtatagagttccggttggggaagatgaaaaaagttctggagatggttggcagagatggtcacacaatgagaatgaacttggtgccactcaactgcacatttaaaaatggtgaaaatggtgcactttatattgtgtatattttcccataatggggattaaagcatgggatagaaatcaagtcctatcagttcctaagataagatgccagcaagcagcccattgctaatgttgcttctacctattaaaaagcctttgggccaggcacagtggctcacacttgtaatccaatactttgggaggccgaggtgggaggatcacttgaggccaagagtttgagaccaagctggacaacatagggagactctatctctacaaaaaattaaaaaatgagtcagatgtggtggcacaggcctacagtcctggctactcaggaggctgaggcaggaggatcacttgagctgaggagttcaaggctgcagtgagctgtgatggcaccactgcactccagcctgggcaacagagcaagaaaaaataaaataaataaaatcaaataaaaaggcttcacactcattttcctctcctcttctctcgcaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctggtaagagtttaaatgatcagtcaactgtcgttgaaaatgatatttttggtcagttccttgaggttgtccccacagtaaaaaatgacacttctctcctttattaatatatttcatctgtcatcctatggcaatcactctctgcatttttgtttgtttgtttgtttgttttgagacagggtcttgctctgttacgtaggctggagtgcggtgcagtggtgcgatctcggctcactgcagccttgaccttctgggctctagcgattctcccacctgaggctccagagtggctggactcctgagtaggtgggactacagttgctttccaccacacccggctagctttttttttttttttttttttttcttttttcctttttgtagaagatggggtttcaccgtgttaactaggctggtctggaattcctgggctcaaaaaatccacctgcctcggcctcccaagttgctggaattacaggcgtgagccaccacgccagccactctttatttttttgaggccacatttgatattgttgaagccagtggagtcttaggaaattatcaccgtgggtgggttgattgagttttcagctctttgagtgacagattgccaattgatggggtgagaatgcattactcttgcatcacgtggtataggcacctccttcccaatattaagaataatccactataagtaaatgtatgcacagtatcagatcgtatttttggatggaggaaaaggaaaacaataagatttaatgagaccatctttgaaattcttgatttacagtacctggtcttataaccgtattcatgcctgtttttagaaatcattttggggcgggtgtggtggctcatgcctgtaatcccagcattttgggaatctgacataggtggatcacatgacgccaggagtttgagaccagcctggccaacatggcgaaaccccatctctactaaaaatacaaaaattagctgagtgtggtggcatgcacctgtaatcccatctactcaggaagctgaggcatgagaatcccttgaacccagaagatggaggttgcagtgagccccaagataaggctactgcactccagcctgggtgacagagtaagactctatctcaaaaaatataataataataataataataataataaatttggatgtgaatatttgtagcatccacctgtgctaaagaattcaggttactttttttctagcaaagactgtctaacagtgaataattattttaaggaattcactactctaacatattatagactcaaatgtagagatgaaatgcattgtacaaattgttcataattactttgaaaaatatagctccttagtatatagaatgtgaggggtaggctgtaaggctagatgggtcatggatatcacctaatctgggtacatcttaatttttctgctatcagtgccaagcagagaaatgtttctagattgacatctcagtgcatttttcagtgtcatctgggaatccttaagtcttttcagtaatctgagtgtttattatccagtcgcacactaccatatttgataaaaatggagaagccgcccatttcattagtagcactctgtagcaaacccaagttgcttgagaaagtcggcaaagcaaggaaactgttctttttgtctccagctcctcctctccttaggactcatagcagatttaacttcagcatcaaagcacctcccgttcaaaggctgttattatgtgagccttgctaaatacagaagttgtttgttctgaatgacagaaataagtattgaccggtttatcctcacatgcttcagattctcggtggggatcgtaatgtgttcttttcacattccgccgtcgggcttttctcccccgacaaagcgagtattatgcacacttatagccatgataccacacacttaactgtatggaaatacaaacttaactttgctctttcgttttacctttcctggagctataaacagtaacatgccatggctgctggtgagcattcaaaaggcaaagcagtctgtcttctctggagttcctctgtgcttagagtaatattttccctgctggctatttaaaactgcatattttagattctcatttcggagtggcccacccccatcccaccaaaccctcaagaatctgaaagtccataatacttcttgagttctggtcagtgtttccagtgactcaaaaccaactgtaaaagcctcacatggtgggatctgtggagcagggaggaatcctacacaaggttcttttcctgtttggccttgccctttcgggtcctgttcagagaggtcatttggagagctggaatttctgcttgacagcctgaaatgcatgacatgggtttcctgctgttgcatatagtgctggggtggacctggtttcaggacaccagggagcctggggtcggctcacaaaacccccattgttccttttccatcttcctttagaaacctaaagatgtaatgttctccgggtcatcagcagcagattttattttgacttcaggtcattcactgttgagctctggagttggctcccattgtgttaggctctcattgctgttttcccatcatgtgttatctgcgccttttgaccctaaatgctttcgatctcatcaagaactcagaagtgattcttacccttttttcaagacaaaagggaccttgtttttcacactctatcagatgcacctaattagggtattacatgttgttttctgcttgttccttcctataccgccattctgtaaggaaatccatcagcttccttaagactgtagaccccaattctccaggttcaaggtggaaggacgctcctaactgaggaaacggacctgtcaacccccactcttagaagatctagaacagcactgtccaggagaactgtctggatgataggaatgttctttatctgcacaggccaatacagtaggtactgagcacaaaagatgaaggagcacctgaagtgtggccagtaccactggggaactgaatttgtcattttgtttaatttaaatttaagtagccaccgtattagcacagatctggagcccacagggtttgcctgcagaattggacaagtgtagacagacaagtgagcatgtctccgccaacaccaccatctctgtgttctttaacagggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggtgagagcgctgcctgcgggtccacgtactcaggggagctcggattacatgcagcttcttctagttgtgtggtgtaaacactgcgtccacgtgaatgtaccccacacttagtgttgctcttccgacaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatgtgagtgtcctttgatcttaagattgttggcattggggaaaaatgggaccaactgaagcttgtagcttccttgatagcattctttttttttttgagatggagtctcgctctgtcatccaggctggagtgcagtggcgtgacctcggctcactgcaacctctgcctcccaggttcaagcgattctcccacctcagcctcccaagtggctgggactacaggagggcgccaccacgtctggctaatttttgcatttgtagcagagatagggtttcaccatattggccaggatggtctcgaactcctgacctcaagtgatcctcccacctcggcctcccagagtgctaggattacaggtgtgagccaccacgcctggccttgatagcgttcttttgacaagagagtctgcatggtgacctcttggaaacccatgtcatcaccttcttccttgccgccttgtttgtggaacaggtttctgtgtaattattgaatgatgtgaaaataaatttcccagtctctaatgactgatgcaattgtacgtttttacgtgcaaaatgaaaagttagactttcattagtttctagaacagtgttatctgagctggtcagataaagatcaggtacgaagatctctttctgtctccaccttgtctacagaaatttcagttgcttcacacccctcttggagggccgttggatttaaaatttcacaggtgtctgtgtgttttatcttgctgtaaaatgaataaataatctttttctgttattcatctcagtctctgccagaaatacttgggagaacaatacccatgcccttcttacttttatgtaaagcttaaagaaaacagttgtcgaaattaatgatcaagatcaggattatggcttttacagccttgtgtttttcttggctcagtgtggtattacagcaacgtaatttaaaagcagcctctcttagcgctcaaattgtctctaggattggcacagtggactttattttatgagaaatggagctggtctggattatttcattggttgtttcatcctttcatattttataaaaacacaggtcacattttcctcaccgaggtatttgttatgtgctgtaaccatggagctgtttaatcagtttgtcctatggagctacatttgagtgacttgatttttccaccacatgctcttttaaagagttatgtattcaaggagacctgaagatcgggatcagcattttctacctgtagattgtttatgggtttatttgcatttttatatatttgcatattcatatgcatttttatagcctctcgagcatgctttctaaaacttaagaaattactaattcagtgtattttatttattaattgaactgaactgaatattttcagttcagttcaattcagaactgaatattttagcagcttttcccacttcaagaaggaacaaatcagttaaactcatgcaaatctccagagatactgaacattttgtactcaaggctgagagatctctgttcttacgttcttgtacatatctcagataagatttttcatcaacactaaacaaaagtgtatagtgttttcagtaattgagattgataaattagggatttttttttttcatgcttaggaaagaaaaaactgttctgtaaactaaaagagcaggcatcctctagagccgaactctgaggtggatttaagagtgtttgggtattgtgggtgtttaaaaattttttcactccttcatgaggcaggaaatacttgaggatagtgacgccggtggcaattcataacttttaccgtattaacctctagtgcactttctacaagtgcttgttcagtactgggctgaggtatttgatgccgatatttgctctgggacatttccttgcaatgtccatgcaaattcaccaagctgatggagaaagtgctggtgtcgtgcagatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccaggtacgggctgcatgggaggtgcatgcacacagggggcagcctacattcttcctaggactctccgtagctgtggttttgtgggactctttcctgaaacaagcaagaaggttagaccgctatattagtccattctcacaccgctaataaagacatacctgagactggtctgttggcgtgcatgagaaaatagtctcactggacttaacccccacagacaaaatccatcgaactgatccttttcctcagctctaaaggaacttgaaaagtatttcttagctagaggcctggggcctagttatgctagtgcaggttaggttgcttctgaaagtcatataatgtttaaatgtatgtttaaatagttccttttgagacagagtcttgctctgttgcccaggctggagggcaatggcacgatctcagctcactgcaacctctgccttccaggttcaagccattctcctgcctcagcctcccgagtagctgggactataggtgcctgccaccacgcccagctaatttttatatttttagtagagacggggtttcaccatgttggccaggctggtctcgagctcctgaccttatgatccacccggcttagcctcccaaagtgctgggattacaggcgtgagccactgcgcccggccacatttaaatagttcttaaagttgactggggcattccaactgcaatgggatacagagctagagatgagtagaggagagagatcaaataagatgaagacaaaaggtcaaggaaacaatggacttagccctcacctgtgggagggggcctgtgtattcaggcagataaagatgatgacaccctttactccaactccctgggactcctttcccacactcctcagaagttgctcccccaccatgcaaacacagcccctacaagctgccctgttcccagtaggaacctatttaattaaatggtttgaatcacctggatttcatcaaaagcatatctctttaatgtttttttgtgtgttgttgacaaaactctgagatactctggtgaccaaagtaaaaacactcttaatccacttaacaataaacagattccagtgaaaatttttttttctctcttctttgggtttccttgaataataccttgaagaaaaatatataaatatttgaactgttcccctcctgtatttcctctacctagggtaatgcaaagaaaacaaagtttgggcaaaccagatcagaaagatttgaatgaaaacctagctgccactcaagggctggcccatatgatcgccgagtgcaagaagcttttccaggtaaggaattgagaagtttggctcctttattaaggataatgtgaataggtacaaaatcttaggcttgacccttgttcatgtcttacctgaagaccttttccacagctggagacggtataaatagcctgagaatgtcttatttacatatattataatgtatcagctagagttaatcatgtttaatgaaattgtccctttacttggaaaagcagccgggcgcagtggctcacgcctgtaattctaacactttgggaggctgaggtgggtggatcacttgagctccggagttcaagaccaacccgggcaacatggtgagacctcatctctacaaaaaaaaatttaaaaattagccgggtgtggtggtgcacacctgtagtctcaactacttgggaggctgaggtgggaggatcacctgagcccagggatgtggaggttgcaatgaaccaatattttgccactgcactccactaggtaacagaatgaaactctctctcaaaaaaaaaaaaaagaaagaaagaaagaaaaagcaacaaattatctggaattaaactgctgtatccacttccgtatctgagaaacctgctttgaccaatgtaattcactccccctactctaactttccaaagaccttacatggaaataagatttcagatacatttatggaggtgatctgttcatatcctcgtgataacacgtgcggtcagcatgatagcccacctccggcgggaagatgcctgcactgctttaaggaccaggccattgttcctacccagtcttttccactgatgggcattgagattgagtacaggtggactcacctcctttctgtctgtcatgttccgcacaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtaaggcttcaccctgttgtcggctagttgagtccaggagtcgaagcttgggtccatcagagataacacgcttttgccaactaatctgtctggggatctgtagcccacaacctcccttgtagagctgggcaccggggtgagtaagatccccgtggtgagagtggaaaccgggcaaagcaagagtaattttcttcctgtgtaacacttgggagaggatttcaactatttctaatgaactcctttggctctacagaatcacactagacttccctagaatgttttgctaatggcattgagatgcggaacatcctatgacacgcttcgatttttccataatttggtcagaatccctttgcactcttctctgttcttagttactgttctcttggccctttaatgagcggggatcccttagggggaaattaactccagttaggactggtaaacctcttgagggcagaggcatcttgtaaggctcagcaggataggtccatcggaggtatatgttgatgccgcctctaccatcttgaaaataaacaaacagtgggagtaggctgggtggccttgccggctttggaaatgagtgcaaatgtctgatgtttttgtttttatttatttatattttttgagatggagtcttgctctgtcacccaggctggagtgcagtggcatgatctcggctcactgcaacctctgcctcccggtttcaagctattctcttgcctcagcctcccgagtagctggcgctacaggtgcccaccaccacgccatgctaatttttgtatttttagtagagacggggtttcaccatattggccaggctggtctcgaactcctgaccttgtgactgcccaccttggcctcccaaagtgctgggattataggcgtgagccaccatgccctgccagtgactgatatttctttattgcatgcactctgatataggtcccagaaaaaaaaaaacaaatgtcatcatttttttcttttttcttttgagatggagtttcattctcatcacccaggctggagtgcagtggtgtgatctcagctcactgcaaagtgcctcctaggttcaagtgattctccttcctcagcctcctgagtagctggacttacaggtgcctgccaccacgcctggctaatttccatatttttagtagagacagggtttcaccatgttggccaggctggtcttgaactcctgacctcagatgatccacccgcctcggcttcccaaagtgctgggattacaggaatgagccactgcacccggctcaaatgtcatcattttgactcgagttgacaacagctttttttcactttctggcttgctcttaaatatgcttggggacagcagcctatttaagtcatagatttattagcccccaatatttctttatatactgattatatagtattatttatatcatttaatcaattaacgttgattatatgtaactaaaattgttagtctaactaacaattcgacttcaaaaactaggtgtgtatggattgccttggcactgaaaaatacatcctctttccaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaaggtgagcgcttcccagttgtttttttgtgacaaggatgactccatatatgaaccaagcctatatgtcactgatcttacaagatggtataattatttaaagtagaggccgggcatatggtggctcacacctgtaatcccagcactctgggaggccaaggtgggaggatcacttgaggccagcagttcaagaccagcctgggtaatatagcaagaccctatctctacaaaaaaattttaaaaatcagctagatgttgtggtgcatgcctgtagtcctagctactcgggaggccgaggcaggaggatcccttgagccaggagtttgaggccgcagtgagctgtgagcatgccactgtaccgcagcctgggcaacagagcaagaccttatttctaaataaacaaaacaaaacatatgcttccagaaaagtagtgaacaccttcaaatatggaaaacagatctacatttattctagcagtgtgttcctcgctgagaatggtctgaactctttggtaactgagctcagaaagagaggccccttccaatgaatatgctcattcgtagcagatttttgccccttttaggatagattttcttgtcagaaacagctagtgaatgaataagccaggaaataacatttgagtcccaagggagatgtggttaaggctgatgtatgtgtaattcataaattctctggagatattactgaaagaagaattccaaaaatctttgtggaaatgtcacattggaagtccagaccttttcaaacagccagcgctcctttaggtgtctgtgttccaagacatttgtgaaatagaaaaatggttttaagctacacttcaaatgggctcttttttcaaagaggagactgtctgagcacataaaccctctgtaacaacggctctgtacagagttcctcattcagcagtccttgtacagtgtcttcgtgcatgtaatgctgctctaacagaatctcacagaccaggcaattataatgaacagatatttatttggctcatggttctaaaggctgggaagttcaagatcaaggagttgcatctggttagttggttggttgtttgattgatttggggacatggtttcattctgtcaccaaggctagggtgcagtggcacactcatggctgctgaagccttcacctcccaggctcaagcaatcctcccccctcagcctcccaagtagttgggactgcaggcatgtgccatcacacctggctaatttttttgtttctggtagagacatggtttcaccatattgtccaggctggtctcaaaactcctgggctcaagcgatcctcctacctcaacctcccaaagcgccgggattacaggcatgggccacccaccatgcctaatgagggtctttttactgtgtcatcccatagtggaagggcaaagagagggcaagggagagcaaaagagcaaatgtgcagcctcaagccatttttatttttatatttatttattttgagatgggggggtatcactttgttgcccaagtttgagtacagtggcatgattacagcttaagcaatcctaccatctcagcccccggagtagctgagactacaggagcacaccaccatgcccggctaatattttttatttttagtagagatgaggtatcactatgttgtccaggctggtcttgaactcctgagctcaagcagtcctccctccccagcttcccaaagtgctgggattacaggcgtgagccatggaacccagccttaagctcttttataattggcattaatccagctcccattaggccccacctcccaacactgttgtattgggcattcactttccatcacatgctttttggggaacacatgtacaccatagcaagtagtttagaggatgccatttacctaggcctgggtcacacagcatggccactgagcctgacccgtcaccacactgcaaatagtgaagagtgaagcacgattttaaacttggcttctatgaaattccatcatttctgcctctggttttgtctctacagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggtatgttctgattctgatttttttatatggtgagggtcatgaaggaaattctgactttttgtctaatgcaaagaatgccttaaacaaacacgtcattttttcttggtgacttcatgaagaatggtgtttagaaagtagcatttcatgtttgttggtctttcagcgaccacttcgtaatttggttcccttagaaaatgtggttctaaagcaaagcaaatatggtagctcggccatgaattcaaaggcatgggaaatgatagattttatgcatttgaactagcaaacagatgtttctcattttatttccatgctttctaacttaaataattcatcagcttttctttcttttctctgataggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctccagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttcttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctct

SEQ ID NO: 12560 - DNA, 64046 bp, Human
atgggacatcactatgttgtgaaggctggtctcaaactcctggactcaagagaggcttctgcattggcctcccaaagtgctgggattacaggtgtaagccactctacctggacacaacattttatttgaaataagaaaaattttccctcactgggaatgctgcagttgaactagttcaaatccataaagaatggaagactgcccagtggtcattcattcacttattaattctagatgttaaattttctagggtgggggaatgtgctcctacattcaaggcattcttgaatgtagccaaactttgtagtttagccaaacttcatagctaatagccaaactttgtagtttagccaaactcttctagcagcaaaacccatgacactggaactctgttcttcacactggtcatttgtaatagaataacagagctttagcactagataggttctgaaagatcattgaatctaatcctctccctttgccagtgagaattctgaagcccagatttgttgatttgtgatcgatagtgtcaaagacaggcctgaaacacagatgtcctgggtcctagaggtgctgtttgcccctctccatatttcttttgttccagaaaacccttctccaaaactggccctaataatcagaggggaaagccatggcccctgccttggggacagcatgggttggcacagaaaagaggtttacaattcagcaggaagtgttgtgcgtgcgcgcgtgtgtgtctgtggaggcgcagggagggtcacctgagcttgccctgggtctggtcctgggctcagtggcaaattcaacgctgggcaggtggcctgaggacaatgacggtgccagctgtgagtcagacttcctttattcataaaatcatgttcctccatgcagtgcttctcaacctggctgcacgtcaggagccacctgggtagctttgtaaaaaccccaatgcccagttggtttgcaccccctgagattctgattaaactgttctggagtccatctctctctttttattatctatctatttatttattttttaatttggcggctcctctgggacttctcatatgcagtaggggttgagaattgctggtttctttggccagatgggaacatgcaggccaatagttacgcacaaacagagcagcagagcaggacggtgctaaggttggaaagggtgagtcatgaaagttcaggaaatcagaataggaaggggtgagaatcctctcatctgggcttgtggggcaggagagaagagcccagtgggcaaggtccagtgagtgtgcttagaactgggaagatgaggggaagggtaagcgctgggcggcggtgggcaagatggacgagattaaacgggagcgaggatttcagcgagagctttggcgacacggaaggctgagaatcggagggagcctgtcgggcgaaagcgaaggcggctgctgggcaggcagccgaatccggctggagagccgagctggtgagacctacaggaagtgaagggagtcgctcagggcgtggcgcaacgagactcttagaagaaactctgaggcagagatggggggcctccgcccatacggagacacaaggaagtccacatgcacacgcacgagcgcgcacatgaacacgcacaagcacacaaacgcctcctccgggcagggcacacgcgcccgctgcacaggccgaggccctggactcggaggggactgcagagccgacccacaacccgggccccgatgcccctcccggccgcgcccctacgactgcttgcgcaacaggcggcggctccagtgggcgcccgccgcgcgctgccggagcccagcccagcccggcgcgcccgggaggagggagcagggagcggggaaggggtgtgtcccggctgcgtgctgggactgcgagggtctgggaggggcgaggcgcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggtaagcccgcgccctcttctcccaggcgcgacgcggagcagaaaggggccgcccgtgcggtgccgctggagcgccaggaccgccctttgtagccccgcgtactccaggagtaagcgccccggagctgcaagtgcgcggtcaccccggggcgcgggcgcgagggggctttgggtgcagacaccgctgaagtggggggttcaattacggaaagggaggaaaaaaagacagggtcccattcatctcccccctagctggggattggggttctggaggtcgggaagggggcgatgagacggtccgaaaaaataccaggatagcgtttcctggcgtcgtctccgaatcccagctggcgccgctggcaggggtgcgcgctggacgtgggtgcagaagggactaggtgagtgtgtgtgtgtgtgtgtgtgtgtgtgtgtgtgtgtctgtgtctgggaacggagagattgcgcgcgagtgtgtagatgaggggttggtagaggtgagtggcgctggcaaggaggctggagaggggggcgtgggtgtgtctggcttgcagactgggtcgggaacgggtgtggatccgagaggctggtggcgcttcagtcccgtagcacacacagggcggtgtgcatgtgtgagtgtaagcgtgtgtgtggggggagggtccagggtgtgtcacagtgcaacacgcgagccggagcaagtgtctgcgagcgccactgggcagggtgcgcccccggaggaacccgggattggcgcatcggcggcgtgggagaagtgacctgggcgagaggggtctcgcggacatttggcggccccttgagctggctggagctaggagtggcgtcattttcgcctccgcccaccctcccccgctttcctcccctcccctgcctctggtgctggccgctcctgccctccacgggggaaaacagctggaattacttcgacgttcctgggggatccgccgcggtctctgattcagcctcgggaggagatttcgggctgggcttggggaatgcggctggttctgggggaaacacgctgtcacgcctctgtcaaattagtagctggagctgggatttagtgggtcggttccttacccacccctcccccatatcccccgcctgttgtccctgctgtccctgggggtcctgaacagcacgcctctgtggcttggaagtgggagatgcctggcagtgggtgggggaggcagggcccttggttatcttatgcccatccaagaacaccccttcctcacggacgctgggggcacttcagtttgtttggtttctttaagctactgggaaatatctaatattcagaagtcagccagtggccaggcaggagggcggtagacatccttataatacccatcagctgcacgggaccttctcctaagctgcctcaaaagaacatatctaaatacaaaccccctgttcttgctgcagaaatgtagtttcaaggcgaatttttcagtctagactcttcctgttgagaaattctggcgttcttattgagtttcacaaatgtgattgaaataagcaaggtacagagggggcaaaccccagcgcctttcttggaagggctgccttctggtggggaagacacacggctggagacgcagaccggttctgtgtggtgtgtgtggcggcagagccagccccaggctggggtggcacagtgtcggggatgaaggaaggtgtaagggagagagagggttttggtgtggatggaaaactgggtgttcccctgacctgtgacttcttagctttgtgggaccgtgtctcccactgcatctgggcaaggaggaggatttgcctgccctgccctgtaacctggcccctggcccagcgcctggcaggtgggaggagttgaaatatgcacatgggatgaagtggatggctctgggtcttctgccccattctcctgtgaaccagcaggttgagtttcgggcgaggtaatagactgtgcatgggtggaggtgttggcttttgcttttgagggatcctggagtgtctgtttgggtctcttgtgaggaagttcttttggagcaacaaagtttgatcatttggaatggaataaaaaactcacacaggacctacctagtccaacttctttccattttacagatggaaaatgaggcacagggatggggagggatgtgcccaggccgaactgagctggagctcagctttgtgagaggctcctgggtgggactgaaggcagtggaaagggttcctggcaggattttgcctgcctgctatggaggggcgaaaggaaattgcatcttcattgaatttctggtgaggaaacttttgaggccaaaggggcagagcggaatgattttttttaagtgtaaatcaggtgttcttgagagattagcaaagccagcctgaagggcaggggcttagaggctgcagccccctgagttggcctttgactgaatggggctgccccccccccatgacagaagacagatctcaactgagctgagggcccccctgggttacgttgaaatccgctggcctgaacttgcctcctcatggacctgaaagaaagatagcattgtgtttttcgggtggcccaaagctgcagttcttccttgggacccaaccccagagaatcccattccagatgtgactcagaggccttgtcctgggagagaaagcgtgatgactcagcatctgagactcaagcagggttcaggtttgactcagcctggaaggaaggccagggagggacacgacatctctctccctccagagcagccactgtctccctccatctgccttcatcctcgcaagaacgttgcctggatcgtattgctccattgaatggatgaggcaactgaggccaggagagtttcaggatttgcctgttgccatatggctcaggtgggagagccagactttgaacccggacagttggacttcagagcctttgttttttttccatgacaacatgttggggcgcctgaagaaatcaggctcaaatgaaaaggcagtcaggagctccatgcctcagtttgcttttctgtaaaatgagagtaacagacatgatgccatcagaatgtgtaaatattaatctgtgtaacctgagaacagcactgagcatgtggaaaacagcgtgtaggtgtttgccgtcagtagcacccgcagaagacattctcaaggcatcttcttggcaggcagagtctgggaccctttgtcctaaacctacccaaggctgtgaaagtgcctgcaaatgcttgacctaggtattgctttttgctaagcttatgtaggttgcataatagtgtcatgaaaatcttgtctgaaatgcacatttccaggcccggtctcctgcgattctctctccatcaggggatatgctgttgtttcaaagctcctttggctgggttgggaatggggtatcctgcaggcagacagagttgagaacctctgctctggaatgacaggggagagaagaaggaaggtgtagtcatacatgccgctgtaccttcaggccaccctgtgtccacagtgccagggaattagtgagtgctcagtaaatagctcttgtttgctatagtgccttggaggttcaatgcatcacatcagctaactgaggtagaagacattctttccacctctcaggtcagaaaattgaggctcaggctggtgactcttctgtccagagtccagtgagtggggttctgcccaaggtgagcctcctgagccctttccaccctccaacattgcgcttggaggccacccacaccctctgggcccaccttttgagaaggagcttgtttcctggatccaccccaggctgttgttcctgcctcccttgatggctgtgtgatggaagtactgcgtgtccacttgctttttatctttcaacttggagatagaggcaggctagatagcggtcttggctgagaacttagcccaggcaggtaggcagaagggctggggacactgaggccccacaggaaggcggctgcagaggtagagggccatgagtaggtgccaacctggagccgtgttctcggggtgggggccatgtgaaaagaaacctgggctccctcgggtggggcgtaagccccagcactacagaatgggaatggattacacaatcggggccataagcaggtctctttgacccagatctttgactttcccacctaacattgtttgcagacctgcctatgccctacctgcctgggctccatctctgaccttttgagtccagcgggttttcttgcaactgagctggtagaaagtgaggctccttaacagtctgggggccttgagtgccctccccagcagtttaatctttcctttctttaaatctgtggggagactttctgcagctatacattttaaatctgcatagagttctgtttgaagagaggtgggtgggggcccaggtctccaccttgttctcctgccttcaccctctgccccacccccacggaacctaagaagattccaagtaaccctcttcaaatatggatgtgagagggccatttaagaggtgggtctatggcctctctcagctgggaatgcttaccatctctccttcctcctttttaatcatggaactctcctcctttctccagaaaggcctccttggctgtcctctgctggaggggaggctgggttgggtccttcctgggacctgtccatgtctcccatgaaacctgagagcctgtccttagtaggtgttgtgttagtggtggtggaaaggacatctccactgattaaggaagtaacttggaccatcttgcatagacaagatcggaggcccattccggagggtggaaactgcaagaccattctggggaaggatcctgttagcgtggctagcatcccatctcgggacaaagggttctgtatgaggaagccatttcctcgtcctctgctaacactggctccgtttgtgtgatttccacaaattatctcagaccatccagcgcagctcatgcctgtcttgcaatttcacaaaataatcctctaaggagaccagtgtcctcctttggacttccagttattcacctcgtcccctcagacggtcgtcttctgtctgccaaacaaattactcgtgctgccaaaactccactgagaatctccaggaagatctcggttgtattgcagaaaagaggtgggccctgacgagattcctgacacctccctcttcctgctgttgtgtttgggacactcttgctgacctccctggtgctgtgctcaagttgaacacacagcagttcagtttcagctccagcccctctggacccacacccagggagtgaatgcggctttggcttgtttgagagggagacagtggggttcaccttcttagtgatccctttttcattccttgaatatcaaacatcactgatgcctcctgggtttcaggctccactgcaaagtacaggggccctcgaggagttcctactgtggttttgttctctgacatttgtactgtttccttgattctgattgctctgatacatttccctaacctctaaactagggaactttcttgaaggtccagtgaatccacccatattgtttgctgagttgattagttaagaaagacagttcgtgaagactgccaacttcctcaccctccccagggccttgagtttcagaagggccagaaaacaccaagagagcccatgaactgctttgtagcttgacttcaaaatctctttgggcaaagaaatgacaaaggattgtatccacagtaaggcagggctatccagggcctatctcaaggtggttttccttgaggttcaggcagaaatggtgctgttctcggcaattttctggggaagttgctacagcaaacagccacagcacatgttgattttttccctccttttaaaaatctgttctataaagagcacaatgtgctggagagaacactggctttcatgtggccttaaaaccaggcatgttacagagggtggaatctgggccagttgctgttggtgacaatcgatgctacccttgtcagcaattcccgcctgctctccctttatctgcttcactgaaggcctccaggggactgttgtccgccctcccccgagggaatgagtgccacacctgcacccacaacaaaccagtgagtttttcacctttccctcagtagggaggaatctagacatgtggcctttggaagtcaagtgggcctttgtgtttgtttttgagcctcaggttacccatttgtgaactgggtataatacccagcctctcccggggcaacctccttgaggagcaagtgaaacagtgtgctgagtgaatgcttttccaaagcattgagttggccgtcttaggaaggtactatgggggagctgaaaacagagaaccttctgggtgttgtgaagggagaaaagttcaagatgctggttttgccaaaagctcaagcctgctcatgatggctcagtggtgactgcagggtggaggagaggcatgtgactgtcccagctgacctccacacgctgaaagcctcatggtcacgtgcagcccaccttacaacgttgtatctgggccacgggtggtggtgaggactgtggatatatttagggcaatgtgagatcattgtcaacattccctttaaggttgctttaaccttaaagcagccagcttgatgcttgctgacttggggcacacatcttaacctcttgatgcctcagtttccccgtctgttaaatggtgacatgctggcacctccctcctagggtttctgtgaggcttaaaggaagtaccgggtttagagtccagttagtgccacagatactgttcctggtgctgtttttgtggtgtgtctgtgtagggttacattgttgccttcctgtggctgctcttcctggtgggcggaacctggaacttctagaacagatcatggatgtttctctgctggataccccttcagcctcaccctgtgggagttgtggcggggcccaggagagtttgctcaagagggtgtgcaggtgggtggcagagctggagcaaggcactagtcttaacagacaggagtctgaggctggcagaagtgggggccttggtccaaggtgcggggctaatctggccagagctgagcctggcagggccttggtaagaccctgtggcccttttgtcttggtgaagcaccttcctgcctgggtttccatttgcctgtaagtttgttgtggacagcgtgatctccatagacgtacactgtgcctactttacagatggagaaaccaaggcccagagaggaagtgacttgctcagagtcatggaataggaaagtggcagggtccccatgccctgattcctaggccagcgttcctgctgccccactgaggtttttgggaatcacaggctctgtgtgtccccctcagtcccccaggggctgttgaacagttctcaagtggtgtcggattactgaagatgcctctgcccactgccctcccaggtcccagggtcacgggtcacgttcttttcttcctcgggcagatcctggccttggctttgcctggcacctgtgatccagctctcctctgactctcctgggtctgctggactggaagggtatttgtgtagcccctcttgggccctcattactcattgacagacagtgctggtggagagaagggccccagtggtgacgcactgggcctgataatcagaaaccttggtggcatttgctgagcattttccatgtgtccctctcctcgctgggactctaggactgaaacccaggccacatcctcacagatgtcctggcatctccaaggcaaccctgaaaggaaagtatgttgatgaattaagcaactgtttgcttaattctccatgccattcttgaatttaagccccactgctgatcattgggagcaggagttagcatgcccattgacagacaagcaaactgaggcaaagaggttagatagccaggcatggtggcatatgcctgtaatctcagctactcaggaggccggagtaggaagatcacttgaacccaggagtttgagaccagtctgggcaacatagcaagaccctgtctctctaaaaaacaagatgaataatacatttttaaaaagagattcgataaattatgcaggatcacagagctaataaatggtgacaccatggcctgcaagccttcccccagctcctggctacctttcgcttctctggcattggtcttctcggaattcctcccaggcaggtggatgggaaaagaagtgaagatacaggctggcagctggtgctgtgacctggagccctgtttttggtgctaagctgggttttagctgaaggagacctgctggaggggtttcttctgtgcttcttggggagcaaagatggccttggagatggagacacggtttgtcagtcccaagccactccaaaggtggggctggtgggctaggagtcagccctggttcccccgccatgctgtgtgtggccctgccttgccaccccacctgctggaggacctctttgatgctttctagtgggtcccaacattctgtgattaggactttgcatgaggcagagggagggcaggagctggagtccagcaaggacctcaagcccagggacaggctccacctgccacacttgctaagccgtgagggcctcaggtgcccgggaggagggagcaggagtggaagcaccagctcgagccgccaaaccaggtcacgtatcacctgccatttcctgctggcagaaggagatcacagacaccagaagacagcagcttctgccagaactgggtccttccatgattctcaggtggtgactttgaatcccagaaaaagtgttttggggagagtggagtgaaggaagagtgtgaacattggatctgactccactccagcccctgtgctgcagccagcagggtgagctcaggacagctggcagccgcttgggcccagccccctcctccgtgaatgaaggtggtggggagtgcacgtgtgcgtgtgagtgcgtgtgagtataaatgactgtggatgtgagagtccatgaaagtgagaatgtatcagtgtgtaagaaagtgtgagtatgtgagaatgagtgtgtttgtgagaatgtatgtatgtgtgagtataagtgtgtgaatgtgagaatgtctgagtgtgagaatgaaagtttgcaagtgtgtcagtgtgagggaatgtgtgagtgcatttgagagtgtgtgtgtgtgtgtgtgcgtgtgtgcacgcatgcactagattaaataagaatgcatccaactgacattttctggatactgttacctactaggaattactaaaatcagctattccagaggagggtggatgtcgcaccaggggacatttggcaacgtttgcagattcttttgctggtcgcagcgtggggtgtatgctgtgggcatgtggtgggcagaggccagggatgctgctgagcctcctcccgtgctcagggcagcccctaaggcagaggctgcttgtggggcccaaatgtcagcagtgctgagctgaggatctctgtccaggaggcacagatgctgtcctggatgctgtccagacagcatctgctctgccctccagggggacagacagacagtggacacagcccagatgcagcctgatgagtgagcccaagggagtgcctgtcccctcgggactgtgagctccgtgggggcaggaactgggtctgtttgctcatgatccccagatgagtcccatagccagtctcatcaccatagctggtgttatttttgttctgagctctgtgttgggcacatagaacctagtgggtagaaacctctgaataaatcctgagttttccatcctgcttccgtgaactcagatgttctttgagggccagcctggtggcgtgggggctgggagtgggcagattgtagggagccaagtcctggggtggagtggggttcaggcccctttccctggcttgagccgaagcaccttggctttttaaattttaaaatttttattttttaacatttttatatgttgaacttccttacatgatttcctttggataaaagctcctgcaaaaaaagtttgaaaagttttttggttgaggcatcagggacaaggtaagggctgcttgatgggcccaactcgggagaactgaggtgagggagccgctctcctcccaccctacaggctggccagatggtggaccgccagcagctggctgggtcaacctgcagagagcaccttctgcagtccttggttcatgcggccttagtattgcaggacgcgaccaacatgcaggctaccccgaggcctgcagcccccacagtccccccagactagtgcaaagctttatccagtctcccggcagacttcagagtctaggacacttcctaaatggttcaaaatcaatggaatcatttgggggacaataaataatgtcactagacattgccaaatgtcccctgggagagaaaatcccccctagtttagatataccccgtgatcatcctcagcagttttatctctggacttcccaaaggcctttagcagtgagggggctgggtcagagaaggccccaccagctcccaaaagcagatgctcaagaacttgatatttctaggacacacagcgatttttttaacccattgcctcatgtggtctgggaagctaagctgtaggaataaaaaaggtgccgggtagggtaaagaggtttcaccagatagaggaaacggggaaggtggacatttctgtcttttctgttctggagaacgagagagctggtggagactgacagacactatgtcctaatgtgatcacggtttctggaagccaaagagaactgaccaaactgggctgaaccacagcatttctcgagtccttttaaatgtagaatttgttttccagacattgcactcttggggtttagcaatgatttaaaagcgaattttactgaaagcatgctgttgagctacattgctcatttattcagagagggagttgcagcctgactttctgcctaggagagtctctcgtgctgggagctagaggtagagaaaagaacaagctacctgcttgatgaagctcacagataggactgcttgaacccacctggtgggacagtgagagccccctgacttcaccctggcgcgctttgctgagcagggtatgctaagaagctcctgtgaaatgagaagtcctttcactcccagaatgaggggtggcgttggcagggccctgggtttctggaaggctccctaggccatgtaggcgaggtgtcccacaggccagggtcttgggaccacgaacctgctgaattagcaaggctaacagacgcgggcctttcatgcctcctgcctccaagctggcagctgcccaggaatgctcacaaatataaaaccgactttgtttcagaatgttctggagcatagactccaaagtctgtataaagccattcttgtggggctggttatctactggggaaaatcatgctggggccccagaccagagcaccccagtggagagcaggatctgcccacggaatgccatgtgttggcacaagggatggacccggggtggattcggggtggcccgcacttgccggctgacctctaagaggtgtttcaccaggttcttgggagttcctgggtcttcagaggagccctaggcaggaatttcagaggcttgcattctctcgaccattgcatccgaggggccttgggcagtgcggggcccaggttcccactctgaagctggctgtgtgagggctttggtcaggcgttttccattcagaaagtctggatctgtgaactgggtgggtggcctgggctcttccctcttgtcacttacttcttctccgccggtcctctgctgctgtctgtaagacttgaccttattctgcattttttatgcttcaccccagggattgatgggcatttagtttttctaacttgactactgatctagaagaatacatgcttatacttctggtttctagattcagctcttggaggcatgcttaatagatagcaccacctgcccaagccttgcaccccagggagtcagtggcagcattccaagtcttcctgggctgtgcttcagtctggttttgcagcccacacttctgcacctgccctgtgttagagcacaggtaacccctctggtccatcccctgctttgatccaggaagtgctttctgccttggaggtcttttttcttacaaaattgtactgtgcgttcaaatgcctgccaaactccttgacttaaggttttcctctgcccctcttcccttttagcaggcagccgagagtcctgcaccgtggggtgtgtatgtgtgttcacgcgcatgcgtgtgcctgtgtgtctgtgcgtctgcatcaccaaccttctgttagggctaactgtgaggctgaagcttgcactatgcctatacgtggtaagcatcgtgtgagcttgtgttcccctttcattgtcacacgggggctgcctgactttgggatcagcaatgcaggtccccttctagaatgcagtgagctgcatcctgggtatggtgggtgggcctgaacttggtatggggacctgtttgtgaggctgatctatccatttcattgggagggtggtgtctgtgagcctcagtatcctctcccaggaaatccactgcgctggccccaatgggaagactgggttgggtccgtgggctgtgtgtacaaggggcctcctcatcccctgcagtgcatcacgagggaggtgaagctgctgggcagagcgcaggcctggccttcttgccattggtcttggatttgcttcctttaggaaacctctcagcaggaagtgttgaccttttggcctttgtctccttgcaggcaggtgacagcagggacatgtctcgggagatgcaggatgtagacctcgctgaggtgaagcctttggtggagaaaggggaggtgagtggagatcttcctggctaccccatcacaggcacatgtgcacatagacacacacaggcacaccggagctcacacttgtacttatgggcatgcaaacactgcacaaatacacatgtatacagcatacacacggcatacaaacatgctgcacacacatgtacatagcatacagacacacatgcgtacacacataacacatttgtccactgcttccttgaaatgcaaagttgtgagaggctctggttcaagtcccataggatcgagggctgggccccttgcccacttctctgggcctttctgctctcatttgtaaagtgaagacatcgaaccagaggttctctcagctttcccgtctctaacattctgtggttatagaacatgcaacatggggcccagttgcccatagggactgcctgcctcagctctcattaaagccacatactctggggccgcactgtctgggcttaaatcccagctgtgacactttgcagcttggtgtccacttgctaacctctcagtatcttcatattctagttcttcatctgtaaaatggtgacattaggacttacctcatggggccaagtgaggatggagtgacctaattcatagggaacagttagaactttgccatagaggagatgggcaatgcatagtcactttttcacttgctattattatctttttgggcaaacctcttctgtcaacagagctcttcctgttggaaacagaagcccctgtctataggctgggctggcagggcccagcctgggctgattgttctgaagatgaatgaacctttacatttgcacagttgacaccgtagcttcaaagcatgtttacatcccaattctcacttagcctcataactgcctctgatatgtctttttaaaaatgtggaagctttggtccaaaagtgaagttagtctaaagccaactaaatgcttttaaaagtgataattaccatgcactaaccacatcctgcatgcctgcttctccgccgaccgtatttcaactttggttcatgcaggtcccaggttctgtgatcgtactcattttgtagaggaggaagttgggtcttagggaggttaatttgtcttctttgcatagttacaaagtgtgggacatggaatcaaacccaggccagcggacgttggtgaatagactgttcatttaatttccttatgactctacatgtggctgctctgttttaggttcataatttcatagacttttctttacaaatgtgtgaggcaaccatctcttttccccttttgcagatttaaaaataaaaacaaactggtcctagacaggaaggggattggtcaagttcatccagatagctggtacaactagagttagaaaccaagcctggggaggctacagatgcttgcttatcattccacactaaggtctgcaaaccttttctgcaaagggtcaaatagtaaatatcttaggcattgaaggccacatgacctctgttgcaactgctcaactttgccattatagcaagaaagcaaccatagacagtatacaagtgaatgtacttaatgtgttccaacaaaaatttaaaatgtggtgaggcggattgcagtgtgccaacccctactgtatactatgcaatttctaaatctgtgtcctctaaactctgggtctgtgacatagtcttctgaaatagtcaaacagaaacttctagatagaacaaatacatatcaccatattcttatttctcccttttaaaaaaccctgtgaaaatagtatcccacactttgctttattcacttgacatttctgggagatcttttcaacatcagtccataatccacttgcttttctctttttaggtacatagtattccactacatgtatttgcccagtgcccagtatatgaacacatgtgtctttccagccttttgctattacagacagcactgcaagaaatttgcacccttgtatctttcatgtgtgtcattacatacatgtgcaggtacagccctagaaaaaagttctcagaagtggcatcgctgggtccaagggtaaatgcatttaaaacaacattttttatttatttcgggcagcctactggaatccttagaacattttatgtatgaaacacatgtctaagagcttgcccattcagggttacatgccagtgcatctctcagtgaatatttaccctttctttcaaggtttagacggaaataaatttctttcaattccttagattgactcagcaaagtatttagagttaggcttgactattgggaagttcttccttgtgtctgtcctcaatctagattgccactatactctgatgacgttttgaaggttggtgtttgctgtacagaatggctttccccattctttcccaccagtacacactcacatgcacatatacacacacagggcaatggtataggtgccagccacgtttgtttccacttgaatttacccaaagtccctgatgttcttgcccacagctcaggggatgtggggctatttgaatccccagcacgagggcctgtgttgtcatctagtcttccaatccctgccatctaatgggagctccattccatcatcctgttcccctcatcgcttttgcatttcgctctgctgagccgtcttgttttctgggggtttgtggtgggtgaggctggggctcagttttcacagtgttgggactccatctctgggtcagtaggaaaacatgccagcaacatctcttagaaatgttggccagccaagactccagttggtcctccgagtcacactttcaccaggccagaggggacacaagacttttctctgtcttcctgggcctgtcctgccatggacagctctggtaaaagatagaatttgggctgaaactcagattttttttttttttttttgagacggagtttcactcttgttgcccaggctggagtgccatggtgtgatctaggctcactgcaacctctgtctcctgggttcaaggaattctcctgccttagcctcccgagtagctgggattacaggcatgcgccatcatgcctggctaattttgtatttttagtagagacggggtttctccatgctggtcaagctggtcttgaactcctgacctcaggtgatcccgcctgcctcagcctcccaaagtgctgagattacaggcgtgagccacagcacccagcctgaaactcagaatttttagattgagggaaatgcttagaggtctccactgcctcttctactcacaagagactgaaatttaatccaggtccagatgacagcagccatggaaaaaatgtaaggaggaccatgatgtggtcaggtttgagttttaaaagtatagcacatgggtggagccggggagaccagttaatagtcagatatcacatttctgtatctctcaagcttgtgatcagcttagaccttcagctttttatctatcaaggctattgtcagaaaggagtccagttaatgtgtctgcttttctgctggacttctattttgagatgaaaaggaaagtctcggctgggcacagtggctcacacctgtaatccccagcactttgggaggccgaggcaggtggatcatgaggtcaggaaatcgagaccatcctggctaacatggtgaaatcccgtctctactaaaaatacaaaaaataaaaataaaaataactgggcgtggtggcgggcacctgtagtcccagctactcaggaggctgaggcaggagaatggcgtgaccctgggaggcggagcttgcagtgagctgcgatcacaccactgtactctaacctgggcgacagagcaagactccgtctcaaaaaaaaaaaaaaaagagaaaaggaaagcctgcctttgtgaggaattaaggagaccccacaaaggaggaagtgtaggtacagattcaggtcatagaaaggcccatatgtcccaatattatttctcttacagagaaaacagatgaaattgacaattttttttgtcttttcacagaccatcaccggcctcctgcaagagtttgatgtccaggcaagtagaggatgtggctttccttccccttcctcatcccgtcttctctttttcctttttctttccattggtttaagtagatcattgtgcaaacattgcgggcaaggggagagaaggcagtggtctcagctaggtcctcaccctcagctgctgctcccagacagaagctgacttgagtgctggccagagaatcaggaaccagtcacttcccacgaaagcaggacagagacaccgcctgtttcagtcccaaagagctggccagaacggtggggcgtgtgtggggaaaatggtgtgatgctgggctggcttgggaccctgtgaggggagggaacggaagcaaaagcttgatgttcttggctccacttgggaaactgaaaccagccttctctgtggtttactggcccagaactgaagtatctccattcccactcaggattgcagggtgggccagggggtgcagctcagctgtgtccaagaataggctctcaggagaacgggctgggctctctcagccgagggctgggtcagaacttcaggaaatctaagtcctggactcgttagccccaagctggggtgggtcccatgctgtgctggcctctggagggtggggcagaaagcctgagcatatggcgagcttgtggtctccttgaaggaggagaggcgcactcctggaccagccagagagccagaggtggctgaggtgttctcacctgaaccgctacccatgtgttgcacaggtgtccccagtttgggacccattctgcactctgcatctcactcctctattctacctccttacctcaaaacaactccgcttttcctcttgaatctctgatttcatgaatgctcccccatccatcccgaggcgaggaatcttgcactgtctttggaaggaaaggaaaggatgggagaggggctggaagcattggctagtagatgatcgaggctttctataccaccaccaaggtgtgtattttctcatcatcctggttgtgtcaggctgtccctagagatcaccctgacctcagtgtttaagaagaagggccagatgcagtggctcatgcctgtaatcctagcactttggaaggccgaggcaggcagatcacctgaggtcaggagctcgaggccagcctggccaacaaggagaaaccctgtctctactaaaaatacaaaaattagccaggcatggtggtaagcacctataaccccagctacttgggggctgagacaggagaattgcttgaacctgggaggcagaggttgcagtgagctgagaccacgtcgttgcactccagcctgggcaacaagagtgaaactctgtctcaaaaaaaaaaaaaaaaaaaagaagaagagagacagcactgggaagtgacttgcctggggtcactcagcagtgattggggaagtggtgccagactctgggcctcacctcttccagccctgagtgctccccttgctgcttgtgtaggttttaatgatgttggtgagggcttcttacctgccaggtgctgtgctgagagcttgccagccaatatctcatgtaatgcctcaatatctcatgataacaggagaggcaccattagctttatttttcagatgggtatactgaggccagagtggagggactgggagccacacctagctctgcctgaccaggaaggaagcccatgttcttcccgcaccactcatgtgctgaggtccaggcttctcccatgccctggccagagctccatcccgttcctctctatgttgcaggacgctgggcatgcgaaggtgctccaggagggtgggaggtgaatgtactatcttgaggtttatcaagtccaagccttcattttacagctggggaacctgagggacagagaaagggggaagtcactcattgagggtggcatggtggggcagctaagagttatggtagcaatcctctttttcaccctcctgagaatgggaaaaaatgcacccagggaagtcagagctgcaatagatgcagtggctgtggcaccagcaccatggccttggttatttgactggttctctgagctgagaacagctggaagttagccccaggggtcatctgctcattcagggatgggccgggccaccccagcctccctcagcctgatcgaagctgcccttgccaaccttccctgtggctgaaatgtcagctccttgtgttccccaggggagcggcttgctggcactgaggttgtatcttcctgcagtggggatgtgattgtccatcctcctcaggtgaaggccccattccagagccaggaagagtgaagcgcaagccccatgggtgccctttcctggtgattgacccttagcacaagatgcttcacctctgtttccccacctgtgaaatggagacagtgctccaggcttgttaagtggtggtggagagaggacactgacaagggccaatgatgtggtgcttcccgcatcagtgccgggccaaacatcacacaccctatccactaactatcatggagtgttttcccgaattatttttgctgttgtggaaacatacacgtaacatccaatttaccaacttaactacttttaaatgtacagttccgtcatattaagtacattcatattcctgtgcaaccatcactatcgtccattttcagaactgtatttatttatttttatttctgtttagacagagtcttgctctgtcatccaggctggagtgtagtggtgcgatcttggctcactgcaacctttctttacctcctgggttcaagcaattctcatgccccagcctcctgagtggctgggattacaggtgcccgccaccacaccgggctaatttttgtatttttagtagagatgggtttttccatgttggccagtctggtctcgaactcctgacttcaagtgatctacctgcctcagcctcccaaagtgctggaattacaggcttgagccactgtacccctggaactttaaaacctgcagaactgaaactctgtcccattaaacaactcctcattctagctttaggcagtcatccttctattttctgtctctgtgattttgattactctagattttgattcctctaagtacctcatacaagtgcagtcatacactatattattattataaaactgtattaatttgcattgatttgttctttgccagtgtctggctggtataagttagcatcgtgtcctcagggttcatccctgttgtagcaggtgtcagcatttccttcctttttaaggctgaatcatattctgttgtatgtatgccccacattttgcttatccatttgtccgttggtggacactttgggcactttgggctattgtgaatactgctgctgtgaacatgtgtacagatatctctttgagatcctgctttcagttttgggggacatatacccagaagtggaattgctagaggtatcagtccattctcaagctgctataaggacatatcagaaactgggtaatttataaagaaaaagaggtttaatggactcacagtttcacatggctggggaggcctcacattcatggcagaaggtgaaggaggaaccaaggcacgccttacatggcggcaggcaagagtgtgtgtgtgcaggggaactgccgtttataaaaccatgagatctcttgctctttataaaaccatgagatctcttgagactcattcactatcacgagaacagcacaggcaaaacctgaccccatgattcaattacctcccactggttccctcccacgacacgtggggattatgggagctacaattcaagatgagatttgggtggggacacagccaaaccctatcactggatcatatggttattttggattttaaaatcttggttaccaattctgagaaacctagaaagcatagtttatctgctccctgtgaagataattcctcacatttttgtttctctggaaagtctgcaaaacacttttacattctcccatctcaggacacaggcaactgacctactcccagggaaggtcaacctatgtggctcaggctggggtcggctaaggcgctgccccttaggacatcattaaagtgggggccacacagagaagcctttggaaggatagagcagaggtcaggataagatttcccagcattgtgcaccagcctgggctgagctgtctgagttaattccccaagctgtcctatgaggtcggagcattttccctattgtgccttcctttatttctttaacaaatgcccactttgtgcctggcattagtttaggtgctggggatgcagtgatgagcatgacaggcagtgacctgtgttttcaggaacctaaattctggaataatagctcagcactgccgagcacagaatgtgtctggcagcatgccaaatgtgccccacgtgtgcttacggcgatcctgtccccatcctacggagagagaggacctgaagcacagagaggttagggaacttgcctgagatcgcagagctggaaaggggacctcaagccatttgcttccagggcacatatttgaaaccaatcccgattcctcagaagaaagagtcaaacaaacatacaaacaagcaaatgtgagcattccagcttctgtaggtgctttgaagataacagtgaagggtgatatggagccaggtgatgggatagggcatggctggggtgctgtcttaggttgaggcttttttttaagtggtgacattgcactgaagtctaaaagatagatagagccagtcacgtgacaaagagactggggatagatcattccaggcagaggtaacagcacaagcaaaggcctttctgatctgaattctgaaatttccaagggcaaaaatgtgttattcctgtaagctgttaacaggctcagtgttcccagtaagtcacaatatttgagctgaaatctgagtgttgaatgacacttttcaaggttgttaccaaaagaaaatctttgtctaaaactgtattcatttagatttggcttcttagattggaaggtgttagggactcaagagattgatgaaagcgtcccccagattttcagcagtctccaaaatcttgggtgtagggttgctgtagaatttccttcagaagatgcagtgcagtgtgacgacggaagctctctggggcctgatgggttccagggccaggaactgagaaggacagagctttggtcaagggggcctacagggcatatcagcccggggactggtcagcataatctgacctcagattcacatgggagttgcagcaaagcgacaggacagcacctgtctgccatgcacttcagtgtcctctgatgagccaggccagcactgagggcctcccacgccctcttgctgaatctttggggacctgtaccatcatccttcctttacagataaggaaactgaggctttcccaggggcggcagctgtgaagtgagccacattgagcccagggctgtctgacgtagacagttctctcaaccgtgatgcttgagtatagccctgttcctggaaaggctgatcaagcccttatggactagattgtggttcacctttgacacgtctgcttgtcaaaaaatctagccaagcagataatctaagcaacacttcattgggcttatgttcagcctactgacaatgagttgttgtaggactcaagagttgctgtgccttaatggcaaatgaattttatctattcatttagttggtttcttacctgcttgttaaaatagggctccctcctgggcagttcttgccctgggcatagcttccctcctggtccagtctaaggagtctgagtcgctttattttgtgtatctgaaagcagccgatgtcattccttgaaaaataattactgcttcagcactttgactaactcaggcagattcctacttcctttaccaatgtagtcaataatttaggcttttattgtttttgttttttaaatgaatcaaaacacacacactgagcccagagctcagcactgaggagctgctggcggagtctgcattgagctgctgggtggcctgtctctggagacagctcgcctgccagagcagatggcatcaggccttatctctccatcactggcatcgcctttaggcggtctctttgttttgtcctgggtgatgttcgggcaaagtgattggtgatttgcatatgaggttctgccagcgctgtcaggcccccacctggctctggttcctgaaaagattccagaaccctcagggcacggggtgggcgggctgctggcctaggtgtccgggttgcaggaaggacacggtctgatctggctcggctgagaggcctccagcatcaggttttaggcaattgtgtttgcagatttgatgagtagggagggggggagtattttgggttccagcttattttctttggctagaattctagagtccaagacttctgctccagttggagagctttgtggaaggccacctgggggagggaagaggaggaagaatgaatatttgcatactcattgtctcagggcttccctgctaaggtgaggggtgttggcctcttttgcagatgagagacccatttgaagatgttagggaacttgccaaagggtactgtagagatagtcctagacttagatccatctgcttccgaaaaatgttatagtcatggaagtcgtaatggctggcctctcttgagctctgctgtacgtcagaaaccgtgctgggctattttcctgcatccgctcatgtgatcctcatgaaaccttgttgagggaggtatccttgccatctatccttgccatccttgttttatgttgaagatacgaggcccagaaaatctggagggatttgcccagtgtcacgccatggtgagatagatggtgaaagctgattcaatccacacgtctggagccaaagttcatttaacgagttttggggaagggacagcagagttgacttcatcaccgataaattgtacctcgtgggccgagtgactttctgtggcttcaaattgctttttctgttggatttgctgcttctaattccctccacctggatcttgagttattcagatggttagatttgatttggtttccatgggaatctgtgtttgtgtgctcaccagggctctgtgggaaatgagctgatgtgacccacagggcctccgtgtggagtggtggagggggctggggcagcaccagggccgggcagggctctggaggtctggctcccgttctgctgcaaggcctcttgttcagcagagctgagctggtcttagggatgtacaatcccattcggtgggggggctgttttccctccttttcttggaagcggaccagctcacagggaaaatggaaatggtgaccttttgctaatttctctctttccacacagttgcttcttgttttcatgccccatgactgaaggtgggcagaactcagacagaagcctggaaatcctaaactcaccatttcccattctcgccctcccccagccctacttcctagcaaagccattgggacttagagcaaacccttagagtgacagatggcaggaacgctcatctggatcagcacaaaatgagactttggaaaataaacacagcatacttctgcaattctgctgtgggtttcctaggagcaccctccaatggaacaggagaggtggggctcatacccaggcctccgaggtgtgtccaggccaggctctgccaggctgacctcactcatctcctggtgtcccagaaagggtgcagtgagcggcagcgagtgcagacccagccctgtcatttgctactcgcgtgtccttggccactcgcttgacctccctggggcttagtttcctaatctgtgaaacagtggggagcatcgctgtccctgagcacattgcaaacactgaatgcacacagcagcgggctcagctcacaggtctttgtcgccctcccctgctccatggatgatggggtctgctccatctcttcaccctaatccaaacaaagatgttcttcctaattcttgtttccttggagaactgaggtcttcagcgtgggttccagttgcatgctgtattcccaggctgacaccttctgcccactgcagcctgttccctgaccctctgtaactttgtttaattctcttgacctgatgtcaacataaaagaagactggggaatgaagcgagaagtgacaggcccagcttgacctcttgaaggtcttccattgtgtgaggcttgcaggggagtcttggctttggaagcccaaggacctatctatcttgaatcttaattctgttatctcattgggcacctatacttcagccccaaaggctgttcaatggctgtcatgatatagcacaggagacaaagctggctttatcagacttgctcagtaagtgggtggctgtctttttatcgtgttcctcctggctacacacacacctcccctggttatctctggtactttatgtgttctttactccttttttttttttttttttttttttttttagacagggtctccctttgttgcccatgctggagtgtagtagtgtgatctcggctcactgcaactgtgacctcctgggctcaagtgatcctcctacctcagcctccctagtagttgggactataggcgtgagccaccatgcctggctaattttattttttgtagaaaggaggtctcattatgttgcagatgctggtctcaaactcaaagttacaggtgtgagccatcacacctagcctatgtttgttacttaatggaatggatcattaagatgaatggcactgctgtgtctccacctcctcctccatgggcataggcgatgaaccaggaaaatatagggggaggagtgtatcattttatgaaaagatggtggggagggggcaggcccctgacattctctcttgagcctctgttcccatgatttgcctttcttgctgccatgggccttgactttatgctgatgagccatagtcagcttcctggacagctgttccagagggcaccgtaactgctctggccatgcttggaccccacttgctagactgagggagggtcgccaagcccaccaactgacttagatcctgggtatgcggtgatcctcttagagcctagaacggtcggcatctgcccagggcctgctgggaaggaggggattaccaggggcagcggggagacagtcacagctggcctccagagcccctccggatcatccagagagttgacttaagccagtggggctggccctgggagcttcacactaatcatctctggagcggttgtccataacaactgacatggagggaaatgctgcagcttgcaaaacacattcaggtctgtaccatggttttagtcttgggagcatcttaatggagcaggaggccttgtcattgacctcagcttacaactgatggcagggattgtcagagaaggctgataacttggccaagggcacgtggtggttatatcattaggataagtattgctcaaaaaacagtgctgtgccaaggaaatgtttgctattctcaccaacctagaaagctaacaccccagctatgaatgtcacccagcccagctggagttagtccttacagcttcctactgtcacctgagcatgcggctttggtcctcagattggtaggatagccaccgaacccccaagcatctcatccatgttccaagtaggatgcaggcaggagggtgaaaggacaagaatcaaaaggtcaagtttgaccctttttaaaaaactctccttgaagctacaggaattttctgctggcatttcattggccagaactgaacctcctgaccatctttggttacaagggaggtgagtaaggaaggggaccactttatcaggcactttgctgcttagtacatcagttggaattctatcctcaaaaagaagggaacaacagatgtttgggatgccaaccaacagagtctgccatagttttaaagctcccaagccagggttgacagccaaagagatgaaatctttaaggcatgcttggtgttaggtcctgtttccccacttgacagcttccaggcggtgtagaccatagtggtacgtgccatggttgctacttgccagcatataggcagtgtagactgtaaatctctaagtgtaccctccgggccagactctgtcaattggagagccagcctttccctctgggaattggcggcctggctggggaggcagctgttacacatatatttgtaattgtggtcgtgctgcaaagaagagaacagggtttgcatggcatgtgtatggtgggtagcaggaaggaggaggtgacgtctcatgtctgtgctgaggtgtttccagtgttggcacacttcctcacaaagacacacatgcgtgcagtttgggggcaggtgcctgttttaggaggatgggagcagcagatattatttctcgattctgtttggtagtggaacagcctgtgctgcatggatggccagtccttggagacgctggggaggtacgagtgttttgcagtcaaataagtgtgggaaatctgacttgctgcatcccctttagggagtcacagtgcacgttgcagagaaaggtttccttcccctcttctgcccagcacagaatgtgaaacaggatgttaaagagaacaggctttggatgcagacattcgaatccaagcttggttcagatcctgccccattattccagctgtgtggccttggatgaagtccttaatctctctcagcctcagctttctcatctctgcaatggttgttccgtgtatttaatgagaaaacacgtgtgagaaactcaaagcaggcatggggtaagatgcagtggctgtttattactgcccccatccctgccatcacctctagacttgaaagagcagctttctagactcttccagagcaggtgagaggaaagtgtgtgcagccaggtttttgtcttttcatcctcttgtctggatcaggccctgtgagcagggtcttctgtggcctggtcctgaactgtggaagagctgggtgtggggctctggatggtggaggagttgtgtttgtgttgccagccttgtcccagccagaagttggggggtccctcatgagcttcgagacaggcaatttgctctctcaggcaagaggacgaacagtgcaccttgcagttctgatgttctgggttccttgtgctttctctttgggaaaacatagaagacacgggatgggttcctctctccagaacactgagtgattgatccccgcagggacagaaggacagaacattcctttgggactgaataggacaaaggcctgtgtttgtgagtgttgtaattctcccattcaatctcagacagtcttcttgactggcttagaaccgcgtgcgtgcacgtgtgtttgttggtgggtgtgtttgttgtgtgtgtgtgtgtgtgtgtgtgtgacttaggggatgggacttgggtacagggaagatgacaacacttgcttttttcctcctcctcctgtgtgtgctggggggccaggaactgagtggaggaccgatgggggccagcagaccctggcacaaaggagcaagggcccagcggagagagttcgaatcctagttctaccaccacaaacctatgaccttgggagagtcccttcaacttctttacctataaaatgggattgatgggcctcccggtggcatggaggtctgataccctgccttactcttcgtaggcgcttagcaaatgttctccctcacctctgctcacctatgcctgggaagcagccctgcccctgtgtgaccttcaccacttcacttccatgttctcagacggggtctttgtccttcccaccaaggctagcaatgtcgaaagcctcttttttgagtcctgctcaggctgaggtttggggcagtgatgaggcagcagccagggtcctgacactcatgagctggggtgaagtgttagtgctctgtgaggctctcaccaaccctgggggtcttatcaggagggagctgagcatctcatggccaatccaagagcagagtggggaagatcccaacatggatcgatgcccttaggagagaaagttcctttctagggtgtaatgctcaccatcatctgtcgggatcagatctcttatccagcagataccgggtgcccactgagagcaggcagctatgcagaggcctgtggacagaaagtgagtgagacctaggcagcctttccttcttggactgaggaatagatcctccagtttagttctggttccatggctgtataattttaagaccttcaaagagatgagtcaaaaatctgctacccactcgcaactccgggggctgccagggacattcttgatgccagctggggtggcgtgtcccatacctgctgccacattagtaccctctgctgcctgcaccgggagtccccatcctgcctggtgctgtgctctgggctccgtgcaggtgactcctctcctgctatggagtctggggtgcaggcggccctcccagctcaggggtgaggacctggaggctcggaggttggggagtggtaggacttggatttgaactccgatgtccgtggcggtggggacaccgcctgccctggcctgtcttttagagggagccatgtgggtcagctggggagacaatgaagaatgtgcccccacaaacaaatggacctttgttcccacagtggcttcagggctgggctgggcccagcagatgatctccggccccctggaagctgggccactgctccctcatctatggatttttccagtgcctgttatgggcaggaaagaagtgttgggccctgaggggcagagaggggagaagggagatggggctgagctctgtgtgccaggggacttaacggtgttgggggctaatgcaggtgccaggatgaccccgtgctgggcgggcccgggtgctcccagggggctgggcctggccctgtacagtgcctctttatgtgtcaccaccctcacctggtaaccactgctgcgtccctgtgccattcaggaacagggaacttttaggtaaccttgaggagggcggaaacccagggcaggcgagtgaagtggcaattgagaaagagtcacgaccaccctctgcaggagtttagatgaacatggcaggtgagagattggtccatgagtgagctggggtgcttgtctcctttctgcagaagcacgatggtggcctggggctggctggcttcggggttctccaagtgagtgtcgggaacccctgcactcctccgctggggagggggaggtggtgagttcttgttggaaactcagtacggagctttcatacgctgcgggggaacctgggaattggatgccatttttctttatttttgaacttgttcctcaggttgagaatcgttggtcttaagggattcaggaggctttcctggtcccattcccagcaaccccccagtgggttaaatcctctttctcctttctcagaggacccagaggaactgcagccccccggggccatttccactgcccccactagcttgtgagttgtcacccactcgtccctgcggggacaaaggggacctggcatacaataggtgcctaatgaatgtttctcagatgaaattgaactgccttaagtatcaggggtaagaagtagcagaggtggaatccgatcaccagcgggtgtggatggcgtgggggtggctgcctcgtaccacttcacggggggtcactcacagatggagcagcctacattctctgggccttcagcacctctaggaggtaggaagggccaggctgttcctgttttaaagattcaagctggggaggaggtgacttgcccccacagggtgcctaagtggtgatctgtcccatcccttcttctcaagcgtgagtttgtgaacgctgaccttcctctctgctgccacacggcagtgatctgtatgggtcgcatttctgccagcttctagaagcaggttcaacagcatttagagtgttctgtgttccacttcactgcctcatttaatctttggaaaatcaatgcagcgtgctgagctgaggtggcctcgtgaggcctgagtgtgcgccgcttgcgggcgggtcaagtgctgagaagcctggggccccgcggaggctgattgtctgggggacctgcctctgtgctgcctgcccgtgtgactctgggatactgacttcacttcctcagccagctgggtcacatggctctggcagggctcctgtgagggtgaggacatggagggacatggttcagcactgccttgacacctggcaggtctcagcagcctgatggccttgcctcctgctccccaactgccctgtgggagcagagcccagagtggggcacttcaaaggggaggtcactgctctcagatgtggaaattgctcaagggagatgagtgactggggtcctcgggaacttctggttgaccttgaggagggcggaagcccagggtaggcatggggtgaagggtgagtggaagtgacaattgagaaagagtcacgaccaccctctgcaggagtttagatgaacatggcaggtgacagattggtccatgagtgagctggggtgcttggaaccaaggcagggtgccttttttttttgttttccagaggaagaaaggtgagcaggtcttcagctgttaggaaggtttggtgcggagaggtgcagggatgactgggagtaagctggctgggggtcactggccgagctggagagttggccttgacccaaagaaccatctggctcaacaagaaggaagggcaggagggaggatgggcatggtatcattcagaatcttttggtcaactcaacatggcttacatgggattggaagttggtgggccgtgtaactgaaaatcccaggtggtggatgccatccccaaaccgtctttcactcttttccatccctgggctggccatactttcaggcaggcccttgcctcacggtgacaatgtggctgctacagatccagccctcccaaccttgctccatcaagtccgatccagttccccaattactagaaataagtgcagctggctttagttggcctgagccaacccatgtgttctttcctgatccagtccttgcaactgggaggtggagtgcatgaattggccttgacttgtgaaacgtggggaggggggtcactgtcaacagaacacttaggactgagggtgagggttgggtgggttcctgaaggaaactgagggctgttcttggaagtggggagtgaattctgtgtagccccaagccagcagatgttagtcacaggtacagtaacctgtggggccagtggggcctgagggcaaggaagcaaggaagcgcaggcttgatggcctgttttccagatggagcaaacagtccggggcagagatggtggcgggcaagccctttccccagcatttggtgcatttaacagcgcagtctgagccaggcctctgtcccctgcctcctgggagtcccctcctagccctggtccttggagtggcttctggccagagagagctgctgcccgaagccggggctcttatggccagatgagaagagagcttcctcaaaacacagttggaaacaggctggctgtcttcagccacgcggatgccatgaaccccacatgaccagcccactgtctgctgtgtctcctcaggagcaggacatcgagactttacatggctctgttcacgtcacgctgtgtgggactcccaagggaaaccggcctgtcatcctcacctaccatgacatcggcatgaaccgtaagttctgaggagctctgattccctgtcagccggttcccaagagagtggcggaaaaaggcagccgagaagggctgatggccgggagctggtggtttctttttgcctgggacttcctggggctgttctgggaagaactcttgccacagcctggaaaagccagaaatgcgctgcatgtgggcacggagttgtctgtgtgcccggaggcgctgggaacacaggaagctgtttgctatctgtggcagtgacttctatattaatgcacgcatatggttttcagtcttttcacagaattgtgcaacgatcagcacaattttggaacattttcatccttccaaaaaatcctgtaccttttatctgtcaccccaccctcagatgactgacccttcattgactttccttttctgtgaatttgcctgttctggaattttgtatacattgaatcaaataatatgtgatttttttttggtaactggcttctttcttagtgctttcaaggtttatccaggccatgcattaatatttgtatttcctttattcctttattgaataataatattccattgtatggatttaccacactttattcgttcttttttctttttctttctttctttttttttttttttctgagacagaatctcgctctgttgcccaggctggagtgcagtggtgcgatcgtggctcactgcaatctccacctactgggttcaagcaattcttttgcctcagcctcccaagtacctgggattacgggcacccaccaccacgcctgactaatttttgtatttttagtagagacggggtttcactgtgttggccaggctgacctcgaactcctgacctcaggtgatccacccacctccacctcccaaagtgctgggattacaggcatgagccattgggcccggccatctattcttcagttgatgggcatttggggcattttcactttttggctgtgtgagtaactctgctacgaatgtttagactgtgaattccaagattaccaggagggttttcttaggtgggttccccatttttcatagatgagaatggaatggaagctactgaatgttgaaatttcatggaatagaggtgaattcttctgtgaggaatcagaagacacaggtttcactggtcccgtaatttttatgaacttgagtattgcaagcttgcttgatttttgacgatggactgcctgattttcatttgtttctataaagcttattaataccttattaataccttgaggctggggatggtgtcactgaaatccactgaaaacactttttcacttcattctcaccttcttttatctcacttcttcccctgtctgtttcccttatatccattttgtaccaggtccatgctaggtattttgatttacactatctcattttattgactctgacaaggaactggaattgcatatggcagcgtctctccccattcggagaggctcattgttggtttataataggcttaccactgtaacaaaagatgccaagccctctgtggcttaacacagtatatgttttatttctcgctcatgtaacagtttagtgggtgtttagtgggacatgttctatttggcaattcaaggacccaggctccttctagcttgtgggtttgccatcccctggggctgcagagccttctgctggaaactgtgcttctggcaggtagatgagagaagagagaaacttagaggatcttagagaatctgggtggcaggtatggtgaggaaatggtgacggtcacaggctatcggccagaaacagatcacatggctgcctctcattgcaagggagcttgggatataccgtctagctgagtgcccaggaggaaaagggacaggaggtagggtgagcagcccgacttccttaggcttcagcagtgaggagactcatccaggccacatgaaaggaggaggcacgcctcacctcccatgctcctcctcgtttgaaaattatgtgtgtcctggaccagtaccccagatgggagggtatagtggacccagatggaaagagaggatcaggagggcaaagccatctcatgccagggccatcctgaccctggctgactggaggagctacaggagccagcctgggaaccccttccagcaccaactgcaagactcatctgccagctaccactcccttgccccatgaaacttactcttgctttttatcagcagaggaaagtgggcatggggacaaaaccaaaaaacaaaaaacgccaacatctgtgttcttctaagttcacttcctacttctgaataggaatgaaacaaaatgaatgtgctttgccaccgagacacctaatttttttctcatcttacttttttctcttctctccctcactgctgttcttcagacaaaacctgctacaaccccctcttcaactacgaggacatgcaggagatcacccagcactttgccgtctgccacgtggacgcccctggccagcaggacggcgcagcctccttccccgcagggtgagaggcctcttgccctatgagctctacagggtggaaactgggtgtcggggaggggttcaggtgctttgctcttttaaatactttttaactgtggtaaaatataaaacgtatcatcttaagcactttttaaattgtgggaaaagatacataacataaaagttagcactttcactatttttaagtatatagttcagtggcattaaggacatgcagacattgttgtgcagccgtcaccaccatccatctccaggactttttcatcttcccaaactgaaacaacatacttatcagatactatctccccattcccccagccttcctgcaaggctggcgttacgataggtgtgctcagcctggacaggacttcagtggaggaggacttgacaccaccaaatagtgtgaagaaaaacctagaagtttggggagaaacagagagggagagaagtaacattgatggagcccttcctgtgggctaggcttcatcatttgtatctaacactgggcttaatccttacagctagctctgtgtggctgctgttgttagctccattttccagacaaacatattgaggcatggaggcattaactaccttgctgaaggttgcacagctgaggccgggcatggtggttcatgcctgtaatctcagcactttgggaggccaaggtgggcggaccaccgaggttgggagtttgagaccagcctggccaacatggtgaaaccctgtctccggccaacgtgatgaaaccctgtctccactaaaaatacaaaaatgagctgggcgtggtggcgggtggctataatccctgctactcgggaggcttaggccagataatcccttgaacctgggaggcagaggttacagtgagccaagatcgcaccactgcactccagcctgggtgacagagcaagactctgtctccaaaaaagaaaaaaaggttgcacagctgatgactggggagttggctttgatcctatctactgagacgtgtatcctctttggaacatcaggctgccttagttgagagtatttgcactgcctggcccttgtcagctcgtgatctgtatgggcatggcctttcaatttccccttgtgcaattatggtcaagcttgttggatcccccaatcagcatcatgtgggggtggcagacctcagagataacccctcttgtccctgcacctgacctgtgtttaaactagggcaggagcaggttcttgggcttaaagtcttccagaaggggccttcttggcatttataaatagatatccttttttattagtgttcagaattatccttaataattaacctttatcagagaggaagggaagggacagccaaccgtatggggccaggaccaaaaattaaaagtgtattaaaacagtgggacgtggttaattgttaaccagcagataaagccagaggtgtgtccgtaaatctttggttggaccagttgtgtgaaagacttgggggaaagcagagactcttagttccccctggtgaagttttacaaatattctgaggcctgagccccacccccaggaatttttattccgttggtctgggtattacagcgcattttccccctagtttactatgtggttttcgtgtgcatctggtgggacccactgtcagagtgggacctgacttgtttcttcctcctggagtagggcagaggagagtgtggggcttgggaggggtgagggagcatctcccaggccctttaagggtgagccccctgtattctgaagccgagacagcagagcagggtaggggatccctggctgggctcctcctggccccggtgtccaccacctacacaggagggaccttggaagtagaattctgctgcttcctcgcctcacaccagccctggggaacagggaagaaacagagggccctgcaattaagtggcttctccagtgtcacaccttaggagctgctggctccaaattgagccatggccatttcagaggagcttcatgtctttgccgcacttctgccctgcggcttctcagctcagtggctctgttgatgtggagccacaccatacgggctctttctggctcttcccagggcgtccgcatacactgcttccctgcccacacgctttactcatcaggttcccatgaccccttcagcgtcacttcttccaagaagccctccctgatcatctgagcacggcaggtctctgtttcgataggctttgttatgagtaacaccccctgtttctgttgactcgagggctggctcctgtcctggtttgcatctgctttgctcacagacccctgccattgcctcaccaagagcccggcatgtgtgaggatcaatcactgctttgcggatggaactcattcatgcctgttttaattccttctccctgacattggaattgtgaaatgccttctagtcagtttctgcaacaccctagacccaaaaccagacaaacacagtgaggacatgtttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtgtgctgcaggggtcttggaaggaggatgcgaagggactagacttgggggtgggggggtctgggtgcatggggcaggctgctgcatggtccccacccttcaagcgtgtccctgtttggattacccgtttctgtccgggcgctcactaatggcttctctgtgtcatccccaggtacatgtacccctccatggatcagctggctgaaatgcttcctggagtccttcaacagtttgggtaagagcgaaggatcagctccttctctgtctgcagagaagcctggtttctagcatcttcctgccccttggctttgatctggactgaccactaaaattaaggttgcaatttagagatgaggcaagaaattagctcgtcactctgtgaacactgttcttcacacagtctctgagctctagtctgtctcctctaacttcagttttcctcttgcgtgaatgttatattgcatgatggcagctgccccacccatttgctcttgcctcctgttcttccattcccttctctttcccatggaatgttctggaatggagttgcctgagtccttagcttttctctccacaccctcatttttccagtgttcctctctgtcttgagctcttcaaagaatgataacttcatggttcttgctcaatttgttttcattccaagttttagaatccaaaataaagcttaagagtgggaagaaatgatgccgtaacgggccttcccgtaaatgtcagacggtctctcagagcctgggtggcggccaggagggaagtgaggagaaggggcgcggctctccaaggtcgaggtctctgtccagtcctaaagcatggtgacctcagagctgtgcaggcagttacggcagcatgctcccgcattgcctagccaggcggtcaccctcaggaagttctaagtgggtccttggaggctcccgtcactctgtccttgtgtgacatgcatttgtatttttgcttccaggctgaaaagcattattggcatgggaacaggagcaggcgcctacatcctaactcgatttgctgtgagtgctttggcattttttgaaaatcgcattttaaataacattttaagatgaaggaagacattggaaaagcatcaaaaacccaaaagggaaaaagaaatgacccgtattctccacagttgtgtgtgtgtgtgtgtgtggtgcatgggtactcgtatatatatatactcacagccttttctcttcctccactcaaggatgatactggacacattcctttgtcatgggctttgtccgcttagccatctagtgaggacgctcctcactcactgagtactctgctatgacactgctttgtaacagctgtacaggtttttgtagtcagggcactcctgggtcataactgattctaaactagaatcagacacgggaagttttcatgacagttgtcattgttatttctctgggctcaggtcaagagccactgttcctttgtatcctcaccgagcaattgtgtaagaatgcaacaatactcattttgtacatccattggtattttgactacctattatttgctgggctttgctggaggttgggaatactgacatgattctacaacatccatcttacaaaaaaaagaaaggaatgctgacatgaatacaaaatggtctggccatataggctctcagcaaattaaaaatggtctcaactgtaccccaggtgtacatatctatatctgtatgtatctgcatcacataatgacattttggtcaatgacagactgcacatttgacagtggttccataagattataatggttcatttttactgtaccatttttatgtttagatttgcttagatacatcaatacttagcattgtgttgcaattccctgcagtattgggtagcgtcatatgctgtacaggtttgtacagcaaacctaggagcaaagggctgttctatacagccttggtgagttgtagactatactgtctaggtgtgtgtaagtatactctgagatcttcacacaatgacaaaatctcctaatgatgaattttctcagaaagtatccctgttattcagcgatgcataactctgtctctctctctgtgtgtgtgtgtgtgtgtgtgtgtgtgtgtgtgtatgcatgtgtttatcctggaagtaagtaatacagttgttactgccacaactagagagcatttgtgctgtgcgccttgtttgattgatgaggtcgatggtgtgttacacccatttgatagctggagaagctgagcctccgtgggttgaagtgacttgcccaaggcaggcctgcaaagcagcgggcttcctacttctcctgcacttcctctttctccttcccactctctctaggacccgataccgtgtctgctgtgctggaacctcagttttgcatggggtggggccggggagcagcagcctgctctgctgcccacactgcctttttctgggtacttctctcaagctttggtttgccttggaaagttcctagtgtttcagattgctgggatgtctgtctcactttgtgtcttgaattgcagctaaacaaccctgagatggtggagggccttgtccttatcaacgtgaacccttgtgcggaaggctggatggactgggccgcctccaaggtgaggtgggggcctgtcaggccggcgggatccctgcaagaagagggacaggtgcacacagcctctgcctgggggatccctggagctacgagctctctctttacccactcctccactaccctctactgcccactccagttccctctgctttacttagaacagtacacatgacctcagccgtttgccattcagaagacttaaataccaccaagctgtctaagccagggaaagcactgggacacaggtccctgaggcagcttggagaagcattgcttggattaatgagtattagctgggtacataacttgtgccaggctttggtcaagatgctgagcatcttgaagaacaagacttcttgagatgaacaagacaaaagcctctaggaatgaatcttaggaatccattcacatattattaaagaaaaataaatatgtatttagtacggactgtgccacagaattttacgataataattagctaacgtagattgagagtttaccatgtgctagtttcattctacgttgctgtgtgtgcatgatctcagttaatcttcatagtaactctaggaggtgagaatttttatcaccgtttcagaggtaaggactcggtgtggctaaggggattgtccagggtcacataaagctaggcagtagaacggggactggatgcagcttgctttgactttgtggttcgtggacctgaccacccgtgcccctggggctcctgtccagggtgggagacaggcaggcctggcaagcagggtaggctgcctggaggagaagggacctgtgctgtcttgggaagctctgtcctggctggtgtcctaaggttccttgtttatcttttaaaaattatcattgtggtgtttttgtttttgtttttttccctgtaaaggcctcagtgttggccaaggagagggggaggtcattccagttgaaataggacagagtctttcaagctgaggtgatcgcagcttctcattctgcaagtgcatttttgcccaattttgggtggctgccagggaccgatggtttgaaggggccctgcctcttgccccatcccctgccctgtaccagccactgtgattttgcatttgttctttgaacattcctccagaatgcaggagcccttccgtccagcctgtatgacgttctggagtggaacacactccctgttttttatttgattttccagcaaaggaagtgacattccagtcaacccgctgggcttcatgatagctgtcctgagtgagactcgaaggtctggggatgtcgaccactggctaatgtgaagcctgaggattgtctttaatagctgtactattcccttcagtacagctttaatagctgtactattcccttctttttcaactccagcctttcgattaccaggcattggtattagatactgtgatgtgtgcagttacttcttgcagtccttcccttgaccttgtggccttgaagttcctggcactcccagttccagattagaagtctgagacccagaggtatgcagactgcccagtgccacacagctaggctgtggcaggcaagggccagccaaagacccttaggtctagagcttctctcctactcatttttgcctaatgcttaggtcagcacacatttatggagcttctgctgtatactaggacttatagagctcctgctgcaaacctagtcactggggagaggtaggaaaagaagattgtcagtgtctttggtaatatcagtatacttagaaaggggaaactggcttggagatgagagaggagggatagttgggagccaagcatatcttggggtatagactggggagctcagtgtgtttttagaagaggtgaatggatggccctctttgctgaggacttggtgaatgtttggagcagggtaagctagcagtagctgggtctttattcagcacttatttgctgtgcatcttgtgcatgggcctctgaaaataaggaactggatatagtcccaggccctgcatttgggggatcaggtccaggagggaactggagacaggaactgagtttctatcaagggggatgtccttgaggcctgcatgtaggggggagtccagcaatgccaccctgcacccagggaagtggggttttgctgaccttgttaactactgttagctcctggtttctcatccacccactttactcctttccagatctcaggatggacccaagctctgccggacatggtggtgtcccacctttttgggaaggtgagttgcgtggtctggcaaatctgttgttcctgctgagcaaggcattgtgtggtgctcagcacagggccccatgtgggggtggagagaacaagacacaatcaactgggggccaccgagctggtgctcatgagataatgtgacattattcattcataagcaacaagtcattcattctctctcttttttatgtgtcttttaaaaacagctgattgaagtacaattaactgcacatatttaaagtgtacaattgacatgcatatacatttgtaaaaccatccctgtaatcaggagaataacgtctccatcactccaagagtttccttgtgccccttgatagtcctcctctccctcctcctcaggcaacttctgatcagcattggcctctatagattgctttgcaattcctagaattttatataaatggcattatatagtaggtactctttttttttttattttggtctggcttctttccctcagcataaccattttgagatttgtccatgttaatgagtggatcaatagtttattcctagtcggggtgcagtgctcattcctataatcccagcactttgggaggccatggcaggaggattgcttgagcccaggagttcaagaccagcctgggcaacatagtgacaccttgtctctacagaaaaattaaaaattggccaggcatggtggttctgcatgcctatagtcctagctacttgggaggctgaggcaggaggattgcttgagcccaggagtttgaggctacagtgagcagtgagctgggatagcccactgtattccgcctaggtgacagagagaccctgtctcttaaaaaaaagtttattcctttttagtgctgagaagtattccattttatgtatgtgcaacagtttgtttttccattcacctgttgataagacctttgagttgttcccagttctgggctgttataaatctggtcagtagcaaacatgtccgtggagttagctgtgtgctgggctgggctcagtcctaagagcttcacaagtgttaactataggaataggattccacccaggtgctctgtgacctgtgtgataaattctgttctcattcccagtttatggaagaggaaacagaccagagaggttgagtgacttgcatagggtctcaaccagggagaggtggggccggtattagaacctatgaatctggcttcattctggtcaccacagcaggatggcggctgcctgtgctgctgcctggctctgagatgagctgctcttctgcagagttaccccactaaaggggattgagccaagcccctcacagcatgctagaagtgagcagtcatcttatcagcccagcctgcctggccccagacactggttttgtgtctctagctggggccagctaccctcgggaagggtatgccatgggcttggttgcaagcccagggtctggaaaaccccttggttgcctgaaattgcagtgacctgctttgcttacataccactgtctgcttctgagctaacatgtgtgaccatctgacactcccatgagtcctggggacacagcctccactctggagctggcgagtacaccaggggaacagacgccccactctggagttgacgagtgtaccaggggaatagaggccccactctggagttgacgagtgtacgagggcaatagaggccccactctggagttggcgagtgtacgaggggaatagagtccccactctggagttggcgagtgtacgaggggaatagagcctccactctggagctggtgagtgtacgagggaaacagaggccccactctggagctggcgagtgtacgaggggaatagaggccccactctggagttggcaagtgtaccaggggaacagaggccccactctggagttggcgagtgtacgagggaaacagaggccccactccggagttggcgagtgtacgagggaaacagaggccccactccggagttggcgagtgtaccaggggaacagagaccccactctggagttggcgagtgtaccaggggaacagaggctccactctggagttggcgagtacaactgctaggtttgcctgttgtgttggtttcctgtggcttctgtaacaaattaccacaaacaggatggcttagaacagcgaaagtgggatgagcagggtggctcacacctataatcccagcactttgggaggcttaggcgagtggatcacctgaggtcaggagttcgagacgagcctggccaacatggtgaaaccccgtctctactgaaaatacaaaattaaccggatgtggtggcacgcgcctgtaatcccagctactcgggaggctgagacaggagaatcacttgaacctgggaggcagaggctgcagtgagccgagatcgcgccatgcactgcagcctgggtgagacagagggagactctgtctcaaaaacagagaaaaaggaaaacaaaagtgtattctctcacagctctgagtctagaactccgatgtcaagcgctggcagggccgcccctccgccacaggctccaggggaaattcgtccttgcttcttactgctccaggtcgctgtcggcattccttggctagtggctgctcacaccactctctgcctctgtcttcacatggtcttctcctctgtgtctgttttatttctccctctccttcctcttttaaggatactttccattggatttcatcccggctcatgtaatccaggattatctcatctcaagatccttaattaattacacctgcaaaaaccctttttcccagcaagtttgcattcccaagttcaagagatttgacatggacatatcttttgagggccacagtttagcccactagagtcctctttccccttttacgattcattccacagcgtgtgacacattttccctgtcctgagtgtgtaatctgaaactgataggaattgggaaaaattcacagccactgtctctgtttcactggaggagggatgtcagacatagcgttgagcatctgatctgattataccccaagttatttggagactggttggtccggccatggtgtctgagggtacccccagatcgctatagttggttttgatctgaaatcccagcgtgattcctgactattttttccagagtttgctcttagtagccagttgacctccttgctgcctaaatgatcctggactgtttgatgcagctcaagcttgacaccggctttctttgacccccaactccaacttctcatctggttgccactggtcatatcagacccttgtgtgaaacctacagtgtctgccctcgtacaaatgagaaacagagcaaacaagttgtttgtcgcaaataacattcaaaaagcacccagagacggggaggctgaggccgacttccccaaggctctggttggccgtggtgggagttgcaattgcccttcttttcagtaacttcctgtggcatgagttgattttgcttttcaagcatgaaaaacttcttttcagctcttcccattggaaaacaattactaacatttgcctccaatttttactgttagtagaggtgagaacacaacctccattaagtcctacaacctagtgaagtaggcaacattctctctcttcccttttttttttttttttttttaagagatctgaggctcagagaggttgaaagatttgcctacgaaagggacagtgatgaagctaagctctagatccaggatgtctgacttcaaattgaaactcccaaagtaatgagtttggaagggtggggtgtggcctttccaggatgggggtcttttctgctcccagcggatagtgaaacccctgtctgcacctggttgggcgtgttgctttcccaaaggttttttttttaggtccgtcgctgtcttgtggattaggcattattatctttactttgtctccaaataacctggagaatggagagagtagtgaccagctcagggccacagtgcgatgaggaccatcttctcacctctctaaatgcaggaagaaatgcagagtaacgtggaagtggtccacacctaccgccagcacattgtgaatgacatgaaccccggcaacctgcacctgttcatcaatgcctacaacaggtattgggatgtagttcagccacatcattgctatttatgaggtgtcttctgtagatccgaaatgtgggacagatgagagggagagtataaaatgagcggaagaggcaggctctgagtttgagcaaatagattaataggacaggtgtccccaggaaggacacctggcctgtaagctggttcctggcattcagctcgccttgcagggatctgaacaaacactccagaccactgggggtgcagacgtgagagggacgcagtcgcacactcagagggttgagagtaaatatgtgtgcccgctgctgaccttcacgaaaggccaaatgtaagaagagctaagtgagagagcagcaaagcactcctggaggccggggataatccaggcaggcttctgggagtttgtcattccaaggataaggaggacctgaacatggcctttgcctaaggcgtggccctctcaaccagcactaggtgcttatctggagctcagctaggggaggagacagctcagggccattggtgtcagccagagactctgtaatcttccagggagctcgctcaacctgctgagctcgctctgccacgctcgcagaacaggagatagaaatgagcctcatagtgtttatctctgctcaaatgttaataaagtgacttcttgaaattaacatttgtaacagagcttagtatctgcctccttttacaatcctgccctcatctcagtggtaacatcctcactgtggatgtgactgaagaaaccgaaacctggcagtgcggttcacttagtaaacactttctgagaactggagcgagtcaggcattcggctgggcgctggagacacagaggaaaccagcacagcccgcagactccacactgttaacttgcccgtgtagatagcaccgtaattaactgacccctctccaaatcccactgtgaaggtcctggaattactgtcatttcctgttgaggaagcaaaggcgcaaagagatcctgtgttctccccaaggccacacagctagaaagtggcagagcatgatttggatcctgcttgtctaactccaggctgtgagctgggaaagagcttctcatgttgggagctgcaagatagcagagagggtgggtggctgcgtgcaggaaaggtggtcggcactgggctggacccacactgggcctcacacgagtgcagtgggaaaccaccacagggtttgagacagggaatggaaagatgaggcctgagttttaaagagatcatttgggtgctttatagaggactcagagttggtgaggctgggacttaaactaagaggctgcgagagcatttgggaggtggcccctctgtcaggtgggggctctgactagggggacagggaaggcggggaccctctatggtggagaatctgacttctactcctggaaaaaaaagccccacaaatatttgtgacaaaatgagggggctctgcttgaaatgcatgtgttgtgctgtccctctaaccaggtctgtggacaccaagagggtgtggagtcctgaaagccacagggcctctctcaagttggggatgtgggtagcttaccagaatggccactggcaggacctcctgggcttggctggatgggagtgggagatttctccaggggaggggtcctcatgctaatgatgcatttgtttcctgcagccggcgcgacctggagattgagcgaccaatgccgggaacccacacagtcaccctgcagtgagtggcttttctctcccccagcacttgcagtcggggctgcccactataaaggtggccttgctggcagggccttctttctgagtgtggcaggacattgtgtcagtgagacctggatatattccacccagagactgagcattacccagcctgacttggacttctccctgtgccggtggcatccgtttctagggtgtccccatgacctaggcctttgatcttggagaaggatggttgattgtacttgggacagcatttattaagcacctactacatcaataactgtgtgaggctttgctccatgaagcctagggatggatagcacaggacccagccttaaagtgctccatacacctaggaggaaaagacagtcatggacagaactaactgggtttccaccagtaatgatggtgtctttttgtggctgagtgcaccgcgttgtgtgacacttgggaacctggcacgtcattgcctttgtccttcatgctgttcttgtttcggtcttgattgccagctaagtcctgcttaaccatccttgaggagaagatgctttaaaacaaaagcactgagtcacagaaattccctggctgaaattcatactaagttgtgaatgactagtaaccaatgttatcctaagatcaaaggagaatgaagtaaaagagcaaagggtgttggggaaaccaaaatgacattgtttgtagaatgcaggccccagcctggcaggcctgggagtgggacaatctttaaaggaaccttgtgctaattctctgctctatccctgaccccaggtgccctgctctgttggtggttggggacagctcgcctgcagtggatgccgtggtatgtagaaatcacagctgatttctgtgtttaattcaacaggcaaagtctggttgactttgttgaagtggccctgcctgcccctcctctcctctgccccatcagggcaggtgatgttttttgaaatgccatattggcctttgggcagagggcccagccactcagtctctttccctggtggctgccagccctggttgcttggcagtgtctcctctcccaggtcccctcacccgccagtctgtgtcccatcggcttgtttatatgggcatgtttgccacttggcttcctggccaagagactcacctcttatttgggaagcagctggatctttccaaactgactggtgcctgatgagctggcaggggagagaggcactgggaggcagggcttagcaaagcttcctgactcctttcaccccttaactcccacctgcaactttgtggcagcaaagagaggaatctgcctttcaaacaaccccacagctggggagatggaagacttaggggctatggatcagagtcctgcagtactgccatgctttgtgcagtgatctgcagagtgacatttgcaaatgttcatgtagtaaatacctggcatgccttagtgaaccatgagtttcttacgggctgactgactggagataatcatgggatacatcaatagagatacactgttcaaatcaagggaggtgatagttttactttaagcattttgaacatcctgggttacatatgggtattctgcccaattccagatgcccctttcaagaggttcactgacaaaatgaagagagaaaccagtgtgattttacatgaagaatagttgttagatctgggaatattaaacctgtagaatctctggcagctgctggttaaacaaggatatttatttagcaggtatttctacagtactgtttacatttcggctaatcttcataataaccttttgaaaaaagatattagctccattttattgatgaggaaactgaggcccaaagaagttaaatcacttatccaagttgtcacagctggtaatggcaaggctgggatttcaagccacatctgctgaatcccaataactccacatactttcttctttgccagcagaaatactggagtttctggtgacggtggcagagtggcggagaagggggagatgttttggctttggcttcacgtagaaaattaacagatttcctccctcttgtgcaggtggagtgcaactcaaaattggacccaacaaagaccactctcctcaaggtacagggaaaacagtgggggttcgtgtttgttatttcttagaaactctcagacgttttctgcaacattgagttaggcttgaaaaaggcaaggcacacgatcagaaactatagaattaatgatttaatctatctgtttatgaacatatattgggtgctgactggtgatctgaggctgcaaagatgagggatccttctctgggactgcaggaatcaataggctgctggtctgggggctttggggatagagggaccagggatggcttggcaagggccctccataggctggggccaggacattcctccaagaggggctctctgcttgtcacaataagaagagacgtgtcccacagccggggaaggtcaggactttgtccagcaagttcatctgagcacatggtgagccagctcactcgcagctggatttgagggtctgtagcaacctccgccagtcctttgccagttatgactgattgcacaatgcaaaccactggctgtttgtggcggcctcgtccggagatgcagcccaagagtgggaacctttcagaggggcctctcagccggggtgcacccctgcaggggcagatgaccaggcgggacctgggtggagatgaggcggctccctcgcactgggggaaggacaaagaggtggcatctgtaggtcaccgtgccctcaacttcccccatagaagtagaatgcctttgaaaggcatgtagggggtgtccgatacttattgagtgggaggctgttttcctgtattgggctctttacatagattttctttcaagattccctcaaaaggaaattgcaagattagaagctgctgggcgtcaagcttgcataatgccgtactttgagggcggttgtcacaagtatcacaaaatgggtggcttaaagcaacagatatttattcccttttagttctggaagctaaaagtccgaaatcaaggtgtgggcagggccgtgctccctctgaaggtgctaggggagaatgctgcctgcctcttccagcttctggtggctgctggccacacttggttcaccttagctagtagacacatcactccagtctctgcctccatcctcactcagcactctcccgattgtatctctgcgtctatgtccaaatttccttcttcttttaataacatcagccgttagatttagggcccgctctaatccaatatgacctcatcttaacttgattttacctgcaaagaccctatttccaagtatagccacagtgataggtactggggttaggacttcagtatgtctattttggggacacaattcaaccacaacctacagcaaagggtaggtggcctgactgaggtggggtggccgatttgatggtagatccagaaacagaactcacttaggcctgattctggagacttccacagcgccagtctaatgtgctgagtgccccgcctggaggaaaaattcgggcatcctgctccctgcgtgctggttgagctgagggctgccccaggtcagtgtcgctttgtggctagtgttgggggtccagacttgaggcgccctgggctgtaggatgcccacagcctcaccactcccatgaactcctccagccccgtttcaccccaggccaccctccccgcagcctccccctgctcccttgccgtcagcgctgcccatttccaggctggctgcacagtctcacagcctgcaatggcctcttgcggttcggtgatttcacagggactttgaacgtccaccatttaggaagggtactggtcagctgaatccggcctgaagacccaaattcaaccacttccttttgagggaaactttcaagggaatatatgaagagggtcttgtttatcaaaccctttcgggtcagagagatcctggcctggaaccttgcgagtccctcaagctcttcctggcccagtttctgcctgtaaaatgggacagctgtaccttccatggttcttggggaatggagtgaaattatctgtagggcctagcatagtgcctggcacgtagcaagctgcaagtgatggttgccacggagacaccagcagccttgcctggtggggctggagtgttccctacccacggtccaccctgttcctcctttgtaaggcaggacaaggcagggcagggcagcgggcggatgggcatcctttcggaaaaaattcatagagcgcagagggccttggctgtggtgtttggcactaacgagcttccctctctcctagatggcggactgtggcggcctcccgcagatctcccaggtgagtgccatgttggcttttgcattatacagctgtcgcttccccctgggtggagtgcatgtgcctctgtgacacctgttccctcattaccttgctgtgacatcggatgacagtttgtggactgttgggaaaaggtgctatataggaggactctgattccctaggaaccaacccctgtggagtaggtgatactgcggttcacagaggttgggggatttgccaagtagacacaccttggtcatcatgggtcagaatctgggtatgtctgccccaaagaccacgggcttctgctggagtgaagggccgcaaggagctccagcccagagcagagggacatggaggagattaagccaaattgtgtgtgtgtgcatgcatgtttctgtgtgtgcatgtgtacacgtctgtgtgtgtgcatgtgtacacatgtctgtgtgcatgtgtaaatgtgtgtgcacatgtacaaataaacacattgatcaacgtaatgtgtttgctacgtaactgatcccttcaatttcccctcctataaagaatctcaccaacctaacaagtaaacttttaatttgttgtcttataattttatatcctgacagttttgtgttccatcttaaaatgaaatagagttttttgtcatcttttttatccaaaacctgccctgcctcctttcttcctcctttttttctttctctacttaaaatgagaacagatgtaaccctggtcataattaaaagaattttcagagcttcagaggagtgcaacgagcacaggcttcgaggacaccagcacaggggggagcaattcctgtgtgacactgtcgtcctcatgccgttgcaggttgggtgtatgtttacacagggttttcccatccttgattaaattaggtccttgcaatagtcctcagaggtgggaagagcaagcattttatcccagtgtcacagaagaggaaactgaggccaaaagttgagagagattgcccatgattactggagctaaaattgggcccaagtgttctcattcccaagcctgtattcttggttctctccaccatctcgaacacaggcgtccctgttccctgcagccctgacctgcttctcttgtctctttcttccactgtcacacaaattccagagggcaatttgagcatagccgctcttttaaatgtcatttggctctttgtggaatcctggcaggagttagtggagagcagggaggggggtcagcccagcctctaccagtgccctctcactgcctcaggagaataggacccagggcactggatagaacagttgggattaactgaagaacagatacgccttgcacgtatgcccttgatatttgagcattcacctccaagtttacattaaatgaactgagagaactggtagaactggatgtggtctcagcattccatacgcatttcacttaaagtagcccagttagttgttaattaattggtttgtttacccatccaacgaaccatccaaccatcatccattcattcttcttcatatcctttcttccttttatttgtccttcttttgttcatatttctcttttttcttccttttgtccatcaattctttttttaatccatctttccttccttccttccttctcttcctttctttcttttttccttccttctttccatccatccttttctttccacccatccatctatccatcatcccttctttcagccagcctgctattgaggctgacagtgatttgcctcaagaacaagtgttttaggtttggagagccctgggttaatgtacaggacccaccacttacttgttctgggaccctgagtggatttacctgtccaaatctgttcagctatgaaatgtatctaaggtagcactgacctcgtgaggggttgtcaggagtaaatgaatgaacgcagcaaagccccttgcattgggagtggctcatgatgccgatgcagttatgttccacttgctgggttagacatgtccctttgtggatggtaatctcctcagaaacacacagaaatagctgtgatactctgccctgtattacaggtgaggaaactggctcagacaggtcatgtaacttgtccaagttccacagctgtggggtgaatttcccatcattgtcccatactcttacttttgtgttttgtcctgtcaacacgtgatggcttttgtcttgagccaaactctcaaatgaaggtgaccacaggcacagccccccatggcctcgggtgatctggctccccagcaactgactgcattttctctccttgtctctcgcagccggccaagctcgctgaggccttcaagtacttcgtgcagggcatgggatacagtgagtatggcattccccgtgtgcagtgggtcggggcatgtgtcggaattggaagtgctctgtcctgagccaggtttggatgagcaattctgtgtccccctggccagcttcagctttctgggaggaaacagttaggtgtgtggagggcatgtggcagcctggaggatctagcctctcatttatcagtgaggctcatttttcctcctttgttgaacagaagttgtttcacaccagggattttggggggtttagatgaggactgtccctttaagcaccaagacaatgaccaacagtgaaacaataacatttttaaaaattttgatcacaagttttaagagaccactagctacagtgatgatgaagatggtgtcgatgatgatgaaagattactaacacattattttatctcactgaaccatcacagtactcctttgacatattcttagcccatcttatcagtgatgaagctgaggcttcggggttgtaagcagggagcagagggcggatctgtggaaattctttgaagactgtgaagctctgtggaagtggctaacaaagttgcttacattcaaggtggagcatgccatagtcaagtcatgagctttgggaagtggaggatacattggaagcatcattcaggaactcactcgttcttattttgcagttatagtttgttagacacatacagccttttttccagaagtgctgtcccaggactaggacagaccctggcgagttgtaactcggctgaacagcagccacactcagtgctgtgggcctgtcagccatggtccggccctgacatgactagtggctcttctgaccctactgcttggaactataattcgtgtgtcctcccttactaggaagttattgaacttctgatcccttttatcatttccttaaactgtttgcccatgtatagtaagagtatgcttggtaagctgactgcagtcctagcattggccttagccatgattagctctagcaaggcgaggctggcaggtttgatttccatgcctcaggctcaggcaggatccacatccccaggtgccctcttccaacagaagctatctgctagtggggctcctgcctttctagcctgctttccccgacggaagttgcaggcaaaggttgtcattggagacagccatggagacagccgcggggcagtcctgctttaccctgcacggtgtgaattgtggctcccatttgtcttggtcccgccagggtttggatttctgctttgagagtgtgttctggagagaaaggaagtgaatgctagacctcatctttctccccaaatcggcttctattaccagaaagctgaagcctcctgcaggtcttggggggaaaataacaggaagagctatggtctcaaaggcatcagccaaagagaaggaaaggaaccggtcactggccttctgcacaccacggggtgctggcttgatgaaccctttgcacacctggcatcagtgctcactgtacgcttctcatcctgctcagtagacatcccagatttgtgggtgagaactaggggctcagagaaatatgtgagctgcggatgtggcattgaccccaattctttctgaattcaaaactagctctttaagacaattcagcaaggattaattctgtttgggagtgcctgacatcaaaagcccctccctgtgcctatcaaggagataacataagccctgcatgcttggtgtggatcaactgcccctgtttctgatgtctgactcagtgtggcctcctagccatgatgcttcagttgggtggagtactagtttcctaaagctgccgtaacaaatctccacaaactgggtggctgaaaacaatagaaatccattctctcaaagttcaggaggcctaaagtccaaaatcaaggtgtgggcagggccttgctccctccaacgctgctgtggaagaaccttccatgcctcttcctggcttctggtggccccagcaatccttggctttatgtggcttgtggctgcatcactccaatctcagcctctgtctttgcgtggacttctcccctgcatatccctgtgtgctgtttctataaggacatcacagtcattgggtttagggttccctctcaacccaggatgatttcatctcaagatccttaactaattacatatgcaaagaccctatttccaaataaggttcccttctgaagtttcaggtaggtgtgaatcttccgggacactgtcccacccggtacaggtgggcaggattgttcctcctcattccaccccatcagcacgtgctaccccatcagcatgtgccacttgcacgtgccatgtgcaagagcatttgaggtctcagagaagatcccaaagaatagacagcgcccttgttagcacctgggctgacaggcttctttgggagagatgacaacgaatagccatgccgggaacttgccgtgtggcccctctccctttccccacctgtgatgtgcagggccactgaccccaggtgtcctccctgctccagtgatcatggacagcatggggtcatgggcgtacacacaggtgctgataccaggggtcagtatttaacatacttgctttacagatgggaacagggaggctcagggggacactctcaaaattacacagcttttaacaggtggcagaattggggttcagacccagatctgggttcaagtcactcatggtgtgattgcggcagttccttcccgcatctgggccttgccatctctctctccgagtggacatggagaggacgggggcccagcagctggatggctgcagggatcaagtcttctctggggctggcacgtagaagagcatgtggctggtggacgggcatgcctggctcctcacctggcagtctcctgccctctaaccggctgtctcttgttcccctagtgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcggcttgtgtcttttttctgtccctgagagattgtgtgtgtgaaacattgcagtgcagggatggctgtttcactggggggttgcccgtccttgacacctaggggaccccagcccctcatctctggaattctttcctcggagcatcacgtccagcagaaatttaagtcagctcatatgttaattctaatttcccagtggccacattttcaaaagtggaaagaaacagatgaaattaattttaataatacatttcatttatctcaagacgtctaaaatattaccacttctataaaaactattgaccaggtattttgcattcttttttcattctaggaactctagtgtgtttcacactcgcaatgcattcagaccagctgcatttcaattgcccagtagcttgggcagcacaatgatgaggataaaaaactttccaacctataattcgaggaaaacagcttttttatttttaatatttatttttattttttgaaacgtagtctcactttgtcacccaggctcaagtgcagtggcacaatcttcgctaattgcaacctccgcctcccaggttcaagcagttctcgtgccttagcctgctgagtagctgggattacaggcatgcgccaccatgcccagataatttatttttatttttatttttagtagagatggggtttttgccatggccaggctggtctcgaactcctgacctcaagtgatccgtccacctaggcctcccagagtgctgggattacaggcatgagtcaccgtacccaggctacattttgtttggattacaaacaaatgtatgtggaaagatcattccttttctcatgcccagtgacaaccattgtaatgcttgttttctactctacattaaaaaaaagagattttagtgtaacctcttatttaaactaagattagtttaaaatatacagacagttgcaaacaatacagagagttgccatatagcctgtacttagtgacccctgtcactaatatctgacgttactgcatacttgtcacaaccgggagatcagttggacgttgctgttaactaagccctggaccatattgagaattcactggggttcccctaatgtcctctctctgtccaggatcccatctgggacaccccattacattttgtcatcatgtctcagcttcctctggtttgtaacagtttctcagattttattttatttatttatttatttatttatttttacttgagatggagtcttgctctgtcgcccaggctggagtgcagtggtgtgatctcggctcactgcaacctctgcctcccaggttcaagcaattctcctacctcaccctcccaagtaactgggattacaggcgcaggctgccacgcccagctaatttttttgtattttagtagagacgggttttcactgtgttgtccaggctggtctccaacttctgagctcaggtaatccacccgccttggcctcccaaagtgcttggattacaggtgtgagccaccgcgaccggccagattttcccttttcttcaacagcgttgagaagcactagtcagacattctgtcacaagtctccccactgaggtttgtaagtagtttttctcacagtacaacttggggctgtgggtttttcggggaaacccacagaggtgatttgtcctgcttctcacatcatatccaggccacacgctatcactgtggtttatcactgatgggattaatggtgatggcgtggctggggtagtgtttgccagatttctctatcgtcaggttaccctttccacttttccatattcattctttggaagtgtgaacccccaaaatttgagacaggtctctgttaatttagaaagtttattttgccaaggctgaggacaggcgcctgtgacagcctcaggaggtcctgacgacctgtgcccaaggtgatcggggcacagtttggttgtatacattttagggagacatgagaccgcaatccatacatgtaagaaccatacagc

SEQ ID NO: 12561 - DNA, 40465 bp, Human
  misc_feature (1)...(40465): n = A,T,C or G
caggagagagaaagccagctccctgaacctgggctacccaccctccaccttccgctcatctctccctcgccccccagctccccaggagtccctagcggcccacgctgatgttgcaggtcttgcagctggggtccttcttggcatcggcagtagacagactcatgagctggtgcccactgatctcccccagggtgcccagggacaggtcgacgggctcagtgtagatgatctccaggatgaggtcctgggcgtggcggaagaccagctccccatcctccacgctgcaggtcaggaacttgttgcaagcaatgtccaggaggggcaggcggtcgcggcagaagcggtcccccagggagcctttgggcgccagcaccaggatggcgtagtggtaggccgtgtacatgcagtagaagtccgcaaagtagaggttggtgctgggattgaagaggcgctgagctgggatctggaagcgccagcggccgtagggggagtcctgcgggggctggcccgtgttgaactccgtgttgcagctgaagaagaccccgtggagcataccgctggtgggggagccgtggctgccgctgttgtccttcaggtaaggctgcagcatgttcccgcagtgggtcctgcccaccccagggagacacaccaaagggaagagaagatgtggctggtgagccgggctgaggcttggctgctgcgtgtggtcgaggagggaggaagccagcccagctcccagccctcccccagccgcctccactagtcgcaaatagaacattccagaatgcaagagcagggagggccctggagagggattcaaccagcccactccttctcagagaagagatatgaagctgtcactccccagcttgaaaccctttgatggggtgtgtgtgaaaaacacggcggctcatgatctgatctctgtggtctccttgccactccccacctcctgccaccccatccacttacccaccccctgcacacacagtctcctgcctccgtgacccctatgcaggactcttccctctgctgcactgactgccctctccaccttcctccgtctggcttggcaaacttctaattagccttcaagcttcagtcaagcgtctgctcccctctaaaacctcccaggaacagcagacacctgcacttgacaaatttttggcttcctactatgtgcaggacacccaatcttctcactatgttgcccaggctggacttgaactcctggcctcaagtgatcctcctgcttcagcctcccaaagtgctaggattgcaggtgtgagccacttcacctggccaggacactgaactgtgctcaacaattacacgtactttttacatgaaatctttccatactgtctctctgactggattctgaggttctcaaaagagtgaactgtgcctttatctttacatcctggcaccaagtaaggtgcctggcacccatgagtgctctctatctctcccactctcgctgataaaggagcccaaactgggccactgacttgctttccaggctggagtgcagtggtgcaatcacagctcactgcaagctcgaactcctgggctcaagcaatccacacccggctaattctttaaattttttgcagaggctggggtctcactatgttgctcaggctagtcttgaactcttggggtcaagagatcccatctcggcctcccaacgtggtaggattacaggnnnnnnnnnnnnnnnnnnnnnnnnnnnnnnnnnnnnncaggcttgagccaccaagcaggccttgcttctttaatacaaaccccaaagactcccaaggtcctcactgccctgaggttaaaactgccctgactgtaaggataaagacagacagaggccgggcgtggtggctcatgcctgtaatcccaggaccttgggaggccgaggtgggcggatcacctgaggtcaggagtttgagaccagcctggccaacatggtgaaaccccacttcattaaaaatacaaaaattagccgggcatggtggcgcatacctgtggtcccagctactcaagaggctgaggcaggagaatcattttaacccagaaggcagaggttgtagtgagcagagatcgcgcccctgcactccagcctgggtgacagagaagacgccatctcaaaaaaaaaaaaaaaaaaaaaggcagagcagctgcttgccctggctgagcctcagaaggatgcggccttggagcacttgccagcaggcccggggatggtgggtactcctggtcctgcctcacattgcctggtcctggctgtcctcagtaacaagtgactccctggctcgaatgaacaagtgcttccctctgggcctcaggctcctcttctgtaggctgagggtgttggatcagatcaccaattttcaaacacttttggactgcagcaactctctttttatccccaaaagaaattatacgtggaagggtcacaggcaaataaaattgaggctactctgactggaggtcaggtgtggggcccaccaagcctcaacctctggtccccccaaccccatggcagcattctaaggggttcactgacatgtctccctggagggagcacccagtttgaaaaccgacgagctgggtgcttcctcgaaccctttgtgatcagaacactcattttgtgcactccctgccaccttccctttggccccagggcctgaatcggagagacctgtggtggtagacccctgtgaaaggaactgtcccagagtgggagcaaacccagacctcattctcccaggctcattagtacaacactcttgcagaaggccctgtccccagagcccttgatcttccctgagcccaatccccaaagtagcagtctcttcagagccagcctggtgacgtcaggacatgtcaaccctagaggagggactggcagccacgagggtgggggtgacctcagacagccaggacaggagcaggaagggctgggagggaggagaggcccagcgggtccagccgggagcccgcgcccatacctggcatgctggaagtactccttgtgatggttgcggtagaagacggagaagcggagcatgcggcctgcgatctgctcagctttctcctgaagctgagccaggtgctccttggcataatctgcaagatcccagatgcggtaggtgagccgagggccagctgaggagcacaaacacctcctgtccccaccccaccccacactgtgtgtgccggccaacctctgtccgccagagcagcaggggagactagacagtcgcagaaccttaaactcagatgggaacaggccagctggcctctgctggaaacacagagcgctgcatactgtctgtcgtcatcacctctgcaaccacattgccagaggctccgggctctccgggtcagaaaaaggcagagggctgcccagttatcctgccagggtcctcaggggctgtgatcccaggccatcctcatgtgaaaagaggacccctgggaaaaaggaagacttgagaggggagggcttgaggtccttttgggaaagtctctcaaatacagtagataggaggctgcccacaccacccccatggaagccagctgtaattacaggtgacggctcgtgagggtctagggagaactgagcccaggcaatgtttaggcagtcctgggtctggagcaatggctctcagcttgagcatctcaggagaaacagggaaggctggaaacaggatagcaacattgaaccctggggccccagcaaggctgctgctggcacatacagctccttggtacaaattagaagatgcccttccctctttgtggctgcatccctggccagggtgcttggtttggagagaggagtgtggactggattgcagccagatctccaatttgaattaaatgcccactgcacatggaggtctcaggggtaaaccaagaagctttccccaccaggagcaagaggcctccagagagtggggttctgcagcagagctaagaaaaaacaccactcaaccagcagcagtggttcacgcctgtgatcccagcactttgggatcacttgagcccaggagtttgagactagcctgaccaacatggaaaaactccatctctacaaaaaaatatcaaaaattagccaggaatggtggcatgtgcctgtagttccagctactcaggaggccaggaagctgaggagggaggatggcttgggctcgtggggaggaggttgctgaggctgcagtgagccatgatcatgccactgcattccaacctgggcaacagagcaagaccctgtctcaaaaaataaaaatgaaaaaggccagggatggtggcttatgcctgtaatcgcagcactttgggaggccaaggcaggcagatcacctgaggtcaggagttcaagatcagcctggccaacatggtgaaaccccatctctactaaaaatacaaaaaaaaaaaaaaaaaatagccaggcatggtggtgggcgtctgtaatcccagctactcaggaggctgaggcaggagaatcgcttgaacccgggaggcggagattgcagtgagccgagatcacgccactgcactccagccaggaggcgacaagagcgagattccatctcaaaaaaaaaaaaaaggcagaaggagaaaaaaaagaaaaagcaccactcaaaagacaacagcagctcaaggagacttggggcataaatcttggcaaaggatagagccagcagcctcagaggcccggggctgagaatgttccgtgtctcttctgtgtgacagagagatctggagcagctctcaccgtgaacaccaaaagaatgtaatcttgtgggggcagaccctgagtcgtgagggaccaagcacacataggcccactgtttgtttgtgatggagtctacaagttaagttctgctaagagagtttgcggggccattgaccaggggccattttcccaggctacgtgaaggctcagaacaagtgaaatgtgattgcctcaccaagtgcacattgacaaataattgattaagcaaaatgtggtctatccatacaatgaaatactatccagtttcaaaaaggaaggaaattttggtatattccagtcacaaaaagacaaatcctatacaattgtactgatatgagacacctagaggagtcatattcatagaaacagaaagtagaatggtagctagcagagggaaatggggggcggttatttaatgggtatagagttttggttttccaggaagaaaggttctggagactggctgtacaacaatgtgaatatacttaataccactgaactgtacacttcaaaatggtcgagacggcaaattttacgtcatgcacctttgaccacaaggtttaaaaagatgcctgtgatctggtaccaagcccgaaaagtaactccctttcttaatggaagtggtcttgccagcgtgattagtggggttcgcatttgcctccagtgagagaagagaaaggttgggctcctggaggcagggagggtgtcatgcccgtgcgtctcccctgtggcccaagcacgctgcctggtggacagaaggtgttcatcagtgtttgctggactacgaggaagacccgccttgaccacagcaaagcccgacgtgccaagcagcaggacaggggtgtgatagcagggcctcacccccagtgcagaactccaccgtctcgctccagccggacaccaggtactccccatcgctctgcttcactgccgtctgcacggccacactgtactccgtgcgggggctcaggaaccagtggcctctcaccgtcatgggcagcggcactgccttggccacgagcttggtggggacgtcctgagaaacagggtacaaacagagagccaggcgtcaaacaggggttcatgcccaatctgggcatcaccccagaatccccactccccagatggccctgtttctcctgagcaggaccaatcttgaggatccaatggctccataccctggccaccattttcctgggaaggccacccagacactccacagccttggcccctcctcgaacccccctgacaccccgttctcttgggaacggaggggaaaagccacaaagttgaggacggcaaggccttcattttttaaggagactttgagagctctgcacactgcagtgccgtctccacggcaacggcaaatgctgagaagccagggaggaagggaaaatatgccttattctttgggggggagggttaagggggtggtgttgaacattcacgtcaccgtggcaactggcctgccaaaagacacccagatcgggagagccggttccagagaaagagagcgggtgagtaacccacgccggtgccgtcggcctgggagccagctggccgcctcactccccctgcctctgccagcttgagaggatgggggtcttcctcccacccacccccacactggcttttaaccccaggaaaggacacacccacggaggactctctcccattccttttctaagtcaagcaaatggcaggccagcaggtgaggggcccgagagggagaactgaggccacagcaaaagggctccgccccgaccgaggcccgtgtggcccacccagccaacagcgaggctgtgccctgagccggggctttgtcgagacttgagacgtcatccccataggcgaagcctgcggccccaccctacccgggctctctgcccctgcctgaagtctcagttgtggcgctgataacaacgctccctctgtgctaggcgccgggccaagcaccacgcaaacatgactcactgcatcctctccacgaccccgtgaggcttggcattgttattccctctttaccagggaaggagctcaggctcagagaggtcaagtaactttcccaaaatgacacaggaagaagagtgtggattttaaccagcctctgactccaagccatcacttccaggtgttcccttatccggcctccttcaggaacagaagctggggaggggctcccaggacaccttctactcacccggtgcttgaacttgttggaattcttattctccttcttgttaaggtcaatgaagtaatgggtgaccctctccaggtcactgtcctccatggcccaggagatgcggaaggagtcgcaggtgatgttgttgatctcaatgctgtggggcgtggacagcagctccatgctcccgtcagggttgtctcctgtggggactgaggaggagggaaagggtcagtacatcccttgaccccggcgagctttctggaatgtcctcctcccaatatccctttcgaggcggaacctcaaggacccctggaatccacatgcctcgtgaaccagatgggaaagactgtacaggggaggctggagaaggatgatggagggtggaaaggggtgcctgcccggggggctctttgctctcctcggaggggtctgcagagcagacggcacctgacaggtggcagaggcagtgggaacgctgcaaagccgggcggggacagatttgcagcagatggagccgaggagggagggggccctcagccagcaggcgtgaaaagagaaaggggtgggggtggagaggacgggtgagaggcggaggaaacgcaggaagcacctgctgtggagcggaggtgcgaggcttggggcaggtgacagccaagagctcacaggtgccagggccctcggattcaggcctctctcctcactggggtcagcaagcgttgccgcggtacatggctggaaggacaagtgccacgttggtgcatgtggacacattcgtggtgggaggggtacgcggcacagccggcttcaagctctttttccacccataactttttttgatgatccctctttctctttcggccaatcttctcttgactcctttcaatcatgacttttaacattaacatctattaggggccggccatgtgctcataatttcacagacgtctcatgcaaccttggaagtaggcacacactatcattatctccattttacagatgaggcgactgaggttggggaggtactaacatgcccaaggccacgcagagagcaaatgatttgaactccggcacccaagctcttgatcactaagctaagatagtgtcccctcatgtgtgggggtggaggggcacatgtgtggcgtgtgtgcatgcatgggtgcccatggtgtttccacctggcatttttcctccttccatcgtttcctttcaagcaactgcattttctctcccctccctgtcttactcctttggttctccccttatgtctgctgctcgtccaggtatgagaggacctcatcacggtcactctcatgtgtgctttagctgggaagagctgactctggccatgactctggcctggctggcctagctccgggatggggaagagcaaagggaaggggagtgacagcgtctgggaggggaccgcagacgtgggtggggcattctccaggggcatttggtctcctgctttccaatcccttcctccagcccagctcctggcacccctcatttttctaaatgtcacctccttctcttctttctcccctctttttctcctccccttgcccaggagctagtggtgagggcatcttgtgcctgcaaaagcaggtacttttatttatagcttccagaggatccagcccacaccttcctgtcaattaagcttgctccagagcctggcacctctgtattaacctgtgagttgcctggatggcaagtacagggtgaaggctaaaggtgatggcccttacctgctccaggtgtcactcaagtcctgtttcatcttagcctcccaccccacagccaaatgccggtggctttgtgcatggggaatacctatggtaaataagcaggcggtgctaccaggcccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacgcacacacacacacgaacacagacacactcctacccaagaggccctgagcggcacccacccacacgctcggaggcagcccacactcgtcccatgagtaggcacctattcctgcctctccttggagtcctcctagaaataggggcagctgtgtttggcggtaggggtctccaggacctgggtgtctgcttgtccctccctccctacggttctgggaaagctgagatgacatccccccgctagcttgggagggtggcagtgagtgagctggggtggacagaggggtgggtgtgaacccaagttctctacacccagaagactggggaagggcagggtgtgagggacaggttgaggcaacacccgagaaacacccacactcctgtgtggatccaccccaagacaggcatgtacacacccacacacaggcaggcacgcacgcgcatacacacatgcgccaagagtgcccacccacccgcgtcccacacctccgcagatgtcctcactcccacacacccatctccacattcaggtgcctgctgccaccttccacattctaagaatgccccacagttttccctcttcaatctgtcacctccatgcacacccagacatgttcatgtccacaggctcacgcacacacacgtccacgcacaccgcctcacaagccatatgtggggaaaagaggatgccacaggcaccaacatgcatgtgtgccacctccacaagaaggcacgcaacccacacgcctgccggcacacacatgtgtgttcatacacacagcagcccccgcccgaagtctggtattctctctcgaatcatctccaggctcaaagacagactttgaaaatgtgtttgcctctggccacactctgccagccctgagccttcatgccaacaggtttgtgcgcctacgtggctctgcccacagacaatggtttctgccccttcttctctttacccactccatcctgctctgggtctcacctccccatatagaaagcccctgtctgcatacactcccacacacatgaaaagggacatggttacccctaaatatactgcctcatagtgtccccacccacgcacacccacaggctactcaaataagtcccccacacacatgtacctcacgtgtgccagaaagatatgtttctagacatgcctcacaccattcaaaacccacacatgagcatgactgcggacagacggacctatctgcgccagcaagcctccagccaactcgcgagcgtgcacacacacacgccgcgcacaccggtgccccttccccatgcccattcaaacagccaccctgccacagggaatgcttcccccaccctgctgtccctgttggcatcgctgactgcagcagaacggtcacggggtgactaactgtggtgccccagagactggattcagccattaaccactttgccaaaggcctggccggggggggagaggggacaaggtcgtcaggcctggcagtccaggtgggcaccctgggtggtggcaggaccctagagcccccagatcccggctactcaggatcaacagcagcaggttccagggaggaagggtactcacctggctccactgggctctgcagaggaaaagctcgcagggaggacagggagagacctctgcgtggatgagctccccggcaggggacagcagccggacgcctgggtcacgggcagtggcgtgcgcttgctcctctcccggctgccaaggaggctgcttccatgccccgcagccagctcctgtctggctgtgcagcgcgtcgctgctgcccctggtgagacgatgttcccagctgagcagcgcaagaagagaggcaagagcgaaatcaaagcagcgtggaggagagagaggcagagaagggagaaagaacgagagagccagaccgaatctgcctccaccaatgggatcagcggctgcgcagcgtcaggtgataataagcaggcttggtccctgctcgccgggctggtgggagggggaaagggcagagggtctcccagggagctacacagatgtcctcagggacagcaacacacgccgcctttcccccattcttccaggacaagctgccctcagaagtccctccaacacaccccctacttggaaatctctgacttgaatgcagcccccaaactttaggatgctgggagaggggtggagcttagccaagggcttgggccccaaagcaaagactctgattgggggaaggggagggaggctgtagaggggaaaggtccagatggggggtgtgaagctggggtggctgtcttcagtccggagcctctccttggggccttttggtgaactgtggttccattttcttaccaactctagagagagatggcagacctgcagctcagggatccctgtgggtctggcaagaaccctctggcagcttgggggtccacaggaaaaggggctgggagagaggctgtggcacagtgcagggtgcacaggggtaagaaaatgggggtgggagaacacaccaagctctgagtgtcctcagcccaccccactctctgagcacaaaggaagccggccctgggcatcttggggagagaatgtaattctgctctcacggcagcaggaggctgttctgccatcaagaagcagactccgtggaggccatcgggaagaacatccaaggaaatgtgagtccagcagcaagcagggacagagggttgcgcagtggtgaaaagcacaggctcacagtcagatggatgtgctgagaatccctgctctactgctacccagctgggggaccttggacaagccactcaacctctcttcatctgtcaagtgggatcacacaggtttattgtcatcatggaatgaaataattaggtaaatcgcccagccctgggcctggcacatcagaagtgccagtcacatgtcagaactgttcttgttcccatcatatcgacagcatcttcctgcaaggagcccacagtcctctacgggagagaagatggccatttagaggatgcaattagagaatgaggagcacacaactaaatcgtagggcacagatactcattcagagaaagaacaatgggcggctccagggcacgtgcagggtgcaggccagaggaggctgtggaagcaggagtgcggctggggtggggaggattggcacgggggcagctgacaccaggcaggcccagggtgaggtcttggtgagcaggagaaggtgtgagctgagcctaagaaacactcaccaagagggagttgaggcggcaggcctcagtgcaaaagtcagaggaggtaacagcagcagaaagtgagagttcacagaatgcaaagacaagcagaagccaaccctgcctgaaacggctgtgagaacctcagtgagcctggccaggtcctgaactgccgaatgtggggtggtgcgtggcactgaggcaggactaagcacccccttggccaagcatgactacgtcctgctccgacatacccacgccgagctggtgagctcagaagagatgcaaaacgtaacctcctggtgatggccagcacatgacatctggactacaattctgtcccaggccgggcgcagtggctcacaagaatccgaacactttgggagactgaggcaggcagatcacctgagatcaggagttcgagaccagcctagctaacatggcgaaaccccatctctactaaaaatataaaaattagctgggtgtggtggtgggcgcctgtaatcccagctacttgggaggctgaggcacaagaatcgcttgaacccgggaggtggaggttgcagtgagccaagattgcaccactgcactccagcctgagtgacagagtgagattgtgcctcgaaaaataaataaataaataaataataaaatcctgtccctaggaccacacagaggggcagtgcaaggaaaaaggcaggttctctgtgacttggtttccccttctgccaaaggaaaactagccccagcaccatccctgcctcccaccttctcgggatgtcatgaggagactgcacgaggtcctgtggcccaagcatgagcaatagccatctgagcgcccctttgtggagctgcgtgccggcgacaggtgaaggcacagccctttaggagcttctgcctcttcttgcctcagaggacttctctacagatcacgagaggaaacacgtggtaagagcaaaccatagtgtgccaagtataactcactccctatgaaaccaaacaaccgccaagatgcacttctgctgcatttttatttttcatnnnnnnnnnnnnnnnnnnnnnnnnnnnnnnnnnnnnnnnnnnnnnnnnnnnnnnnnnnnnnnnnnnnnnnnnnnnnnaactttttatgacacaagtagcacatgatcattgtagagagacgagcacatttcattttaaaatttaagagggaatttaaatctctcattttcccaccatgcagaaatacacattaaatacatataaagaatttttttaattaatttttttcgagacagggtcttgctctgtcacccccggctggagtgcagtggcgcaaacttggctcactgcaacctctgcctccctggcttaagtaatcctcccacctcagtcccctgaatagctgagagtataggcgcacaccaccacacctggctattttttttattttttgtagagatggggtctcactgtgttgcccaggctggtcccaaactcctaaatgcaagcaatccacccgccttggccttccaaagtagttgggattacacaggtgcgagccaccacacccagccaatacttgtatagaatttattaacaaaaatagaatgaaagaatgctgttttgtaacctgcttttttcacttaccaatatcttttctgttcatcatataaccttttttttttttttttttttttttttgagacagagtctcgctctgttgttctgtctcccagaacctgggaggtggaggttgcagtgagccaagatcacgccactgtactccagcctgggtgacagggtgagactccatctcaacaacaaatttttttttttttttttttttttttttgtagagacaggctctcactatgttggtcaggctgatctccaactcctggtctccagtgatcctcctgcctcggcctctcaaagtgctaggattacaggtgtgagccaccatgcccagctgatcaactccattttaaaaaggtggagggtgggaaagaggactcaggccataagtagtaaaactagttagtattcaaattcaggtctgtctgagtaccaaggccagattcctcgtggtagaaagatgcatagcaaatatagagtctgatgtaatagagaatgagactataagcaaaacatatttacagtcttaatattgcttatgcactttatagatttaaaatgtttatgtgtatttccctatggctgaactcagtgtggggatccggtgagccaatgaatgcacatacatcaggtagtccgtggaaaccacttttgtcctttacatgtgtttacaatgacaagagtgggccatgagtatttataagaactacatggatttctcagtgcttatttccttttcttttcgatattatgtttagacaacctataaccttcactggtcatctattttaatgaagagcattaacctaattctaaaaacatttactaaactaaagaaaaagtattttatggctgggtgcagtggctcatacctgtaatctcagctctttaggagtctgaagtgggcagatcacttgaacccaggagttcgagaccagtctgggcaacatggtgaaaccccgtcttcacaaagagtacaaaaattagctgggcatggtggcatgggcctatagtcccaactactctggaggctgaggcagcaggattgcttgagcctaggatttggaggctgcagtgaggcatgatcgcttcactgcactccagtctgggtgacaaagcgagaacctgtctcaaagatatatatattttagattttgtagaaaacttaaatatttaaccactttaagacatgggaaaatgctgaattatattaaaggactcagacaagctacagaagagacactgagagaatgttggagggataaaaggaacttcaagagaaaaagatcaagaacaatgatgaaagagaatcgtaagtagaaggactcatatagaacctcagtactggaatagtcagtaagttatacccaaagtggaagaacatgatgtaggaaatacggaacaccactgcgcactgcttggcaaggtaccaggacaaggccaggcgcggtagctcacgcctgtaatctcaggacttagggaggttgaggcagccgaatcgtctgaggtaggagttcgagaccagcctggccagcatggcaaaaccctgtgtctactaaaaatacaaaaagtagccaggcgtggtggcgcacgcctgtagtcacagctactcaggaggctgaggcaggagaatcacttgatcccgggaggtggaggttgcagtgagccaagatcgtgtccctgcactctagccttagcaacagagcaagactgccaaaaagaaaaaaaagaaaaagaaaaagaaagaaataccagaagagtgtgacatattgaatacaagcgatcaccatgatgaagcgccttccctccatgcacccaaaatttgccacactgactctattaagagtcactgacagaagaacctatagagaagacatgaaaatacaactcacagatggctttgacatcaatggtgccaaaattcaattaccttctggaaacaatctactcatttttctaatgcacatccagattttctagttgatctcatcacaaattggaattcaatcatccatttaaaaaaattcactgagtgcttatctatgtatcaggcactgtttcaggcaatgaggatcctgcagttgtaggcagggaaaggagaacaaacaaacaaacaaaaaatccctgctctcatagggcttacattctggtgggggaagacagataattaaataggtaagtgaataaataaacaaactttatagtctgttgggtggtgataaatgctctagagaaaaataagtcggtaagtagagataggaaacatcatggagaagtcgggagttatgattttaaatagggccatcagaggaggactttttgaaaaggtgactttggtacacaacaaaacaaaacaaaacaaaacaaaaaacacctgattaaaggatggacgggagccatgcagaattttgtggaggaagggcattccaggtaacaggtgcaggggccctgaagcaggatgttgcctgatatagtccagaaacagcagggggagccagtgtgcaaggagttgagactagagaaatggtgcagggagagattgtgcagggccgtggcgcagggcgttctaaggcctctgattttgactctgaaatgggaagccattgggaagtttagagcagagatgtgacctaacgtgaaacatgtcagttgcactatgtggagactagacttggaggattcaggtggaaggaggccaattaggagtcaattataataatcagcaataaatgatggtggcctggaccaaggtggtgagaagtgggaagatcccggatgtatgtcaaaaagctgatatgttagaagtagtgcatgggagagaggagtcaagagtcgcaaggctgggtgcagtggctcaagcctgtaatctcagcactttgggaggctgaggtgggcagatcacttgagactcaggagctcaagactagcctgggcaacatggtgaaactccaactctacaaaaaataaaaaaaattagccaggcatggtgcggcatgcctatagtcccagctacctgagaggctgaggtgggaggatcacttgagcccgggaggttgaggctgcagtgagccgagatcatgccactgcactccagcctgggtgacagaataagaaagatcctgtctcataaaaaaaaaaaaaaaacctgcaagatttttaatctgaacaactagtaggatgcagttaccatttactgagatggggaccactttggagaagtagtttgaggagcaagatcaaaaaagtgtggatatggccaggtgcagtggctcacaccagtaatcccaaaactttaggaggtcgaggcagatggatcacttgaggtcaggagttcgagaccagcctggccaacacggtgaaacccggtctctactaaaaatacaaaaattagctgggcgtggtggcaggtgcctgtaatcccagctactcaggaggcagaggcaggagaattgcttgaacctgggaggcggaggttgcagtgagcggaaatcacgtcactgcactccagcctgagcgacagggcaagaccctgtctcaaaaaaaaaaaaaaaaagtttggatgggcacataggtttcgagatgcccagcagacatccagctggaggtgtggaataggcagagacacatcaggaattcagggagcactggactggaggtgagcccttaggagtgatcagcatacagtatacttgaagctgagaaactgaaccattgtcatgggagttagtatagagaaaataggaaagaattccaaggacagaattctttttttttttttctgagatggagtcttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtctcagaaaaaaaaaaaagaaagaaaagaaaaaggacacgaaattgtgatacgacaactctgtgaagactactagatacattacaaaatttttaatagtagtactctacgtggcattctggtagaaatgatttcctttcctcaaactccccataatattgttacatggtttttatacggtctgggggatgggggataacattaaatgacaccttttatgttaaatcacaaacgctggagtcaacaaaagttctttaaattcctccagcagtagagcaaacttggtattccaattccctccaggctttgaccaagagcgcacacgagggccaccgccttcgtgatcagaagcgggtatgactgggcaccggttggtccactgcggctgttccaagctgcccccacagcctcaccccaggactccaccaggagcacagggaaggggtccccgaaagtgggcgaggtcgctgcccggaggtaatgaccactccaaggtcaccatggagaacccgcagacagggctcggtgtggcccaggactccccgactcttaagtccaggtctcactctctgcgccgcgccgcgcccctcgccccatcccgagcagctaccccgaagctcccaggggctccgccgaggcgaatcctcacattgcggcgtggtggccgacaaaacccgggaccctgatcttggcgcctccacgccaccgcccggaggccaagacccccgagcgccgcagcatagcgtagcccagaccagtcacctcatcctttttcgccctctcaacccagcttttcccgactccgggaagaaccgggaagagaaggcggaggggagcgaagcgccgcctgataaatactgtggcccagtcccgcccccctaacgtcacttccgccccgcgccaagatggcggcgcccaggccctgccacgcagacttccgcccggcgcggagaccgaaggctggcggctggtcgcgttgcaggtgaggttgtgacgcgcggtgtggagccgcggcccgggtgcgtccctgtctggttcctgggcggggttcctggagagggcgtgtcgcgagccaaaggctctcacctgggtggtcccgggagtctcgccacgtgggaggggaggagctgagaggccactggagggacgcaccgactgggggaccggaaagcaagggggtggggttccgccagggtccgcgtgtcagtcccctctggtgatctcgtcgccccttctctcccaggcaacatgtcggaaggaaacgccgccggcgagcccagcacgccggggagggccccgacctctccctgactgggggcccgggggctcatcgggccggcggccggcgcctcccctcacccccggccgccttccctccatccgttccagggacctcaccctcgggggagtcaagaaggtacccaacggcgcgtttctaaagaaactcaactaccttgaattccaagccccaggattcaactaatgtttgtgtaggacctactgtgtgtcaggactgtcgttgggcctctcaagcctacccctctttaaattctagggagtctgtcctaccttcaaatctaggtactgagtacaagatgttgaaatgactcccagaggtggttgaagggcagagaatcctaataagttaaagtcgttcaaaagcaatttgaacagtgtttatttacttttattgtgtgtttggacatctttaagaaacccatgaaagccagacaggcataaacttcgcagtcttagagggttcagaattcaccatctctgtgtgcaaactttttatctagagtatgatgaatcctaggtatggcattcgaggctctgtggcctctcccatgtgtatatgactgtggatgtcaagagtagcccagaaaggggtggggtcaggatgacagaagaacaaagcaggttttggttttggttttggttttttttgagaggaagtctcgccgttgtcccccaggctggagtgcaatggcacgatctcagctcactgcaacctctgcctcccaggtttgagcgattctcctgcctcatcctcctgagtagctgggattacaggcgcccgccaccatgcccagctgatttttgtatttttagtagacacagggttttgccatgttggccaggctgttcttgaacccctgacctcgtgatccgcccgcctgcctcgacctcccaaggtgctgggattacaggtgtgagccaccgctcctggccgaataaagcggttttttggttttttgttttgtttttaagggaatctctttctgtcgcccaggctggagtgcagaggcaccatctcagctcactgcaacctccgcctcccgggttcaagcgattctcctgcctcagcctcccgagtagctgggattacaggggcccgccaccgcgcccagctactttttgtagtttttagtagagacgggtttcaccatcttggccaggctgatcttgaactcctgacctcgtgatccacccaccttggcctcccaaagtgctgggattacaggcatgagccacaacgcccagccataaagcagtttttaaaaacctaactttgccttggaaaattgtggtgacagtccatagtcacctgattgaaagtgttggcagatctatggccttccctacttaggccttgctgctagagctgttcccccatgatactgactggtctctatagcagtttgaagagaagaggtgagaccagagaaattcctttgcttttagaagtcccagaggatcttctttcagaggcagaacctaaggctgctggttaaaagtgggttttggtgcccccttctatgtgtaactccactgctaccacactatgacattcctccttttcaggcacatgtgtatctataaaactgacagcactgtggaatgtgccaacgagagccgtggtggccttggtctgtagaagatgccctttgggaatttttattttcctctgtactttggggtcagaacctaacacatcagtgactcctgtattttgctttcagaaaaccttcaccccaaatatcatcagtcggaagatcaaggaagagtaagtagctaggccttctgaatacttgccccttatttacttgctctgaatttggggctttgggggaaataactaggtttgtagctccaaaatttaaatttatatctttagttcttttcactagtgattttcaaccctggctcctaggtgattctgcaagctttaaaaaataaataaataaataaataattactggtgtctagggttccatctttagaaattgtgatttaacttgctggcagtagaatggagtgattctctttgttgcccgagttgagagccaatagtttaaacaaagatgtatcacactttccctgaagttcctttgcatttctgccttcctgctttcagtcccaatgcaaacaaaaatctatatttttggacaagaaggtaaagtaaagcaaactgaaaaaatcctgcctcatcaaggaagtgagaaaagtgctagaattaggattggattctgcttctcatggtgtaaatattggctcaaactctccactgttttggagtgaagtggtatgggagagtaaggccagattttggagacacagtgagtgagtggtttcccttaatccattcttttttccaggcccaaggaagaagtaactgtcaagaaggagaagcgtgaaagggacagagaccgacaacgagaggggcatggacgagggcgaggccgtccagaagtgatccagtctcactccatctttgagcagggcccagctgaaatgatgaagaaaaaaggtataaggaaggaatcagtgaatttcagttcagactgccccagagaagggcgagaacagtggaatttccccactcccatttccgttttccttgctgttgggcatcttccttatcgatccctagtgacctgggtgatttcccacagggaactgggataagacagtggatgtgtcagacatgggaccttctcatatcatcaacatcaaaaaagagaagagagagacagacgaagaaactaaacagatcttgcgtatgctggagaaggacgatgtgggtaccaggaggctgggggaaggggtttccttgtggctgtagaacagggcttctggggagccaggtgaggggtagaagagcttactgatgtcctggaatcctggggagcagcggaatctttggttagaaagggactaaagcagactttgatccaggtgcatgtgctagcaggctggatgacccagactctctttggcagttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaaggtactctgtcggttaacttctcatctccaattccatggctgctccccaggaatcccgtgcatcaggcatcccttgcatgtgcccctgactgctgctcgtgagcaggtcctcccattccggctgtaagatacatgagctgaacaaagatgctccattctccctcgcagagggttcctgtgttgacagggagcagtgggcctagcctcagatgtccctttttagataagtcatgtgagacttgaacgtgttgtctcttgcccctctgtataactggtgcctccttcccactccctggctgagtgacagtggagcagacaggggcaaagggctggtaacagtgagctggtatggagggtggtcacttgatagcattccatgtctatcacccgggcagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagtacgctcagacagaggcctgcgggaatcaagtcggggactgggacgggaagtggtgacctgtagtgggaagcaaagccgtgtcaccctggctgaaatgggacaataatgggtggttattcttgacgcctgcaagagccatggggctttgtacctccaaccccaattgtgtatgtgttgtgggggtgtgtgttcacttcttataaggaaatatttcaaacacaaatgagagaacatatggccagatgcggtggctcatgcctctaatcccagcgctttgggaggctgagacaggaggatcacttgagcccaggagttcgagactagcctgggcaacgtggtgacaccatggctaatacaaaaattagccaggcatggtggcgtgtgcctgtagtccccgctacttgggaggctgaggtgggggaatggcttgagtccaggaggcagaggttgcagtaagcctagatcatgccactataccccaaccttggcgacagagtcagaccttgtctcaaaaaaataagagaacgtaaaccgccatgtaccagaactcagcttcagcagtaactgatattttgtccgtgtatgtatttgtttgctgtgggttttgtattttaaccatagcagacagccctaggagaaggcactctttggggagctcattttgacctttgctgtgcctttctcttggggagtagaagggggttcatgaaagatggaggaaagagctcctagcccagtgtccatcctctggttttctccgcaggaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggtaagagcctccttaggggcaaggagggaccctttcaggagtgaaggaggattgaagagccactgctaaataagggagggggtttctgggagtatcatgtccccattcacagctctacacgccgggcacgtggtggtggttctcatcactgtctctgttaattggcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggctggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctcttatagatgaaaactgcacaaggccagaaccagcaggcactcaataaacgttcatgtcctttttctctacctgagtctattttcaaacaaaatagagattctaaatctcccagaagcagcgactagagctgctcccgtccccactcttgccccttcctgctttatatcccgtcctcaccctgggcctgatgccctaaatttatggtgtcagattgttctatgcctttttctcctggctcctgttagccaggtgcctcctgtgtgagttactgtaatagctgcaggtaatagaaaggaagaagtcagagacccctcccagcaccctacaaaagcctttgggggacatgttgggcccaggacatgttccctgcactctttcctttgcagttagtactcatgtatgagccgaagtcatatattgctaacaaaaaaactaaatccttcataagagaagttagggatgtattgaataatggcctctttgacacttggccgatgatgcccacttcaaaaactttgggtttcagaggcctgcccgtctcctgtcctagcactgccagagccacctactcagtgttacttttttgggtctgtgatcctgttccctttaccaggtcattgtactgtgttgtccctggaggaacagcttctcctcttgtcttgacagtagggctggggttttccctggttcagctggggagacgtttgcaggttagaaaaaggtctcatgcggcagcgtgtgtggctgttagacgctgatggcacaacttccctttgctggcgtcgtggcacctggcctctgggacagtatgaaccataggggctcaggaagaaccgcttcccctccacccccatccctgattcctagtggccccttagattttgggtacatcttccttcaggctcaccttccttcttttcaaagttcctcaagcctgttactcatttgtcaaggctgggcttctcctacaaagccctcaacctgcccagccagcagctgtgaggctgactgaatatttggtgaccatatcaccctttctggtgctgaagctcatgtcagctccattggacagtgttattctgggctcttctcactgtagaggactggagcagaaagggttccttggaaacctgtgctgggaagccctgtttggtctaaggctaagctttggttaactctgggctccagccctttcttcctttaaatagctgatgcacggccagcaggtctccattctcatcctctctttctattctgtttctttggttcagaaatactcttctgctttttttggacgaactcaatggcccgatgttagatattgggtatttttcaatcttctgttttctgacccttccaagaaagtttgaggaagaacatgtactgctttcacgttcatttcgcccattcagatgtcttggcttgaaccttatgactccgtatcaaagtcctcacaacctgtctcagatccctgatgcacaaattaggtcttattaataagtgtgggaaaagagaggagagtccaccttcttggtcaggcccctgaggcatgcatttctaccaaggaatatggacagatgacagaggagaagagcccaaagccaaatttatacatgagtgcaagtggatgcaaatttgttgctccctgcatctgtgtatatgctttctgttaaatacagaaagaaggaacaataggcttgcacacttttctaactacatgtttaagtggcagagtccaggctgtcgagtcacggttgggtttgaatctgactccaccagtaactttggttggaaaaaatcacttatcctctttaagcttgattttatttattttattttatgtaagagtgagacagtagtagcttaatagggttgcttttaaattagagtgaacatgaggcatttattcggtgccagacagataactgcctataacaggatgtgatcagcacaagtaacagaaaattagcctgacggtggcttaagcaatgggaatgtttatctcacatagcaaaaagtctgtaaatagatggttctagagttgggtggaagccaaaatgtcatcaggatttccttggaaccgtctgctttgccatcctcagtattgcagaatggctgctcctgcgccaagcatcattctgcaaatgatggtgtccacagccagagtggacagtagtacaggagccttctcattctgcccttatccgggaataaccgtcagcagctccagcaacctcccccctgtctctttatagagtggggccacgtgcccactcttggaccaggccctggcaaagggggatgggtcgactagtgtatcccctggcactgagcacacttgcccttgagctggggttttgttagtagggaggaagctggagtggcagttggatagacaattcatagtagctgctgccatgttcaaaaaatgctgcaatgtaaaatcataaagtattcatctaggcataactttttaaaatattcagtcaccttttattctactaaaatcaattttaacattttagtgtatattattttattttagattcagcaggtacatgagcatgttagttttgttttgttttgttttgttctgttttgttttttgagatggagtctcactctgtcgcccagtggtgtgatcttggcttactgcaactctgtctcccaggttcaagtgatcctcccgcctcagccccccagatagctgggattacaggcacatgccaccacacctggctaatttttgtatttttagtagagacgggagtttcaccatgttggccaggctggtctcaaactcctcacctcaagtgatctacctgcctcagcctcccaagtgctgggattacaggcgtgagccactgcgcccagccacatgtgcgtgtttgtgtatattgcgtactggtggggattgggcttctgtcatacctatcacccaaatagtgaacattgtactcaggtagcatttcaacccttgccccccctcccactcacccccttttggagtgcccagtgtttgctatttccatctttatgtccataggtacccattatttagctcccacttataagtgagaacatgtgctatttgattttctgtttccgaggttaggataattacctcaagctccatccatgtggctgcaaagcacatgatttcattgtattttatgactgctcatgtatattatttcagcctccaaaattttgtatgttatttataatgatataaattatgtggttttatcgtgtactctatctcactcagaaatacatacaattcttcgttcccagctactctggagctgaggtgggaggatcacttgagcccaggagttcaagaccagcctgggcaacatggtgaaaccttgtctctgaaaaataaataatacacacccacatgcacacacatccagttcttccatgttaatgagtatgttgtgtttcacatacttctgaattagccgaaggaattaaaggtagcatcttttaatcctcagactgccctgcgtggtccgattgaattgggcagtcagcactaggctcttcaaagggaaacaggcttctttcttaggacggtgcacagtgaaagagtggcacacacgctgttcatccagtgctccaacccccagtcctggtgtcagatacttctacatttggggcatttccccttgagatggctgtggctagcgacacatgatgtgaacacctctcttggattgtggttcggccgcacaaggccccatcagagttctacaggtggagtgtggggcccagaaggggctcaggtcttaggggtgtcatctgaaaaaacagagatggtgatgggacaccagttctaggagccctctgcatggccactttctgcctcagctcttctaaagcatttcttctgttcccttccattggggtaaccactgatctgtcttcccaaaaactgagtcagaagttggactttgttacttggctcatctacatttaagatatagtcagaaaaaaaatgcagtctttacatcttaagaaagcttacatgggccaggcgcagtggctcacacctgtaatcccagcactttgggaggccaaggtgggcggatcacctgaggtcaggagttcgagaccagcctcaacatggagaaaccccgtctctagtaaaaatacaaaattagctgggcgtggtggtgcatgcctgtaatcccagctacttgggaggctgaggcaggagaattgcttgaacctgggaggcggaggttgcggtgagccaagatcacgccattgcactccagcctgggcaacaagagtgaaactccatctcagaaaaaaaaaaaaaaaatagaaagcttacatgaaagaaaaagaaaaatgcagtcttgatcactgttggcctggagactttatcttgtgtgttttccagggcgtgcatgaggtttcactggacaagtagaaaccattctaggtattcagaaagagttaatacaagaagagaagtttatagactcgttggaaggctggaggagtgagccataggttaagcatccaggaatcagcaccccctagaacagatggtgagggagctacaccctctgccacaatcaggagggtggagactcaagctcgactgagttccggaacacaacacactgccacagctgccagccaggggtgagggaatcccacagccccagctgcctctggggaaccatacagctgtagctggaccctggcacacctgaagaaagtgcctgctgtgtgctaggcaccctgcaggagttaggaaagcagtggttaggggctgtgtcctgctggaggagcctgcgctctagtgagggagacaggataagcttaaggaaggacgttaaaaggtgacaagagtttgggaacttgcagggagcaggggattctgggtggtggcgggcatgttgcagcaagtagggtaggtctccttgagaggttatcgtttgaggaagtgaaccagcgggatcagatgcaggtggggagagtgctctgggctgagtgaagagtaagacagagactggctggagctgagggagtgagaggggtgggacctggccctggagggcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgggcgccaccagccatattcacgggagttagcataagggttcacagtttgagtgaagcttcctgagactgtgccgtgctgccaacacagttctctccgattcattccctcaaaacagtatattcccaatgaaagcacgaccagtacttaaactagccatgttcagtgtggctctcagacctttccccagggcaagatgatcacaagaattcctttaggaacgtctcttaaattgtacaactaaagtttaatggttatattagaatccgtcttcgtactatgaaaattcacccaactgatctcccatttctgggatatttagattttttctagtttttcatcgtttaaaaaatgatgcagcctggggtggtggctcatgtctataatcctagcagtttgggaggccaaggctggtggatcacttgagctcaggagtttgagaccagcctgggcaacatggtgaaaccccatctctaccaaaaatataaaacttagccaggcatggtggcttgctcctgtactcccagctacttggggggctgaagtgggaggattgcatgagcccagaagtgggaggttgcagtgagctgagacgagatcgcaccactgcactctagcctgggtgacagtgagaacttgtctcaaaaaataaataaataaataaaatccattaaattgccagtgtcctcaattatttccttaggagtctctatttaaaatggttttcctgaccagactgggcaatgtagcaagacctggtctctagaaaaaaaaaattttttttaattaactgggcgtggtgatatgaggttatatagcgccagctactctgaaggctgacgtgcgaggatcagttgagcccaggagtttgttaagtccaatcctatgagatttttaaggattttgatagatttttccctccagaatgtttgcatctattcacatgtgcatcagcagtgcatttgtagttaaatgtgtagttaacgttctgtttttaaaactatacaaatgttgggccaggcgccatggttcctgcctgtaatcccagcacttgggaggccaaggtgggtggatcacttgaggccaggagtttgagaccagcctggccaaaatggtgaaaccctatcactacaaaaaataaaaaattagctgggcccatggtggcacgcgcctgtaatcccagctactcaggtaactgaggcccaagaattgcctgaaccagagaattgcttgaagccaggaggcggaggttgcagtgagctgagatcacgccactacactccagcctgggggacagcgtgaaactgtgtctcaaaaaaaaaaaaaatatatatacacacacacacacacacacacacacacacgtacatgtgtgtgtgcatgtgtgcaaatgttgggccaggcagcgtggttcctgcctgtaatcccagcactttgggaggccaaggtgggcggatcacctgaggtcaggagttcgagacaagcctaactaacatggagaaaccctgtctctactaaaaatataaagttagccgggtgtggtggtgcatgcctgtaatcccagctactcaggagactgaggcaggagaatcacatgaacctgggaggtggaggttgcggtgagccgagatcacaccattgcattccagcctgggcaacaagagtgaaactttgtctcaaaaaaaaaaaagaaaagaaaatatggtaaatgcgtgatttttattaaatatataaactgatacaatgtgagtgctgaagaaaaaattcttatttctatggaaactaaggtaaaggctttggcaagattaaagatgaggctgagcgcagtggctcacgcctgtaatcccagcactttgggaggctgaggcgggtggatcacttgaggtcaggagttcgagaccaccctgaccaacatggtgaaaccctgtctctactaaaaatacaaaaattagctaggcgtggtggcacaagcctgtaatcccagctacttggaaggctgaggcaggagaatcacatgaacccaggaagtggagggtgcagtgagccgagatcactccattgcactccagcctgggcgacagagggagactctctcaaaaaaaataaaaaaaataaaaatgatgtgatagaggctgttggttgttcctcaatatccaaatatccactctttccttcttccatgataatgagccttgacttttaggagggcacgtactcattcaatacaaagaccacattctcagcctcttttgagagcagaggtgactctatcattactttctggacaatggcatgtaatcataaacatggggcagtgctaaggtttggatgtttgtcaccttccaaaatttcatgttgaaatttagtccccagtgcaacagtactaagaggcgggaccattaggaggtgatctgaccgtgagggctcccacctcgtggatgggattagtgccctcattaaagggcttgagggaatgtttgtcccttttccaccttccaccatgtgaggacatagcaacaaggcatcatgcttgaagcagagagggcaagcccacaacagccactaaatctgctggcatcttgatcttggacttcccagcctccagaactgtgagaaataaatctctatttacaaattacccagtctgtggtatttgtaacagcagccagatggactaagacagggagctcccaggagctttccttaaaggagacatgatacatgcctctgttagttggcaggggtgggggaattatgaacctttatttaaagatttatttttaaaaataaaataagtaaaacaaactaccattctccttgtctgtttactctaccattccccttttcctatgtcctcaagcctccaacgcctctccccagttctcactctcagctgagaacactgcttctcagtgcattaagaaaatagaagcaatcagccaggcgcagtggctcatgcctgtaatcccagcattttgggaggccgaggcaggtggatgacctgaggtcaggagttccagagcagcctggccaacatggtgaaaccccatctccactaaaaatacaaaaatgagccaggcatggtggcgggtgcctgtaatctcagctactcaagaggctgaggcacgagaattgcttgaacccaggaggcggaagttgcagtgaaccaagatcgcgccactgcactccagcctgggtgacagagcaagactgtgtcaaaaaaagaaaaagaaaatagaagcagttggagagggtgtggttcccactaccacatcttgagtctgcgtccaggtgcctgttcttgcctcctattcctatggatgaactgtctggccgggcgcagtggctcacgcctgtaatcccagcactctgggaggccgaggcaggcagatcacctgaggtcgggagtttgagaccagcctgaccaacaaggagagaccctgcctttaccaaaaataaaaaaatctgctgggtgtggtggcacatgcctgtaatcccagctacttgggaggctgaggcaggagaattgcttgaacctgggaggcagaggttgcagtgagccaagattgtgtcattgcactccagcctgggcaactagagcaaaactcctatctcaaaaaaaaaaaaaaaaggaaacctatggatgaactgcctgctcctccctgagacaagacccttcagtgggccttagatcccattccctcttgtccactcaaaggatacggctccagcaaacacctccctcacccacttacccacacatattgatccccttcacacacatatagaccactcccatattcacccactccccacacatatagaccagccccacaggatacaaagcagtagtcccctcctatctgcaggggacaagttccaagacccccagtggatatttgaaactggaaagcactgagccctagatatactatgttttttcctactcatacatacctatgatgaagtttaatttataatttagcacattaagagattaacagcagtaaggagaacaattataacaatatactgtaataaaagttatgtaaatgtggttctctctcaacatcttattgtactcatccttgtgatgatgtgagatggtacaatgcctttgtgatgagatgaggtgagtggcatggtcattggggcacagtgttaggctactacagacttttgaagatacatcagtaggaggatcatctgcttcaggtgatcctggactactgagccatgacaatgtagatggtttatgtcaggggctatgtgtgtgccttgcctcctttcctggtacttcctcatctctccagctctaaatatggaatgcccagggctcaggcctttcaaggtttctcttatccgtctaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaagcaagatcctgtctcaaataaaaggagaaagagaatggggaggtggacggctcactgcagcctcgacctcccagactcaacaatcctcccacgtcagccccctgagtagctaggattatggctaattaaaaaaaataaaaattagaggcaaggtctcactttgctccccaggctggccttgaactcctgggatcaagagatcctcccgcctcagcctcccaaagtgctgagattataggcatgagccaccacaccatgcatctctttctccctttaagaggtccagttacctctttg

SEQ ID NO: 12562 - DNA, 7620 bp, Human
tagctgcctgcagcctcaaattcctgggctcaagagatcctcccgcctcaggaggcaggaggatggtcttcttcttcaggagtccctgtctgcccaggggcagctgtcactggaatcttttagctgccaggaatgaggtgatggctgaagagcccaccactaagaaaatggttagtcacccctttgacaatgcttcctttgtgccatgcctgctctgagcactttgcaaatgttgactcatataaacttcaaagccctcatgatgtgggcacaactgctatcctcattcctcattgtgcagatgaggaagctaaggccagcaaaggcctagtaactaacccaaggttacccagccgggaaatgctggagctgggaatgaagcccagctgtctggttccagagccagtgttacatggctctgacctcccaggcagttcttccaggaacctcccccacttccctgggcccttcccaggtggaacccctttctgagcctccttttcccatcagctctgtccttgacagaggcaccccagactttcagagccaaacgcgatcgtgttgcctacaattgaggaaacagaggccttgaaaggtgtgtgacacacctatgtccccccaaattataaaggtagttggggaagaaaaagaagcacgtgtgtaagaacggggaatatttatgaggttctcactgcgttccaggcactggggacccagtgcagacaggacctggcccctgcccaggtggcgatgtcagactgggagggaagacacattgaaagccaagagacaagataaatttcaaatttagcggcaagtgatcttgagagggcagtaaagggaagaaggcgggactgggaggaccttgggagatgcgcttccgtccagatcctcaccttgctttaggaggtgagaacagaggcagtcttccgtcccaaaatccttctccccacggttgggagaatagcgctggtgggttttttgttcattttactttattttacttattttatttatttatgagacggagtctcgctctgttgccgaggctggagtgcaacggccggatctcggctcactgcaacctccgcctccccgattcaagctattctcaggcctcaatctcctgagtagctgggattacaggttcgtgccaccaacgcccgggtaatttttatatttttagcagagatggggtttcaccatgttggccaggctggtctcgaactcctgacctcaagtgatccgcccgcctcggcctcccaaaatgctgggattacaggcgtgagccaccgcgcccggcctgtttgttaatcttaaatagaaacggagtctccttatgttgcctaggctggtctccaactcctaggctcaagagatcctcctgtcttggcctcaggaagtgatgggattacaggcatgaggctccgcgcccggcctgataggttctcttattgccatgttgtagatagaagggggcccctgggttaggcagacacaggttaggtagttcgtccggcgtcaccgggcgggagcccaccgcaggccccacgagacaagggcgagcaggttcatcgcctcccggggaaaggactgggtagtcccaggccccaccccttcctggaacagcaagttcgctgtgggtcccgacctactgacccaggcggagggcgggacgcagggtagctggggccgcgtagagagggaaagaaggtcgcgattggctcgtcccgaaaggtgggcggggcctcctccgacctgtgcgcgcgcgccgcggggaggtgttgccgagggcggagcgggagggggcgtggccccgcgcgggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggtgtgtgctcgcggccaggggcgcggccccgccttttgacagacagggaaactgaggcacgctggcccctctcggcggccccccgggaaggacgccccgggccgtggggccgagctgccccgccctccggcctcgcgggcctccgccctcggattggcggccgcgcggtgggaggaggagccttggcccagccgctcggccagaagcttctagcatgtctggggctgcccctccccgggcgcctcctcccgcggccccgagcagccccggggtgcggtgcatgggggtgggggagccgggggtgacgacggggacggcgcggcggagcccgctgcggacccgggctcacctgggctcggccgccggggtccgcggggcggcgcctccggctcagctgcggggcgaggggttgtgaatgcaggagccgaccccgttcgtgggcttgggggctgggttgggataattcccgggaagtgatgacctggccccggcagggcacgcaggaggcagcggccgcccaggtccggagagcggggccgcctcggagggtaaggagagcagggctttttgttcctgtgcccgttgatgattcaggctggcttctgggcttgatctggagctgactttttgtgcaaggatggtggcagtgaatgctaatgtgtgaggatttaaaaactccctatttatttttgtttttttttttcttctcttcctacgcaccattagccctaaaacgttgagagtaaacacttaccgaaagccgaccctggaccatgtgtctttagccatctcttggtgatgttgccaggaggatgggtcagtccaggagtggcagggcctaggtggcacctggaggtgaacacctaaccgcatgagtccttttccactgtcaggctacgcggaaatactgttggtaggggggcgtctctgctgttggcagtgagaggtagaaacttggggttcttccttgctctcccctgacagacaaaaaagttcctcccccatggcttccaagctgtttccccctgtaagggaagctcgagagagagtctgctgttcagccatctgactgcttctaaatctgcttttcaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggtaaggtgccaggtggggcggtgtctgtagagggcgatggctgctttttgaagcagtttagtatttgctgaaccaatgtgttggggtgtgtggtgcgtgccaggcttggggcacaacagtgaacaggactgaccagggcgctgttgtggagctttcgtggtggggacgtgtagatttgggggccaggtcttagctgcagaggcctgatgggtcttatctatggcagacggcctctgggcaagagctgagcctcttgagccagcttccatctaatgctgtccttttgcttttcaaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccctggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctcaggggagcggtcctgtgactctgtttgagggttctgctggttttgggggtggagtggggagctgggcatccttccaaattcaatcaaggtgagagggtgggatgggcaggaggcaagtgccctgcaagggaaacgtaagtctcccttcctcagccataagtgggttggagaacttctacccagactcggggtccaaaaaaccagagacccaagcacagtggccttggggatcattttttgatgaaggttggagtcaaagtagcggtggggagaggcagggtctggctcctaattctgcctttcttcagggtccctggctttttcagcagaccttggctctggggccaaggggccaacccagggtctggcctcttaattccttatcactccttccctgctagaacgggctgggcgtcctgaaggctggccaaaccggagctcaaggtcctgcccaggactagccccactgtagagaggacccatttcctgccttggctttatttgcaggctactaaagctgcttttactttgtaactttctttaaaataactggttttattataaagtaattgctcaggcttaaaacaatgtattgctgctttgttacaaaatgttctaaagtggaaacactgtatatagaccaggagcagtggctcaggcatgtaatcccagtactttgggaggccaaggtgggtagatcccttgagctcaggagtttgagaccagcctagacaacattgtgaaaccccatctctacaaaatttaaaaattcagccggagaatgcagcgtacacctgtagggccagctatttatgggactgaggcaggaggatcaattgagcccaagaggtggaggcagtagcaagctgtgtttgtgccactgcactccaacctgggtgacaaagtgagaccctgtatcaagaaaaaaaaactaaaacacagtatccaaaagtcaaactgggccagacgcagtggctcacacctgtaatcccagcactttgggaggccaaggcgggcagatcacctgaggtcaggagtttcagaccagcctggccaacatggtgaaaccccgtctctattaaaacaaaaagccaggcgtggtgcacgtacctgtagtcccatttactcaggaggctgaggcaggagaatcacttgaacatgggaggcagaggttgcagtgagcaaagatcccaccactgcactccagcctgggtgacagagcgaggctgtgtctcacaaaaaagtgtcaagctaagagttgctttcccttcccactgaaacagttgaagcgctgaaaacaggctaggggcagccctgccagtccaggagaactttctgcaatgactagaacgttctatataccgtttacttaaacatcttacaaattcaataaaattagaatcagttcctcagtcctgccacacttcagttgcttagcagccacacatgtatgtggccagtggcaactgttggacaagtcaagtctagagggcttttccctaaagacattgcaggggtgactttgaagagcagccacattaagccaggagacgccagcccaatcaggaggtgaccctggaatatcaagagctaagagatgtttaccaaagtatcccacacgccaaggtcacatttattgcggaactgacctgacctcattggtgacacaaatcccagggctgccatccccacccccaagtctccattatacaccaagtccctgtgaacttcatactgaagtgtcacaaacataaaggtgcacgaagccttgaggtatatacaattctgggaacttcacaaaaaacacggccaagcaacctaccaggtagcagtgtgaggagtgggacggtgggattttgaggggaaaatcttggtggtaaaagggcccaaagacctttcacacatgcatttttttgctcaaaggccactacttggcttgtctatcttggccggatatctggtgcacccacatgcaaacttttcccaaagtcttgggcttg

SEQ ID NO: 12563 - DNA, 55674 bp, Human
acaggacagggcacacagatagaaggtagacagcgagcaattttcccctcttccttcttgactcagctcataggcagggctttggcttgataagctatacatggaaagttcaaggcctaaaggagaggtaaaactggttcctcctgggttttgcacggaaccgcagctctgctgatctgtgatctctctgttcagcctagagatacagctcacagtaataggagccaggagaaaaaaatgcgcgtttccccggggtccgaggaatgacacaaccacattccgggtttaaaatatcgcagctgccctttgacccaggcagcacgcctcttcctttctcctttatttttcctttttttgggcaaaacctagtcgagggggacgcccttgtctcccgtcacacttaccattttcctccggcccaacagtgaccctgtcaggcacgcagccagcagatacttgtccccatctttaggttatgaaactccatggccttttattcttacttcagtggttcttaaaatgtggtccccacaccagcagcaccagaggcacctggaaacttggtagaaatgcaaattctcggggcccccttacagaatcagaaactagcagtgttttaacaagccctgcaggtaattctgatgcacgttcaaatttgagaaacactgtgttcgtttatctcagtttgcactgggttataactttacttttgtacattaatagtcaaggatgaacacagcacgtccatgtcaccattaatacagaaagttgaagttggagaagggctgtgtctatgggtttccctcgcctgacccaccctccacccccaaaaggaacgccaagttgaggcgttcccctgtctccctacccccattggaaacatcctgtccctcaaacccggcacctcgaactgtctgacccatctgaggctggcgcccgtggccgcagaaatccctacacctctggcgcgagtaatgcggtcgcgcagcttttatacccaccccctcctcccgctgagcacaaagtaaaaccgaaagatttctgctaaggttgaaaaatgaggaagatactttttcttttctttttttttttttttttagtcaggacccaatgttaaaatgtgagtcaagaatgaaaaacagatggttaacaaggggaaggaaaaaccaagccattgagggggcacccggatttgaaccagggacctcttgatctgcagtcaaatgctctaccactgagctatacccccgcgcctctacagcgcctggaggcggctccttgggtgctaagcattgttgcagctgctacactgtgagtagtggtgtaacagaaggagaaaggaatgctggagaaaaaggggtcaagctgaacgcagacggtgcccgcatccggggaaccccgggaaggtgcactgcaggggctcgagagggaagcactagcccgggcccggcagcgcgcagggtccaagagggagggacgggttccgccccacaaatgtgggaaagggtgtgggccggaagagagctaagaggggcagggtagggggtccccgttcggtccgcagattcatgccgggtagaaagtccccgaatgcggtgaatcagttccagcgttcaggaggatccaaccccaccctcgacgggcttgaggggttagcccgcctcccgcagcccgggcgccccagatgtgcagcctgctcgcctctgcgccgcctccggctggggaagggccctgggcaccgggcgcagtcagcctgagagcgctgaggcgccagcaccgcgggccccgccgtccccccaggaacccgcccccgcgcagccccacgtcgcccggagagcgcgcctcgctgcgcgtgcccttgcccgcgcccgaggcgcgtgcccgccccagtgcagcccctcctccccgctgtgtttattaggggaaggagggcggaggcggaggccagttccccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataaggtgagcccgggaccgggagacgcgtctttgcaatcccccgcagtgctccgaatccagggaggagagaagggccgggtctttgccgccttatccccgcgatcccaggagaatggagggagggcgagcgggcggtgtcatggggtgtggggacacatcccagtctgaaaaccaggagatctggggcgaggcgggaagtccacgcgtagcgggcagccgctgctggagaggggtgggctctgtgtcccggggttgggaggacgggagaggagcagggaagtcaggcgccggggtgtgttgggggaaggttaggggtgcagtcccgccccctacggcctggagagtgagaagagacggccgctccctctccgctctgcgccgagcgccaagtaggcggaagcgcggggcgctggtggagggggcgggggggcggggcagaggctggggggccctgcaaaaccgtccgctccggcgggggtggcctggcttcctggcctggcggggcgggggctatcagcctgcgagtgtgtggcatctgatgcggggggttttgggtaaggacccgggctctgccgcaagagccccgtttttgaacgacctgcacccccttggattcagtcgttaaaggactcgcagacctcctccacagcttcccaacccccacctccaattaaaagccaactcccggtgctgggccgtccagcctgagccgggtggggttgggtggcagagtagggtgggtggagggtgcttagctgagatctcctgaaattgtgctcagagccaggagaccgtgtggaagaacaaagagctaacttttcaaagcaggtttctccaatggagggtggggttggctgagttctggggaagccgaggaaagggggaggtattggggggaggggagggtggccttgtggagattcagtgtcccctgggggccctgtctccccaatgctggacttgttcatctggttgccattagacttttggaggggggttggagagtagaactgggtgtttcccgtacagtttagggtaggatcctgttctcttgtaagctccgtaagatcctaaggtaaaacctgcccctctgcatcccctccccagtctggaggggaggcctctgtgattttgtgcccttcctcaccgcgtctttcatccaccacccaaagctggctccaagtccaagtattctgtcctttccatctgaactgggagggctgggaggactggatggaagagaggtgcaagggtgggaacactagatgaaagaggggtatagagccctggggccaagttcattactgacctggagccaggttttgttcaggagaggatagtttattggacaccttatctctcccctcccccttggtgtgtgagcttcctcagtgacctttggcctctgagtcagcgtgaggaggtggggttggaggttctgaaagatatttgaacttgctcttggggagtgtgggcatatggggccgctgctgtgtcactgttcctcctggtcctgggcttgactgggcaggaggagaggagggggtatattgtgggcacgaggaaagttgttgatctccccatgaccatgccagccgctgttgggcaggacttgagcttagagctatcagataatgaagtctccccttgagaatgtacctgtccttgcacactggggtttcgcccgcccctcgtggcagagattttggcctctgcatcttgagttccctgtggtccccttcttctccacagtcatgaattgggaagaggcagtgggcacttgacccgtataaggaaaaagcaaaacatgaaggcaggattgccactccaggagttgggaaactgggtccttgttccaggtctgctcccaccagttttatgaatgtctctaggcctcagtattcaccatctgtcagatgggtatgatgatgtcatttccttaaaggtggggcagtgcactaaagtccctgagtgctaaagagggtgctgtatagactatgccctccctacctctctgggatgctctgttcagctccacaccactccccttggaaagaccttcagtgccgtgtacccgaggggaggggagcagggatgggcagggtgccctccccagttctcttaccctagctggaagaggacgttcaagtgggggttgcccagggaagtgggagttggtgattccttcctctttttagaactctccctataggaagtggccctggagagacctcgccccctgtactgagcaggagacctgaaatatccaggtatcagacctattcctctccacctgctccaggcagtaaggataggaccaggaatggggagccagtgcctggaggatgctgggctgtgaccagggaggaggggaaaccttcagtcccataggcagcttcagtcccatagttgctaaccaacttcccaaggcctcccatttacagcaaaagagtcaaattagactcacccgtttctctacaatcccccatggtactcagcccactacgtggcccaaagcacagggtgtgtccttggtttcagccttttctcctccctgagccttatctcccaaaggcataggtgggtaaaaaccttgtcacctctgaaggccaccctgcccccaacctgcagtacccagcatgctttgcaagctggataaatatgtattgctgatgacagtgtttgaggaaggaggtcgagatttgcttctccagaggacttctgggattagagctgggggagaaacagggtgacctcatttgctcattcaacaaatatttattgagcacctactttgtgcacctgctttgtatctagggagctgtgttgtcaagaacctcgccacgtccctctttcctggcttgcttccccaggtttctgaaaacaggtggaggtagaggattggtctgctgccagttcccctggaatcccctgttagggtgggctctctgcctctgcttgtctcagcgctccctccccactcgagggggttgaagtcctcacagctgtggtgccccgttttgctagctgaagcttagagtaccccaccatcatcttgtgaccatcccttcataatagctactagttatcacgatatgctgggctcagtcttcacagcagcctcacaaagtaggtgtattcgctcttgtaaacgatgcactccataaacggaggctcaggtagcccatgtggctcatctccctctcttagagctgaaattcacatccacagttctttctgctcagctcttctgccagtgtgtttgcagaaagtacttttatttatacatatttatattttatttacatctcatttgtgccaaaagtaggtcccatcccttcctgaccctatctggaggaatgctctgggcctggggtcttgtatgggggcgtggggccactgggaataatcctgtcctcctcggaatttgtggaggtgcagcaaagatctatgcctttaagccagcgggtcaggtggccaaccaagctaggctggtgccccggcgagggtggggctggcattgcctctgcaggagggagaaactgtaaccctgggcaacaggaagggaagagatggtctcataatccatccctgagtcatggccaccccaggtagcctgggttcagaggccaaggtgccaggctgcaggcacagtgacacgaagcttgccacatcccccccaacccagagccacagagggacaggctgtcccaagtgaggggtatccttgcaggcttctgcccctaccagcctgtttacctttctttagagtgggttgcaggtaggcaagggaagatcaagatgaccctgccttggagcctcggatccaggctgagaggcctctaacaggcagcagaggtagggtctgtctggtttctgtgaacagggaagccatggactttgcaggcagcaggaaggggcagaggtgcatgcctcgaggtgcagtttccttgagtcctgaggcccaggaatgcttcgctgaaatcatcttgcctggggcctttaaaagaggggggctcttgctctgggacagagcccatggggcagggcagaggcagacggggtcactgtggggtcctctggacatatttccctgacagtgtccttccccagaccccattgagacaaggcaggggttctttcatcttagggtccaggcttggctcacagcggttgtggagggactggccattttctgcctcccctccccacaattttcctaccccaaaaaggacacagtggaaggagctggtgggttttcttgaaccttggggccttcctccagagagggtaggggagtcgcctgaagctgctggaggtgccaagcattaggggtggaacggcctcctctcctgaccttccagcactctgggagacagtggctgcagctccacttgacacttgtgcttcatagtaactggtttccatgtttctgctcagagccccctgcagggggacaggcgaccaccctcctctgccccacccttgggtgtctggatgagagtgtggggcctgtgagggaggtgggaaggagctactgatagaaataggtgccatcccctagaagaggggctctgcttcctccgcgtggcagcctggaggggtctttggaaccactgggtccagtgttggccctgtgccccctgcctgctcagtacaccccaccctccttctccaaggggcttggctccgggtgcaggcctggccatctggagtaggggtctctctccctttgtctccccaacgtcaatcaggaggcagccttggaggtccgtggtcctaggacagtgtgtagcccttcgtgtgtgtgtgtgtgtgtgtgtgtgtgtgtgtgaaagtgggtcatggtctggattctggagaatgtttttcctggcaggcccctgtgggggtagggggaggcaggggcccaggcaggggcctaggcaggggcctgtgcagctaagtaggcagaggccagcagactgggtggtgaccaggctggggcaccctgccaatgcctcccagttactcggggagggagtggggctgtcacttcaggggcctgtgggggcagggaccagcctgtcttagtgtccctggtgggttctgtgtgttggggtatgcaccacttcaggggcctgtgggggcagggaccagtctgtcttagtgtcccggtgggttctgtctattgggttatgcaccagaaggagtctttaagttgcctcataggagtttgggggccctgggtcactgggataggcccaggttggggagggggccaagcttagacccgccacttctttgcttccagacttccggctggccgtcctccccaagagtggttctcctagcattctgtttaatattccaccattaggtttttcctttgggtcttcttgatagggaaccagtaccctattagaaggtgatttccccctgaaattaccctgggggtctctggttgaagtgggccatggtagggaggttgaatcccagattctcagccttctttctgctatcccctcctcccagtgtctcagaagcacctctccctccgggggtttggagacaacattttgaaaagcatcgccttgggggaattccttgacaaatggccaagaaccagctctgtggctgggctccttcaaaagtccccctgggcctgcctcctggcctccttcttttggaatggggaatgtctcccttgactactgggaaatggggcagggacaggccagccaggtcactcaggtggcctggattattctggggtcctggcagtggacccctgtttggtggtgatccagcacatcatcctgggcttctgggggtgaatttagatcctgttgtcatgggtttgcctaagcatcaatacttctcaggggttccacaaagacccctccaggctgccacgtggagcctgttagatcgtttctcttttttttttttttttttttgagacagagtcttgctctgtcacccaggctggagtgcagtggcacaatcttggctcactgcaacctccacctcctgggtttaagtgattcttttgcctcagcctcccaagtagctggaattacaggcatgcgccaccatacccggcctatttatttatttatttatttatttatttatttttgagattaagtctcgctctataccccaggctggagtgcagtggcatgatctcagctcaccgcaatctctgcctcctgggttcaagcgattctcctgcctcagcctcccgagtagctgggattacaggcacgccgtcactgcacccggctaatttttttgtatttttagtagatacggggtttcaccatgttggccaggctggtcttgaactcccaacctccagtaatccgcctgccacagcctcccgaagtgctcggattataggcgtgagccaccgctcccggctagatctgttctctttctgtcatcactctcttccctccgtcggccaccctggatgggccctgtgtcccacattctcttttttttttttgagacggagtcttgctctgtcacccagactggagtgcagtggcctgggttcacgccattctcctgcctcagcctcccaagtagctgggactacaggcacccgccaccacgcctggctaatttttttgtctttttagtagagatggggtttcaccatgttagccaggatggtctcgatctcttgacctcatgatccgcccgcctcggcctcccaaagtgcgggattacaggcgtgagccaccgtgcccggccgtgtcccacattctcacacgcatgaatggattggagctgtggttggcacagtgaagcccctctgcaccccaacacacacaatctccagtgtgagccctgaccccctcggctaaggttcacacctgctgtgcccagcacctgacatctgagtgctcagaggtgccaagtgctgtgctgagggctttgaaggtgatttctcctcagtcctggacaatcccaggagggccaggtgttattacatccattgtacacaccaggaagtgggctcctctgaggtgcagggccccgcccaaggccatacagttagtggggtagagctttgatgtccactataggggtgtccaccttcaaggctttgaagtagagcccttcagtgcctcagtgggagacccgctgccgggtgctctcctgccctcctcctggggtgggagaggatgagggaagggtagaaaggatgtgttgtgttgacagagcctgggacacccagcccactcctctggccaggcatcccacaggaagtgggaggtatcggagctgtagcaccacctggggctcatgtggggctggtgggtgtgctgggccctggtacaggagctaggagcacctgggttctgggcctgggtgtgtgggggctgggccttcctcttctgaggccttggtgccaccagaggagctgctccttcatgttcagcggctgctccctagcaacccagcgcagctttgcataagcaatgaggcctcgccagctctgggcaggaggggttccctggggagggtggagctgacttgggggctgctgccactgctataactgggctcttcccccctgtccttcatgcctgcctgtctcttcctcctgggttcaaatggcccattggtggaggatgaggaaggagagaggggaggggagtgccaaagcctgtgacctgaaatgcccccagctcacctgggatgattccatgttctccccacagccatgggcctaggacagtcccagcagctcctgagtgccccttcctagggcctgagcccctttttcagaagtcctggtatctgatgtatgtcctcctgtctccatccccagttctggcataaagcatgcttccattgcgagacctgcaagatgacactgaacatgaagaactacaagggctacgagaagaagccctactgcaacgcgtgagtcctgttctgggcagggggctgggtgggcaccttggctccctccccgagtgagttcttcctttccttccaataaccgcaaggtgacattggcgaacacttccatcccctacttgaacatcacagtttgtcctcacaacagctgaatgaagcaagcactttttatccccatttaaagtgcttttatcccccatttaaagtgcatttaaagtacagatgaggaaactggggcttagggaagggaagagactctcaaggtgggatggctagggcaagacaggctctaacccaatttcgggcagtaaggcgagcacgtttctttccactgtcccctgctacaaaagagggggctttcctcgtggtctttcaagaatgagtgacctgtctgttgtatttggggttgaggactttgttctgtttaccttcccttatttctctcctcaaaatcgacagtttccttctctcacctgggtacttctaggctttgggggctccttcctccagtggttccttcaagaaaactctctggaagcctcatgccagcccttttggtgttcattttttgagaatgggcaggggtgcataaagggtgttgcctgggccagatagatctcttccctgcctggtgagggaggctgtggagactgtttcttttgagtatagtcatcttgagtatagtgcagctctgttccttctgcactgggacctgcagcagctgacggtagggagggagtatagaggtggggtcccccatcccagagcctggaggaatacctcccctcccatcccatcccatcccatcccatgcaatcccagaaagtacagcaattttccatcttccaattgaccttgtgagtagcaagtacaaactcagtgttggggcctcacagccgcctccacctgcgaggtggaggctttggaaggtcaagtcacttataagtaatgatgtaatgataatttctttttcttttaatttgcttttttttttttttttgagtcagaggactcatcacccaggttggagtgcagtggcgcgatcttggctcactgcaacctccgcctcttggattcaagcgattcttgtacctaagcctcctgagtagctgggattacagatgcatgctaccatgcccagctaatttttgtattttttagtagagaccggggtttcaccgtgttggccaggctggtctcgaactcctgacctcaagtgatgcaccgcctcagcctcccaaagtgctgggattacaggtataagccacctcgcccagccttaattcgattttttttttaattttaacttttttttttttaacttcaaccaactcaagtaatggtaatttcagtgttcacatgaatttaggatctgacttgagtccagttttttttttttttctcttaattctcagtcaggaggctctttgcagctgaagttcacccagggaaaaaaaaatttgggacttgtctaaaaagggggcttaaacctccagccttacccctaaccttaccccaaaccttccttgcttccttaccccctcccgttccctggctaagaccactctttcatctttttaggggctcgctcattcagcagacatttattgcctgcctgctgctataatacatactaacctgcaccaggtgctgggaaaacagattcctgataaaaatctcaagcccaagaagcaacatgaagttgtcccttctggaagaaggagggcactgggcaggttatctgggtaaaggaagggttgcagctctgtcctggcccctccttcagctgccccttctcttctattaatttctactgttcctcttccccctaccaacccctcccacccccacaagggaaatgggacattcttcgaattcttaagggctcacacaagccctggttctctgccacttcctccctccattgggtagtggggtggggttcagagaagccagggcagttaacccctccgttgctggaccacctcaggctagattctgagcctccgccccagcacgcagaagtctgaccgagccttggagcccagtgactcaagtagcctagaattcagtgagcactgggagctggagaaaaatcagaggcttgtccttgttttctctgcgttttatcagcctcatccaaagttccagcttactgtttttactgtcttcttgggaagctgccacaaggttgggtggagggctcctgcagggactgggggagccagaagaggcagatcaaggtttcttctctgggtgatgcttccaacttgcagaggcagaggttcccctgtctccctcctggcctccagccaaaagaagcaggttggcctctccatgtttcctccagcttttgtagccctagcctctgccatgcctcattgacctttggcccagttgggatgtttcctgggaaggagcctagtgagagagacctgggggctttgtgacccagctgtgtttcactttagctgtagtagcacctcctcgcccaaggcagtcattctccctcccctgcatccactgggccaagaagttacccgtggggattctgggatgaaccaggtgtggcgcccgcttgcaaggagtgctctctggacgtgtctgagccttggtttccccatggttaaaaattcctgcccaggaggcctggcatagtggctcacgcctgtaatcccagcactttgggaggctgaagcaggtggatcacttaaggtcaggagttctatcagcctggccaacatggtgaaactcgtctctactaaaaatacaaacattagccagatgtggtggtgggcacctataatcccagctactcaggaggctgaggcaggagaattgcttgaacctgggaggccagggctgcagtgagccaagattgcctctgcacttcagtctgagcgacagagcgagactccatctcaaaacaaacaaacaaacaaactaaagataaaaaaaaattcctgcccagggatgttggaccctagaccaaagaggatttattgagctcttgctatgtgccagacgctaggccgagtgtttgctgtcattccctcctgctttcttactttttttgtttttattttgctttggttttttggagacaaggtctccaaaaaaacttcgtcctgctcagtcacccaggctggagtgcagtggagtgatcatggctcactgcagcctccacctcctgggtttaagtgatcctcctgcctcagcctccctagtagctgggaccacaggcatgtggcgccatgctaatttttaagttttttgtagagaggagggcttgtcatactcttggcctcaggtgatctacctgctttagcccagcctcctcctgttttcttcctgcctctggtcttatccttgagtgacattcaggttcctgaatcctgggtttaccagggtacagctttctgccatttctgttctggtcttgctttgtggaccacaggcctggcttccttctctgaagcatcacgtgctccatgctgggccaagcccagtgcaggacccgtaggggcacgtggtttcttctggcactttgccagggagttgggcccacccagtgagtgtgtgagtttggtgtgcagggaggcctctatgttctgcctgtctctggctagtctctgaggggagctaggatcttgcagggggctggtcaagaaagaagaaagctatctttccctgtggtttctcaagattcagatttaagctctagaaagtgactgtaaagtaggcagtgaaaaggcctcttctgtttctgtccttgcatcagacttgtttgggggagaggcaggggagagaacataggccagagctcactgccagcccacctggtgtggcggacccccacatgcgtgcagttacacacatgcctggtgtgtaggcagacacccacgccggtgctggggcgggggaggaggacttgggagctggactgaatgggctgtgtttgtgtttccaccttcaggactgcagccatgcagccaatgctgtggcaaggttgagggtgcactcccggcttctgcacaatagccagtggtggaggaagaactgctaatagaattctttttgtttgttttttttgagacggagtctctgtcgctcaggctggagtgcagtggtgcgatctccgctcactacaacctctgcctcccaggttcaagcgattctcctgcctcagcctcccaagtagctgggattacaggcacctgccaccatgcccggctaatttttgtatttttagtagagatggggtttttccatgttggccaggctgatctggaactcttgacctcaggtgatccactcgcctcggcctcccaaagtgctgggattataggcatgagccactgcccggcccgaattctttcttgaagcttctgggtgggtggagtgagcctgctcttggtgagagagatatttaagagagatatttatgccctccattacttgttttgtaaactggattttccaaaagtggggcagatcagtccacacgcccaggcttagcataaacctgcatcgttgtctccctgcagatagtctagagtactgcctgttccctcctctttagggccctactgacaggaggcagggttgccagccagggaaaccagcttgtgaggtgtcaagtgggaggtgggcatgggctggggaaggaaaattgggggacttggttgcacctttcccctcttctctgactgcacatatttggggttcattctccagtttccttgagctgtggggtaaggactgaggagggtaaagatgtccctgattctggggagccaggaactatgtttctgccccttcccttaggcatcagatgggagtagggtgtggtctgtgtcagacaaggctgggtgcttaagtgtctctggattctagcaaactgtctttaatcccagctgcttttaaaaggtggggcagggttgggtgcagtggtttatgcctgtaatcccagcactttgggagactgaggagggtggatcgcttgaggccaggagttcaagaccagcctcatctctacaaaaaatgaaataaattagccgagtgtggtggtgtgggcctgtggtcccagttacttgggaggctgaggcaggaggattacttgagtctgggaggttgaggctgtagtgagccctgattgcaccacagcactccagcctggcaacagagggacactctgtctctaaaaaatgtaaaaatgaaaataaaaataggtggagcaggagtaggcaaaccccgcactggggcccagggctttccctccttcccaaaattgtctgcctctaactggaaaaatggggactagggatgacagtgtgggggagggcaagtgcaaatggccagcccaagtagccaaatgtggcctccaggtagccctcccacctcacttacccccaaatccctgtccttcaggcctcctggagcctgagggatcactttgcttcctaacacctacgttttacagatgaggaaacaggcccgcgtttccatgccttactcaacttgcagaattgtttctcttctatattaccgacaggggcaggcttttttttttttttttttcttttcattttgtgtgcaatctgatggctggtaagttcttcctcaagtctagccttgatctttttgactgctcttttttttcctctgattgaacaatgcctccttgttgcttcctatcgccaccacttcagccccttaggcctgaggggatggacgggtgagaaactgggttagcagggagccctcccttcccgcctgtgggcagccttcccagtaggggcttttggaatccgcagctctttctagaggcaggatgtgggggctgttttttttttttccttttggtaaaaccaaaagctccttgttgcttttgttgatgtctttttgttcctccttgaacacaaagctgtggtttttgaagagatccaagcctggaacgggcgaggctctgtgtagaaagggcgctgggctttcgggttcgctatcctgttcttctgaccctggagtgtggctgatggcaggactggagagtgaggctggtggctgacaagctgtccctgtcacctgtgagcccggaaaccttgcccctgtagtcccaccaagcaggaaggccacccagaggtcctcacagataacccctctcctgggacacagggcctcttcagtatcatatccttttttttttttttttttaatttttattttttgagacagagtttcgctcttgttgcccaggctggagtgcaatggcgcaatcttggctcactgcaacctctgcctcctgggttcaagcggttctcccgcctcagcctcccaagtagcggggattacaggaggccgctaccatgcctggctaatttttttgtatttttagtagagacggtgtttcaccatgttgtccaggctggtgtcgaactcctgacctcaagtgatccgcccacctcagcctcctaaagtgctaggattacagcgtgagccaccacgtccggctttttttttttttttttttttgagatggggtctctctctgtctcccaggtggaagtgcagaggtgtgatctcggctcactacaacctccgcttcccgggttcaagggattttcctgcctcagcctcctgggtagctgggactacaggcgtgtgtcaccacgcccggctaatttttgtatttttagtagagacagggttttgccacgttggccagactggtcttgaactcctgacctcagatgatccgcccgcttcggcctcccaaagtgctggcatttcgtgcccgacctgtatcatatacctttgaaaagttcagagggataggcagctcctaagcaggtgtggctgagaggccccagaatatctctcataatggccgagcttggaaacgagttgggtttgaaggatgaagtgctttgttttgcacccaacctgccaagcacatctttccccagaactgagtgctggaggtggctggggtccatctggcctccccttcgctgtctgggcagctgtggtgtagaggagaatgccttgggcaaggtctctgtccttgacactggacctcagtttcttcatctgtaaaacggcacaatgagaatgccagcctaaagctgtgtggtgggttttgagagagaatgtgcacaggactcagtgtgccaagatgttgctttgtgtctctgtaaattgtcctgaagcccgaggctgctgccaatagctgcctgtttgccctgccctatccctgtccagtccctgttcctgccccgcttcttcctgtcctacatgcctctccctgcaaactccccagagcagctgatagcagggaggaagggtgggtggggcacctgcagagagcccaccacccacttggaatgattaacaaggggccagtacaggctggcctatgggacaaaggacagctgtgctctggactctgccctgcacccagctgatcaccctgtccctcattcctcgccatggcccagtctgtcatggggttgggttccagcggagtcaccagctgggacgggtggcccctggtctgtcttagcacccatgttggcatgcacacatttccagccatccctgctgggatctaggggtaatggatgggatgggcaggaagggaaaaggtagaattcccaaaaattgtttctggagggaggtcaaatcagttggagctttctttgaagcccggcatgctggtggggggaggggtgcagcactgatgttctcatgcctttgcttctagaaacaaacccgtgacacttgtcctcctcacctaaattatccagaaagatcctatagacacagtctcctgactttgccctcatgggcttctccttagttgaggacccccttgctgtctgtgcctcttcctcaacccccgtagacctctctctctctctcactcattctctctcactcgctctctcactctcactctctctctctctctctctgtctcgctctcgctctctcctcactctctctctcactgttgctgctctcctgcctggagctgaagatgaggttgccatggaaacctgaagcgtagtgagccgggagagggaaaggcagagtcgtctcgccagggctgggggctggggactggggactgtgggctgtggggaggggacagggttgacccagcaagaggaatatagcccaagctgtctgcctgccttcctctgcctggggttgggcttagtgggcaggggaaggagcttggaggctctggagtgcctctttaatctagttaatctgatgcaggattaaaatcctccctcactcctgccaaattaagctgagctcacatctgggctggctcacccccacttcccttctgatgggattagcactccagctgtcgggggctgagactagggggaagggtgcttctgaagaggatgaagtacctgccaaccccacccaaggtgcctgctgcatgttggaggggctcccgagaccgtctggtgggtgtagggtgagcagagggacacagtgtggggtgcagggggtgtgtggacatggcctcaatgcagctgctgcctgggtgtcttggaggcgcccatcggtgcagagggcacatctatatattcatcgtgtgtgaggcacagtgcagtgtgtgtaggaacttcagactgtggaatgggtggggcacgtcaggtgcacctgtctggcggtctttgggcactggagctggcctctgttttatttatttatttaataaaaacaggctctcgctctgtagctcaggctggtctcaaactcctggctcaagaaatctgccctccttggcctcccaaactgctgggattacaggcgtgagccactgcacccagcctggcctgttttaaccctgtgcattctggccaatgagaaaccccagggttttgcagaccgggtctggaggatgtgtttgccctgcttgcctctagccctccccatcaaatgctaaccagcctcatcttctcagaattgagtcttcgagtgctgggccagagctgcccggaggtctcctctcccccaccctgcttttgccacatgtgcctctacttccatgtgcttgcctcaccacagcccctgcccatacagtctgcagaatggctctgatgttgggaggagggtcgtctcgtctctgaagcgctccctcttagggcctcagggcctgccagccctgctagagatcttccctttctggtctctaggaacagactcgtggttgatcatcccttggcctggaattgtacaggaactttgaagggagctcctcagctgtgggtggccctggctgcacggggacgaccccagacttggccacgtattcatcacaggccacgtctgttgccagctgcggacacctgtgtttgcctttcctcatcttcccttcctctgctggaggaactgcgagtctgggctgacctgggtggccaggacccaggtgagggctgggggacgggcaccgctaggatcatctggatccgggacagtgaaactggcccaagggaaaaaggatttgccaaggtcacccagtaagtcagtggcagggccagagccctgcactgggccctgtcaagttatgctcccttgattgaggtctccaaatcctgagccctgcccttcacaagtggtggcctcaggggaagtcgcctgtttacaggtagctctgatgcacggccatgtgggcggcaggagaacatgccgagcagaggggcagctcgttcttagctctcgagtgtgtcagttttgggtggaacgtgcctaggaagaggtcccaggaggccatctatggcttacctgggtgcagcctgtgagtcagggatctgcaggggtcatagctgtggtgggctgtggtcacccagggctaaaaatggcctgacgggctccggcttggagaagccacccaccagtccctgaagtaattggggcccatgcagacccccagacatttctcatagcagcacatacacacaaaccacatggctcagagctgcctgtctctcctgcagctggtttgctaggggaccttgtgatgagagagggatggagaagggctgagttctagtcctgcaccagcttcaattcctggcgtgacttttttttttttttgagatagagtcttgctctcgcccagactagagtacagtggcggatcttggctcactgcaagctccacctcccaggttcaagtgattctcctgcctcagcctcctgagtagctgggattacagctatgcgccacggtgcccggctaatttttgtatttttaatagaaacaggatttcgccatgttagccaggctggtctcgaactcctggcctcaagtgatccacctgctttggcctcccaaagtgttgggattataggcgtgagccaccatgcccagcctgacatttgtttattcaacaaatatttactgagcatcgcctactattctaggaacttgagataaatcaatgaacaaaagagaccccaaaatccctcccttcatagagaagtagtggagagagaagacaatacattgatgtgataaataagttaattatgaagactgctaagggagaagtgcctggtgccagcacaccgtttcctcctctgaaatgagggagttggaccagagtcttctggaggtctctgcaggctctgagggttgccgtggcttcggctgcctccaagccaggccctcttcctgggaccaggctgtgctgggcctggaaattggcggctaagttcagcatgaactgaagaaatcgtctgggcgcaaatctggatccctgtgtgtcttggccatgttgtttaacctctctggcctcagttctcccatctgtcaaaggggtacgctgaataccagtcacacaggtggctgtgagaattcggtgaactagggcacataagcccttagcacagggagaacattcactgtttgtttttttttgttttgttttgttttttctttttgagacgtagtctggctctgtcacataggctggagtgcaatggcaggatcttggctcagtgcaacctctgcctcctgagttcaagcgattctcctgcctcagcctcctgagtagctgggactataggcgcacgccatcacacccggctaatttttgtatttttagtggagaccggggtttcagcatattgaccaggctagtcttgaactcctgacctcgtgatctgcccgcctcggcctcccaaagtgctgggattacaggcatgagccactgcgcccggcctaattcactgttgttactatagattgagcagccctaatccaaaaatccagagtctgaagagctccaagatgcaaagctttgagtgccgacgtgatgccacaagggaaaattccacacctggcctcatgtgataggtcataggtcaaaaagcagtcaataattttgtttcatgcataaaattatttaaaatattgtataaaattaccttcaggccatgcgtatgaggtatataggaaatggtcccatccccaagatgtctcagtatggatattcaaatattctaaaatctgagaaaaaatccaaaatctgaaacacgtctggtcctgagcatttccaataagggatactcaacctgtattttacctgtcaccctcaggtgacctccttttttgtcctcaagctggccttcccacctaccctccagttaggttggaccttgttaaccgtttgaaataccactttaaccgtgtgttttctctctcaccacttcctccaggaagtccccctggatatgtgtgtccctttgtttttctgtctcccccttgctctcctctgcatggtcggtctccacttctggtcttagctgaaagcttagtcctgactcacctgtgcccatcttcccccagccgggcccagttgcctcgacctccatgtgtggtaggcacaaggcatggattatccccaaacaagggtaaccttcaaccctcagagagtggcccagtggccatcctttcgctcaggacagttctccttggctggcccatcactgatgcctgctgcgtcttcccaggtcagccagtcccagctgagtctgagaaacgcttgtctcccctcggccttggtggtggacactgaagtcctcctgtggggccgggccagggcgtgcccaagcataggacgaagttcccaggagggcatgctctgtgagaagcccagaggctcctgcccctcccccagagtcacccccactctgttttttctgtcctgcagacactaccccaagcagtccttcaccatggtggcggacaccccggaaaaccttcgcctcaagcaacagagtgagctccagagtcaggtgaggggctgggcggtgctggggcctggcagggagggatgctggggagggaagttgtaaggtcggcatttggcaagagtaccttcccctgcggttactctgcaaggccaaggtgctgaaatcctagcattgcctttaatcttgaccccacccctgactttatcaaaggagcagggtagagcgttctcccacttcctacctagagggggttggagaggtgtgggtgtctatttgagcccgctctggggctccctaaagcctacctcctccaggaagccactctcccctccctcttccccattcacactcacccacaaaggaggggtttggggaggaccagggaatttgcccctccaggtcatgccagtctgaggctgggcaaccaaccctctatagccgcgtcccaaacctccacccactgaagggcaaggtgtgaagggggccctgccatgggggcacaggatagggggctgttccgcctctgtctcctttggcttgactttccagaacactgctgagtgggaggtatgtgcccctgtaggaggggaggacgggttccaggcctagggagaacttggtctttaggggacacggaggaataagcaaagggtctggagtcctgagaacagaacagctgacccaccctgcctgggggtgcgagggctcctgggacaaacctggccagtgatgaggtggggtggggtggggcggggcttcagccgatgaaggattaggcgcgagaatacatgtaggggaatttaccacgtgggcagcgcgcccaggacccactcaggatcgggagaagactgcagaggttccacccgggccacagaggggatctctcccagttcctccagaggggactcctgctgcctgatcttgatgtgactgcccgggtccatcagggagaaccgaccctgccttttgtcaggctttccatgcaccctctctcagcatcctcccagcagccctgtgaggaaggtgctatcttccccattgttacagatgaggcgactgaggcccagcgactttgagggactagctgaggtcctgcgggtaggagaggcaataataatattcacagctgacgatggagggctcagtgctcccggcgtgtgagctcgtttaatcctcacccagccctgtgcagctgtagcatcacttcacttcagagaagaggaaatagacactggcagctttgaatgtaggtttgtctaacccagggactatccactccccaagaaacagtctctaccttaataataaacatgatagttccttatgctgttgagaagttttgtagtttagggctgggagccatggctcacgcctgtaatccctgtgctctgggaggccaaggtaagaggatcacttgagcccaggagttcgagaccagctggggcaacatagcaatacctggtccctaaaaaaaaaaacgagcagagatggtggtgtgcacctgtggtcgtagctacttgggagtttgaggcgggaggatcacttgagctgaggagttggaggctgcagtgagccatgatcgcaccactacactccagcctgggtgatggggtgagaccctgtctctaaaaaaaggaaaagcaagaaattgtgtagttcagcaagtgcctttagttagttcccctgtttatccttgactgggttctgggggaaggtaaaagacccagcgtctctgtcttacagataggggaaccgagtgagtgaatgcggatccaggatttgggccctggtcttgtcactcccaagtctggggcccttgatgctgcacagccctggtagggcctgaggctcacagaggaagagagcagcagctcacacctgccacccacccacctgcggcacagaagctgaagttactaggaagcagggaacaccacagcctgcctggccatattttacagattctagccaggccctgactcctgccttcaattccctgccctgtggaagggccatgggggccagaggtggaggggctcagaaggacctcggagaagaggtgctgggagcagatagcaggtctttggagacacacacacacacacacacacacacacacacacacacacacccttctcaggggagaaattcaaacccctcagcctttgtcagttccacaaaagcgtggctgcagctctttttgccccggcaccctatccccgaggggtggggtttgaggaggaagcacctccacgttgttccccctgcccaggatgggcagcaagtgggcagggcatgctgttggcaggggctgcttctgccccccacaggggaagccagcaccacgctctgggtttgggggctcctgtccctggcctgtgccccctgcttcccagggtcatagcctgctgggttcccgggggggcctcttgggagatgaaaatggcggtcactcttcattagggcctcactgagggccagagcgtgtccgtgtgtgtatgtgtgtgtgtgtgcgtgtgcacgcatgcacgcgtgtatgtgtgtgtgtgtgtgtgcaagcatgcacgcatgtatgcgtgtatgcctgactttgtttaatccttacagccacctgatgaaagaggggctcttattatccccatcatacagatagggaaactgaggtttacagaggctgccctgcttgtgcagagcccagggacaggggcagacatcaagtcccatgacctggccctggagcccgttgctctgaacagtgctgatggcacaggcaccgagccctgtgctcccaccctgcaggatgcaccagtcagcagcaagtaggatgggcttgttggaatgcagattcctaggccccacccaagggacttctgcttggcagctctgggtgaggcccaagaatctgcattttgactcccccgtgattctgataaggacttttggccccactttaagaagcttagagatgggtccatgggcaggagtgtaccgaccctgtttgtatgctctgaggggtgccacattagggtagggctttgcactaagggcacggctctgttcccctgaggtgggggtcctcgggggttgggggctgagggcaggataggcaggggaggaaagggtactgccctttttgcaggcctgttctgtctcccttcccaccgcccaccagctgtgtggtctgagactggcctcagactgtctttcctctcatagctttgcttcctcaccagtaaaatgaggacagcaaacccagttgcctcaagctgggggctgggcctgatgctttgaggcttggaagggctgagccggccaggctggagcagtgacgggttctggttcctgtggctgccgtgggggcagagctggagagagctgcctgcggctagcaggaagggaagggggagcctcttctgctcacccagcttcaccccacggggtcagctggcttctctccatgccccttctgggcctgccttgcccttccctgtctctgggaagctgcccaggctatttcagctttatttattttcccatctctatattggtctccaaaatggcactttgggtgtctgggacacctggagcctcccctgtggaggaggtaaccacagaactgtccagaaatgaccctctcggtggtcctgcccaggcctggctgaggcagggggctggcagctggacccccagccccccttctcacttgctgctcctatcccacccccaggctgagcagaggcagtggctttggggtgggactgagctggaggtgtctgtatggccctgagcccaggcagaagtgccaagtgccagtagactgttcttccattttttccttcatcaactcaccttgatggggtcgtgggaaattacaggggggtttctatcctcctcggatcttgtaagcagcacgggtggtagagtatcactcttacccgaactagctggcctgagattgaatctcgcatctgctgccaccagctgtgtgaccttgggcaagttgcttaacctctgtgcacagtgccttcgtctgaataatgtggattacctctctccagagggtggtgtgagataggaggatatgttaagcatttaaagattcctgacgtggagtcagcattcagtgtttgctactactgttctcccggaaaggagaggaaatggaacttggacatgaagaagctgggaaatacacacagcaaccttttgaccatgacttccagccccggccctttccatcagctctcctctccatctgtgtgtgtctaatttttttttttaatttgtatttttttgagacagggtctctctctgtctcccaggctggaatgcagtggcgtgatcttggctcattgcagccttgacttcccagactcaagcgattttctcgcctccacctcctgaatagctgggactacaggcgtgcatcaccatgcccggctaatttttgtatttttagtagagacagggtttcgtcatgttgcccaggcttgtttcaaactcctgacctcaagtgatctgcccacctcagcctcccaaagtgctgggattacaggtgtcagccaccgcgccctgcctaaattttaaaaactagtgtttcttttttgttagaaggggatgggttacaaagtatgttggcccaacacatggtaggcacataatagtggaaattgtatttcgctcaataaattttgtatttttttagagatttttattaattttttttttttttaaatagagatggggtactatgttcccaggctggtctcgaactcctgggctcgagtgatccacctgtcttggcctcctagactgctgggattacagacatgagccattttgttttttaagtccagcctaatttttgtgttttttttttagacggagttttactctgtcgcccagcctggagtacagtgtcaccatctcagctcactgcaacctccggctcccaggttcaaggaattctcctgcctcagcctcccaagtagctgggattacgcccaccacgcccggctaactttttttgtattttttttagtagagatggggtttcagcatgttaggctggtcatgaactcctgacctcaggtgatccacccacctctgcctcccaaagtggtgggattacaggcgtgagccaccgtgcctggcataatttttgtttttaagtaatgatccttcttcttatattgggtcatcaaggcagttgttttcccaattatgctgctttgtttggagattacgtgtctgcattcaattcattcatgatccaacaaatgttgatctgcacctcctgtctgctgggatgagaagcaagatagatccagggagaacaactaagaactgacagaaaaattagagtttcacggatggtggttgtttgggtgtcaggagcctcagatgtcagtcagtcctgggcctgacagcagagtttccaaaatgggagcccaggtatctcccaggagtggggtcctctgggagcccaggcatctcccagaagtggggtcctctgaccgaagcgctgagttgcatcctggcctgagcgacaactgggttgtgaccttgggcaggtcccttcctccacagggacccccacagcaccctggtgagccatcctagacaacaggggcaagcactcctgccagggcaagaagggagccctgaagaggggctctgggctgggccctccctacacccctggccccccacccttcacttctgccaccccttccatacccaaagacctttcaaagagcctccctgtcttgattatccatagtcagggtctgaaggtgctttaaaatggtcacagactccaaatgggagggattttagagatcagctagccagctcccttcaggggacccagagaggggaactgacttgcttagaaacacacagcaaggtggtgctgatcccaggctccctcccttctcagcccctacccctcacccctaccctctgtgggcctcctatgttagcagtgaaatgaatgatccttccccaacagggagggggaggcagaagcagttcccgatcctgggaacctgctgatgtcattgcagcgtcgccatggcgattattcccctggattaggggcctgacccttgcaaagccaggaagcaggggacggagtgggggactggcactcgttcagcacttcattgctgacagagcactttcacactggccctccacagtgcgctgctgctttagagccactgtctgtatcgtgggttggagtgactggcgttatggtccccattttacagatgtgggaactgagtcttgagatgtgaagtcgttggcccaagatcactcagaagtgggagactgagcctgcgttagtgctagctccgcctggctttgtgcccagacttggtgataagaagccccctccccatattatacctgatttctgtcacaactcttttacagatgaagaaactgaggccaggggcttgagatgcagggcttctgtatctggagctacatttctctgcctctgagtgccctaccttccccgatgcccgcttcccaaagggcctcccactaagagtcaccgtgctggcccagggcttccaggactgaggaagagctggtgctaggcaggttctggactcttggggtgggttggtgcctctatccactgcattcacttctgaactaatggggaacagcacatccaagcccttcttgtctggatcagaacagagaaggagagggaaccacatggatgagtgactgggggcttcaggagacaaacaaggactctgacccccacaggcatgtgcagaggacctgacaggtgtggccgtggctgcatgcgcatgcgcagtcgctccagtccaagcacagctcggtgctgctgccagatgattccctgccagggaactgcctgggtttgtgtcctgggctgacctgtgtccaggacagtgcagcccccgtggaggaaatccaagcagctggtggggtctggaacagatggctgatgaggtggacagtgaagtctctggaagccaaggaatagtttcctgttccatgagttttctcagcctcattctgttcttcaaaaccctcaggggaggacaagctgttcctcatatttcaattcctttcgtgccagggaagtcctttctgatgtctgacttgagtccctctagtactgtggtggggtggaagggttcttccctggagcttggagacctgctgagatgctgtctgacccccgctgctttcctcccctcctatggcggtggcctctgaagccatcccggcaggctcccagaatccgcggggcctgtcaaaggcgcactgatggagccttccctggggctgtctcaccaccctcctttctgggcaccaactctgtcctttggcacagccctcactcagctggttgctgaaaagctcccccaggcgtagtgggcagggccacatcctggctaacatgagggctggggccaccctgggagccctggaaagaacctttttcctataagcttccagacaggatgggcagggagtgaagggtcaggagtcaggcagatgagggtttgcactctggtagtgccggacattgactgctaagctctgtgaccttgggcaggggactttgcctttctgtggctccgtttcctgatccgtaaattggagctgttaattgcgtggctatatgtatggtgggatctaaatgagatggttcatgtaaggccctggactctgtgcctgccattcactgcgcaccaaagacttggtagtggcttattattacgagtctaacaccttttggctgaggcctctgctttgagttggggacttctgatcagggtctttctgctgactccctgtccctgtctcctgactggttgctgcctcagaggggccccaagccgaggccctttcggctcctggcctgactccaatccctcttcctcccctcctgcaggtgcgctacaaggaggagtttgagaagaacaagggcaaaggtttcagcgtagtggcagacacgcccgagctccagagaatcaagaagacccaggaccagatcagtaacgtgagctcttgccctgccctgcggcatccctgctgccctctgtttggtccccttcctgccagcctggcagacgcaagcctggcagatgtgaatgaggccagtgcctccactgcccctgccctccagggtgggcctggggaagagcttggggttcccagatgcctcttctctgtgtacccccagaccaccagcacgcatagcattttcttcttgaagggactgtattctgtgggggcctgtgtgctaaatcagcccccactctctctgactgttgttcttttttctggatatcgtgggtatcggtgaagactgcatgtctcatcttagcacaaaggtcaaaactggggggcggggagcacctggcctcccctggtctgcgcctgggtgctgacattgcagtcatttccgcccttccttggcctcctcccccacatcagcctgctcttccttcctgtgtaaaaaccccagccagcttcacccgccagccctgcaccccctggctcacaccccccgcctccctgatggtcagtggcatctggctgtggcaggggtgggcatggagagtgggcaggggatcaactgtccccagcatcgtgtgccctccatggcacctgtggccagagaacaggcctcagtttcctgcttggcagagccacaggcaagcagcctgtgtggctttaggcatgcgggggcagggcactgcggtgagcagcaaccatgggggatgcgcacacagaactgcaggggctgcccagccagcctggcctaggaggtcctgccagggagggtttaggcaggcagctgtcttcgtgtctggaacaggaagggatcagtgagctgcccattgttgctctgggctgaggaactggggatagagattgccgggggagcctggctttccggtggtctcagcacccactccctgggctccacatcccttcctaccctccacctggccacctcagcagggcgctcctttaagagcttggctgggccgtgcatagagtgggctgcagtggtgggtcaggtggatttcagaagcgcaggcagcccacagacagcagaaccagccatgcccaaaatggtggctttcaaactctgacttcagcctacagtaaaatatacattgtacgtcttgacccatctgacaggcatacatttatgtagagggaaaacagaatggaagctttcatgaatgagtacttcctacttagagggcgttcagatcttttttttttttttttgagacagagtctcactctgttgctcaggctggagtgcagtggtgctccgcctccagggttcaagtgattctcctgccttagcctcccaagtggagtagctgggattacaggtgcacaccaccacccccggccaatttttgtatttttggtagagacagggtttcaccatgttggccaggctggtcttgaacacctgacctcaggtgatgtgcccgccttggcctcccaaagtgctaagattacaggtgtgagccaccgcacccggccacattcagatcttttctaaagatgctggttgcaggcccctatacaccctcacataatacagcccctttgaggactgtattcccaacactttgggagactgaggtgggaggattgcttgagcccaggagtttgagactagcctgggcaacatagcaaaactgtttctacaaaaaaaaaaaaaaaaaaaaaaaaatacaaaaactagccaggcatgatagcacacgcctgtggtcctagctattcaggaggctgaagtgggaggatcacctgagcccagaggtttgaggttatagtgagccgtaattgcaccactgcattccagcctgggaaaccgagtgagaccctgtttccaaaaaaaaaaaggaccaggcgcggtggctcatgcctgtaatcccagcactttgagaggctgaggtgggcggatcatgaggtcaagagatcgagaccatcctggccaacatggtgaaaccccatctctactaaaaatacaaaaattagctgggcgtggtggcgtgtgcctgtaatcccagctacttgggaggctgagacagaagaaccgcttgaactcgggaggcagaggttgcagtgagtcgagatcgggccactgcactccagcctggcgacagagcaagactccatctcaaaaaaaaaccaaaaagatgctggttgcagacttactgtgaatgggttttgcaactggactgttgacctgcagtttgaagttggtggcctgaggaaatggcatgcttccctttggctagcaggggatgcctagggcgggcactctaatcctccttcccctccaacttccagaggcctgtcacagttgactctttatatgctagggcctggcctcacgccctggagcttccctttggctcagaccctgcaaagggtaagacccttaggtctgtgtttcagagctctcggcttggaaagtgggggagggggaagatggtcttagattatggggaaaacccggaatggttcacagaactggaatgtcggctcttcagcctctgcggcttttcatgtagaggctctagtcttttatcagtgacacttgctcccaatgtgcaaccccagctccctggctgttcactcattgcttcaccctgtgggttttggaggaggggagacaagcccagtcatccctgcttccctttctggaaggcttccagaacactccacactcagcctaagccacctcctcttcttccctcccccagttagaggtgttaatatcctagtgacaaaactcaccaccctggccaagccatccgcatctcaggagataaccatcttttacccttctcgcggtgctgcagtgagctaatggtcctctgcaggagctgggggaagggatcgaccccgacctgctagctgcttttgcagctttagcagagacctgtagggtgtgaatgcaaagcctggagactcttggttttaatgaaagcaattacagtctgtcggatatgggcctccagacagctgtagcacagtcacctgtagggttgactgaaaatgcagactcacaggccttctcccctggctgccagaatcagcgtctctgggagtggggcccaggaatcagcatgttagacacattccctgggtttctgtggtgctctctgaagtttgagagccaccacctaaaagtctgaaaaagcttcaccaacccctaagtcagagggtgccagatcaggctgtacctcagaaccccaggggagctttatttttatttttatttttttgagacggagccttggtttatcacccaggctggagtgcagtggcgcaatctcggctcactgcaacctccgcctcccgggttcacgccattctgctgcctcagcctcgtgagtagctgggactacaggcgcccgccaccacgcccggctaatagtttttgtatttttagtagagatggggtttcgccgtgttagccaggatgatcttgatctcctgaccttgtgatccacccgcctcggcctcccaaagtgctgggattacaggcgtgagacaccgagcccagcctatttttatttttgagagagggtttcgctccgtcatccgggctggagtgcggtggtgtgttcacggctcagtgcagcctgaatcttctgggatcaagccattctcccacctcagactccgagtagctgggaccacaggtgtgcaccaccatgcccagctaatttttcttttttttgcagagacactatcttgctatgttgcccaggctggtctcaaactcctggattcaagttatcctcccgcctcagcctcctaaagtgctgggattataggggtgagccacctcacctggcctcccaggggagcttttttttttttttttttttttaatcagagacagggtctcactatgttgtcttaaactcctggactcaagtgatccgcccacctcggcctcccaaagttctgggactactacaggcatgagccactgcgcctgggagctttaaaccacacataaaaccattgctaagttgtcccaacctcctgaagtgttttggaaaatagggtgtttagagccacaccttttgttttgtatccaaaatagcattcctgttcctgtatgtagcttgttgctttgcttcccagattagcaccaaatgactccagttactttatttatttatttttaattttagttttattttatttttgagatagagtctcgctctgtcgcccaggctggagtgcagtggcgtgatcttggctcactgcaacctctgcctcccgggttgaagcgattcttctgcctcagccttctgagtagctaggactataggcacatgccaccacgcctggctaatttttgtatttttagtagacacagggttttgccatattggctcggctggtctcgaactcctgacctcaggtgatccacctgccttggcctcccaaggtgctgggattacaggtgtgagccactgtgcccagctgactccagttatttctaaaggtcaggccatcttacaaaagaatgaggatatgcttccttggagggatatgctgcagactagggctttttaccagccagagcattttaaaaacaagtgtctgatctcctctggggtgtctgctttggataagtgcagtctgtcttcagtcttgctaagtggtgagacagtgaggtaggaagagatggtaagggcccagatcctagcttctgtcattctggggccaggcagggctctttgagcctcagtttcctcatttgtaaaaatgggacagtaggccctactttgacaggtggttgcaaggaacatgccaagtgcttggcatgggataaatgatatcactcttattatcatcattattatttttgagacaagattgcccaggctggagtacagtggcacgatcataggtcactgcagcctcgaactcttgggcacaagtggtcctctcccgtcaacctcctgagtagctggtactacaggcatatagcaccatgcccagctaattgttattttttttgtagagagagggtcttgctatgctgcccaggctggagtgtagtcacgtgatcacagctcactgcagccttgaactcctgggtttaagtgaaccctggcctaagactcccaggttgctgggattacaggcacacgccatcacacccagttatgttgtcaatgttatcaatactttaaaggcacacttgtctgctttctacactgttgccggagaagggtcataaagtgaagtttggcagaaaagtttggccattgtctagtactgagaatgtgtggaagtgaggaaaggggccagtatattacacatctatggtgagtagttgtgtcatcattaaaggcatctgaagagttgccttttgatgggtccatgctatgggataaaggttacatgttaggaatcctggccttttgtcatgagctctagcagtgttcaagtatggaaaactttagtcactttactggagcctcttcttttatttacttacatattgattttctgtatacaattttgtgtccttaaaactttttttatgtgtgaaatatgacacatagtaacatatacaataaacacctgtttcaccaggcaggtataccatacattgtattactgtatgcctgtcaagagcccagtgttcacagtgttaaaaatataactcccatgtagtaagtacttatcatatctttatttaattatgagggaaccagctagagattaaaactggggaatatgagaggcagaggtaaatgctagtctgtgaaagaaagtgctggggccgggcgaggtggctcatatctgtaaccccagcactttgggaggccgaagcgggcagatcacctgaggtctggagttcaagaccagcctggccagcatggtgaaaccctgtctctactaaaaatacaaaaattagccaggtgtggtggtgcacacctgtagtcccagttacttgggaagctgaggcaggacaattgcttgaacccgggaagtggaggttgcagtgagctgagactacaccactgcactccagcctgggcaacagagcaagactccgtctcaaaaataaaaaaaaaaaaaggaaaaaagagagtactggatacatttagctacagaaatggttaagggcctaccattagttacacattggctattgtcctacaggaaaataaaaccataaactttgaagatatctttgctgcaggcagaaatgctttgcatctcagttggccagaaataatgagcattttatattctgtaatgagcttcagtctttagagtctgggcctaatcaatagtaaatagtcaaacaaagttttgtccccagagtaaaatactctgaaggcaggtttgttggacaatcctctagtttgattttgaaagcatgtatttttcattataattttagtatgtaattatgtattcttaaacactatagttttgcttttcctgattttgaacacagagtaattttgtgtatcttgcttctcttacacaccattgggtttaaagattcatccatatgtttgtgtgtagcggtagtacatcctttttcattgctatatagtattccattgtttgtttataccacattttattgattctgttgctggtggacatttgtactgtttccagttgctatggacatttttgtacatatctcctgaggtctatgtacattggaactgctgcatcttagaatgtgtgctccttgggccgggccgtggtggttcacacctgtaatcccagcactttgggagaccgaagtgggtggatcatgaggtcaagagatcaagaccatcctggctaacacagtgaaaccccgtctcaactaaaaatacaaaaaattagccgggcgtggtggcgcactcggtggcgcaatcccagctgctctggaggctgaggcaggagaatcactgaacctgggaggcagaggatgcagtgagttgagatcgcaccactgcattccagcctgggcgacagagtgagactccatctcaaaaaaaaaaaaaaaaaaagtgtgctccttcaactttacgagataatgcggaactattttccaagtggctgcactgatttaccctcccaccagcagagatgagtttcatttgctccatgtgctcagatatgttcactttagcattttgatcgtgtagagtgtgatagccgatggttttagattgcatttctgtgattactaatgaagttgagtacagacttttgtttgttttaaaaataaaatactggggcatggtgggctcacgcctgtatcctaacagtttgggaggctgtggtgggaggattgcttgaggccaggagtttaagacttgcctgggcaacatagcaagataccatctctacaaaaaaaagaaagaaaattagccgtgcatggtggcatccacctgtagtcccagctactcgagcggctgaggtggtaagattgcttgagcccaggagtttgaggctgcagtgagccatgatcacgccaccgcactccagccttggtgacagagcgagaccctgtctctaaaaaataaataaataaaatattgtgagtctctaatggggagcagtattgcatggtggttgagaactgaggctctgatgttagaactggattctgacttaacccactgtttgcccacatcttgagccttggtttccctatctgtaaaatggcagtattctcgggctggctgaggaaaggaaatgaggccaggcgcggtggctcaggcctgtaatcccagcactttggcaggctgaggcaggtggatgatttgaggccaggagtttgagatcagcctgaccaacatggcaaacccccgcgtccactaaaaatagaaaaaaatagctgggcatggtggtgcacccctgtagtctcagctacttgggagacagaagcaggagaattggttgaacttggaaggtggaggttgcagtgagctgagatcgcaccactgcactccatcctgggcgacagagcaagactgtctcaaaataaataaataaataaataaataaagttaaaaaagaaaaggaaatgagtaatgcatgtaagggcacccaaaaaaagaccctagctggtgagctgatgattccacccagagcctgctgttccctcgttcactgtgatgtataatcatgtgaggagcaccgtatggagagtcagacttttattttccaccacagttgggagagcaggggggtcagaaaacagaacatcagctagcagagctttgtcatggaccctaacttgtcatcctggagtcccagctagtagggtcctggctgagtcgggagggtccttaggcctggacccctgaacccacatgtacttggacctcatgggcacaggtagagtgtggcctgtgtccacagaggcccaggacagcttccaggctgggggctgtgctgacatgtctgggcttagggcgctcctcactcagggctctctgaaggccagaactttgcagagcttggagcagggatgagccaggcccttggaagctgggaaatgtttccttgccttctgaatgtgctaacatccccctcatgtgcctatttgcttaacaaaccagtaggtgggtcaggaaagtaataacacaatttcctcatttgctggcgaggggaaggagaggaagctgagggtttggaaattttatccaagtgggcccaggctggaaggcgctgagcctcactttttctcagcccatttagccgctctgtgccgcctgtcctgagttgcatgcctggtgtccctctctctcgagttagggtgactttctgattatcattcttgttgagagtgaaaaggggtgcattgaaatttatccctgagcagcagacatgaactgggacttgggcgtgtggtcaccctgctccacacctgttctcaggaaagggcctgtctagctgtgattttgtccttgtgtcaccagccttggctgttactgagcaatgaaagctctgcctcgggaagtcatttaatttctgagcctcatgttcctcttctggaagatgggaatgaaagtgtgcgtgtccggcccattttttagggcaatgattgtcagggtatgaagagcttggtcaagctgtgtgaagagctgtacagctgcagaggttgttaacattgatagagccacccaggaagggtgtcctgggttcaggcagctactcctccagccgtcgggtcagccagccgtaactttagatacacttatccatgtgtaatgactttttaagaagcaagatcagtttccccagccctttatgggaatacccatgtgtccatacttgctttcagcttagagtttgctcaggttcctagagctggtcagggtttgcaggaccgcctgggagcagatggtaccatggccttatttacagatgaggaaactgagacccagaggggaaagtgactcccaaggtcatgtaggtaagcatacggctcccctaaggatgaggcattggtctggtgacagtgcagcccatcataagggactgagcctgtggggtccagacctgctctcctcccagaggaaaaggctccctgtcaccccatcactaatgcagatagcgtcatgtccagggaagctgtcacacattcatctgggcccccaacatcaaggacacctgtccctgcaggccccctgctggcaccttcggggcccagggcaggcccctgtccattccgtgtctgcacttccctccctggtcacaggttctcaggggcaggctcttttccttagcagaaaggaaacaagggaagctgacctttcccacctcagaacaaaagttggaagggcaggtgcctcgtgagcctggaggcctcaggaggggtgtccccttcccttgtgccctccccgccaccaacaccagtggacaggggtcactaagagagtggggctcgggagactcaccttctgcgctgggtctgtgagaacatcacctggagtgcccctcccagcggatgctggggtcggttggattttcagcctggccagggttggctgcctcacctcaggaacaggcttagcctgtgctgccacgtgggtgccggtccttgctctggcctgaagggagggggccgggaaaggagggactgatcctgacccaaacccctaagtaaactgccctctgcgtccagactggactcctcccagactctgtccaggcccttaccactgccctccctgtgcccccagcccgggctgcaggaactactggctgttcagccagcaggagcagcaaccatgcaggtgtttccagctgttaacgtgtaagccctgcctggccacgtgcttgctcttgccttttgtgcacagccagtgccaagggggagaggaggcagcagagacgttgtgcggaggggatgcccaaaggggactgcccaggctgggacagccctgatggggcaggggcgttccaggaaacagcaggttttgcctctcctcctcttcccaccccactactcccaccccattttcccggatcaggaaaaggcaggccagcattctagggaacaggaagtgaagttggcttccagctaggtgcctgccagggcctggaggaaattcctgcaggcctgagcccgtctgggaaggaccagtttctctccttgtcctggtgtcctgctttctgagtttcccctgagggtgggggagagctgtcactctcttcactctatgtcccgcttcctcccccatcctcatggagcactcaaaccctgagccctcacacctttctatggttgtacccgtccccaccagtttcctctctggaaagtgaagaggaggctgggcacggtggctcacggctgtaatcccagcactttgggaggccgaggtgggcagatcacaaggtcaagaagttcaagaccagcctggccaacacggtaaaagcccgtctctactaaaaatacaaaaattagccgggcgtggtggcagttgcctgtaatcccagctactcaggaggctgaggcaggagcatcacttgaacccgggaggcagagggtgcagtaagccgagactgtgtcactgcactccagcctgggcgacagagcgagactccatctcaaaaaaaaaaaagaaagaaaagtgaagaggatagagcccactaggggtcatcaaggtgtgggacaggcagcatgttcctacaggaagaaaactctaactcctggttctggttctttttcatctcattcattcattcattcattcattcattcatttgttttgagatggactcactctgtctcccaggctggagtacagtggctcgatctcagctcactgcaatctccgtctcctgggttcaagtgattctcatgactcggcttcccaagtagctgggattacaggtgcccaccaccatgcctgattaagttttgtattttcagtagagacagggtttcactgtgttggccaggctagtcttgaactcctgacttcaagcaatctgccaacctcgacctcccaaagtgctgggattaaaggtgtgagccaccgcacctggccatctcatactttcacaattcattctttggtgcaagttttacaatatacattctatatttgtcaagtgataacttccatgtaacttataaaatacacataattcaggaagattgtgctaaaatacatttaaccaataggagtatgccgtcagaatattttggcaaacaagggtcactaagttttttctgtaaagggccaggtaggaggtatctcaggctttgtggccatatggcctctgtggcagcagctcagttctgcagttctgccatgaaagcagccacagataagaggtaattgagtgggtgtggctgtgttccaataaaactttatttctggaggctgaaatttgaatttcagagaaatttcatgtgtcatgaaatattattcctcttttggttcttcttccccccctccaccgccccctgccaagcattaaagaatgtggaacccgttcttagcagccggctgtgggctggatttggtccatggaccatagattcccagcttctgctctagaccacccgttctcagacttgaagcctgcttcagacttacctggagagcttttttccaaaatgcatattccagaaccccagccctgattttgtagattttctggaaggccccagaacccgcattctaacaaggagcccagttgagtcagacacaggtagtctggagtccacttttttttttttttttttttttaaacagagtctcagtctgttgcccaggatgcagtgcaatggcgtgatcttggctcactgcgacctctgcctccaaggttcaagcaattctcgtgcctcagccttccgagtagctgggatcacaggtgcctgccatcatgcccagctaatttttgtattttcagtagagacagggtttcaccatgttggccaggctggtctcaaactcctgacctcaggtgatccaccagcctcagcctcccaaagtgctgggattacaggcgtgagccaccgcgcccggccaggagaccacatgttaagaagcaaagctcaagggtctccaggatcctggtctgttctcttcagccagtcctgaggcctggggtgtgtagtgctgtgggagacccctgcatcagaataactggctccttcactaccttccaggagcttccatccagtgggggtgggggacaccacccgccaacagcacagcccagtcccaggtgctatggaagccctgggttcagcctggagccagggccagcgtcccgaggatgaggtgccgagatggaccttgaaggatgagagaagcctggactgcccttgagtggcgagggtgggctgcctccaggttgaccttaatcccttccctccctaccaccatgtgtccagatgaccttgggcaggtcccttagcctctctggatatcgggatatgacattgacttacctcagagacttgtggggaggattcggcgagctgatatgcatgaagtgtatcaactagggctgctggctggtatctccttcccttgtcttcccccaccaccccagccaggggacagggtgctgctgagggagtgggctgggagagtcacttctggccttgtcttagggatctgagaacagggcatgggccccgtgtctgggagtgccctggtgcccttcctagtggggttgggcgtggtcagtctggccagggctggctccctcccccataaataggctcacctggaggtcttttcccatttgaggcaatgagatatgtatgtgaggctttatgacttgtcttttttttttcattttgagacagagtcacggagtctcactctgtcacccaggctggagtatagtggcatgatcttggctcaccgcaacctctgcctcccaggttcaagctatccttttgcctcagcctcccgcgtagctgggattataggcgcccgtcaccacacccagctaatttttgtagttttagtagagacagggtttcaccaagttggccaggctggtctcgaactcctgacctcaagtgacccacccaccttggcctcccaaagttctgggattacaggcgtgatccaccgtgctcggcctcaccacccacctttcttgtggtgtagttcttgctgcctcaagaactacatatatcaggcctcaaaacccacctgatatatgcgtgcctgggaatagggaccttgacttttcccctgtcccatatgggcccaggggccggttctgggctggcccaggtggggctagagcagctggatccaggcacatgagatgtgaaagtgtgggccttacgccgcatggagcggctggaggaaggagagagggagcaagggtgccgcagggtcagattgccacagggccagggtgccacagggtcagggtagggccagggtgccatagggtcagagtagggccagggtgccacagggtcagggtagggccagggtgccgctgggccagggtgccgcaggatctggttgccacagggtcagggtgccgcaagcacaaggagtcacccgtgattctccagggtctggctcttgggctgagatccaggagaccttggcaggcctgtctttgggagtctggcacagccccagaaggccatctggacagttttcagacctgagaggaggaaagggcttgtgtctggagaaggtgccatggggtatgggaggtggaggaagcctggggccaatcaggatctggatctagcagggaacaccgaggccggtgttctcgtcccaccatgggactcagcctgaagaagacaaggtgaatgaacgaccatttctctctaactcagttggctaagaggactgagctggcgccgaggctctggacacaaatgggccagttgaccctgaggtttctttctggtagtggaggtggggcttcctctggctgaccctgcttaggtctctgatggaggtagcaggggctctggttcccccaaactggccaagtcctccaccatagcacccaaggggtctgggcagagtgcagcttccctcccctccccagcttggcttggtgggcacctgcctcccctgccctcctgaccttgatggctaatgcagccagccccaggcaggcacagtcacagccctcaaacaacatgaggcccaactcaagactcctgggtggtggtggtcaaggtgggggactctgtagccagtagagcactgtgggggcaagagactgacttgaaggcttggagcctcacatgcccgcctagtggggtggtcctgagggatatgacttctttgggcctctctgctcatttttggaacctgacccgagaaggagcccatccaagacaatgtcccgccctcagggagggtctggcagtttttatccctaaaggctgggattctcagcggagcatcctaggctgtagtacccacgacatcttgcacacaagaggtggaatcgcctgttgatgaagagcaaggctctggaatctgtgatcttgggccactcacttcacttatcaatcccttcgcttccttcttgcctgttacatggggtctgcaatctacccctcaggggcgctgacgagctcacatgagcctgtgacataaaacacctagcacggccctggcgcagtaagagctcaggaaacgggctgctgctgtggttactgtggacccaggcggaaacagagcagccccgcccctgccgcaggcatataaaagtgaccacttggccggtcacggtggctcacgcctgtaatcccagcactttgggaggccgaggcgggtggatcacctgaggtcaggagtttgagaccagcctggtcaacatgatgaaaccctgtctctactaaaaatacaaaaaattagctgggcgtagtggcaggcgcctgtaatcccagccgcccaggaggctgaggcaggagaatcacttgaaccctggaggtggaggttgcggtgagctgagatcgtaccattgcactccagcctgggcgacagagccaaactccgtctcgaaaaaaaaaaaaaaagaaaagggaccactcactttggtctgattcttcagttctcatggtccttttacatcggtcatttcattgcattctccaacagtgtctgagggagactggtgtctcattttgcagaggtgaaaactgaggcttggcaagattaggtagcttgtccaaggacacacagctggtgcttccagagcgagacctggctttctgtacccaaagctcttgggtagtctctcccatcctgggatcttgagggtcacgggaaggaactgggtggtttgcagtgggacccttcacctagtgccttctgaccttgcagataaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccgggtgagtgcgggtcctgttggtgcagatgacctgaggcgaggccagtggggtggggaggaagccaggagaagacagacagacagatacaccttccggagccttgctcttaatcaacaggcgattatgcctcttgtgtgcaagaggggaccagaggacctgaggccgggccagctggggtggggaggaagtcggcgagagacagacacacacacacacacacacacacacacacacatgcacgcacgcatgcaggcgtggaaaggactgcttcccaagaccccaagttccattctcatccagaatgaggacgtgagcaccagggtcaggcctgtactgggccaagaggattgaaaggagaggcccccaggtcatggggctcagagcccctgcgtgggatacaacacacaggcaaatgtgcacacgtggacatcagcctttgagctgtggggcttgagctaggttgggggcggggtggaagtgcatggtatggacttctcgggagctctgggaggggctgggtttggcaggacagtttccaagccctgtctcctcccatcttccagtttaccagcagccccagcagcagccggtggcccagtcctatggtggctacaaggagcctgcagccccagtctccatacagcgcagcgccccaggtggtggcggggtgagtaaccctggccggaggggagaggccagaggcagggggtccttcgggaaggcttggacacagctcatggattctcctgacctttgcacccaccctctgttgtgtgtgatgataaggatctcagccttgtgagcagagaggaaattggttggcgtagtgggcagaggctggctgggactggggccctgcgttccagccctggtgtaccatgggcaggttgctcaccctgctttgggtggggtttccttaccccagctacctgggaacacacaaggcaactttctgcatggggccttccagcactgggcgctgctctcctcgcttcatgaggatggcccccacatccttcagctctcaggctgcccctgcctctgaggggcctccccagccatgtcgtgtaaagcgcatcaccctgatgctttgcatcactcgactccgctggctgccttcagagcactttttccaactaaaaagagctcttcgtgttggtcaccttctctgtgtcccctgctgggctggggaccctggcagcgtccgtctggttcacctactctgagccaggcctagagcaagtgaataagcccagcaggaacggggtgagatcaggcttcctgagccctcagagctgaagtcccggctctgtaagtcctgccactcactccacccatgggtgccgctgagccacccttaccaagctcctggcaggctcagcgcctccaggctgggtgcctgggaattcaaagtagctcacgtaggagcagaacagatacttagagagataaaatcgcctgagataatggctggctggagtctgatgctctgggcacacaaacaaagggatgttaggactgcccagggcactgtgggcgcaagagttagtctgaagtataaggttccaggcagcccagccagtccctccctcctcaatgggtctgtcctggatgtgtagggtccatctctgaatataaagccacctctctgccctctgggggcttacattccagtcagggggacaaacaagaaaacaataagaaaataggtgtataacataaggtcagcggtgacacgctgtgaagagaaagacagcagggtgagggatggatagaaagcagctggattaagacatttggccgggggtggtggctcacgcctgtaatcccagcactttgggaggccaaggcgggcaggtcacttgaggtcaggagttcgagatcagcctggccaacatggtgaaaccccctgtctaccaaaaatacaaaaattagccaggtgtggtggtgtatgcctgtaacctgtaatcccagctactcgggaggctgaggcagtagaattgcttgaacccgagaggcagaggttgcagtgagccaagattgcactattgcactccagcctgggtgacagagcaatatctccaaagaaaaaagacatttggccgggtgcgatggctcacacctgtaatcccagcactttgggaggccaaagtgggcagatcacctgaggtcaggagttcgaaaccagcctggccaacatggtgaaaccctgtctctactaaaaatataaaattagctcggcatggtggtgcatgttcataatcccagctactcgggaggctgaggcaggagaattgcttgaacctgggaggtggaggttgcagtgagccgagatcacgccatttgcactccagcctgggcagcaagagcaaaactccagctagaaaaaaaaaaagaaaaaaaagacgtgacatttgagcaaagtcctcaataaaggaaggagtgagccgtgcaacgaggacaggaagtgcaaaggctctgaggcaggaatattctaggaaagttcagggagcagcaggaagcccgaattgactagagtgggagagggtgggaggtccgattatgcagggacttgtgggccccaggaaggcctctgtgacctgtgatctgtgcagagcgacataggtttttggaagaccaccctggcagctgtgttgagaagaggcagtggtttgagggtagaagcagggagaccgtcaggaggctgttgcaggatataggcatggatgggagtggctcagcccaagatagaggcagaattggtgatgagagagactgaggttacttcatgggaggtgtaacttcttatcccatagacctgttggtttcaaactgtcctgtggagcctcagagaccagtcaagggcagtgaaggtcaggggaggtagaatgttgtctatagctataggatttatttttcttttttttttcctctttctttttttaaactccatcctggtagtaggtggcgctgtaggtttttgtgtgccttactgaacattacctagatctagggcttaagcggcagattttggctgaggcttggaaggtggaacctgatagactcgtcttctgtcctctgaagatttttctcccaaggaaagatctttgtcctgaacttggacaggactcatcatggcttctaaaagaaactactggtgcttataatcatacaaataatagcatacagggcatgttttttctgttttttttttcttttttgagacagggtcttgctctgctgcccaggctggagtgcagcagtggtgcaatcacagctagctcactgcagccttaacctcctgggttgaagccatcctcccacctcagcctcctgagtagctgagactacaggcatgtaccactaagcctaactaattttttattttttgttgagatgggctcacgctagtactttgggaggccgaggcgagcggatcacttgagaccaggagtttgagaccatcgtagccaacatgatgaaaccctgtctctacaaaaaagtacaaaaattagccgggcatggtggtacacgcctatagtcccagctacttgggaggctgaggcaggagaatcgcttgaacccgggaggcggatgttgcagtgagccaagatcacaccattgcactccagcttgggtgacaaagcaagactccatctcaaaaaaaaaaaaaaaaagagggagttggggggtcttactgtgtttcccaggctgatttcaaacttctgggctcaagcagttctcctgccttggcctcccacagtgctgggattacaggcgtgagccactgcacctggcctgcatgtcgtatttttagacattactctgtcatcatggctggtggaccttactgcagtcctgttcagggaggtggggcagagctgatgtgacccggtccctgctctgcctctggcccttagtagctgccaaaggttgtaaaagatcgattgctctcagaaagcaagacacagaggttaagaatctttgcagcagagcctggtgctccatttctgagttcactgctcccccaggctctgctccagggtcgtggagagttagaaaaaaatgctcagacccaggtgagccggcatgcagggccctaggctgaccacacttcccccacagaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggagggcgaggcccgtggggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagagaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtagaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcggacttggtttcctctctggctctgagctgctgttgtgtgtgtctgtgtgtgggtgtgtgtctctagctgtaaggtgctgctgtgtgtgtgtgtgtctagctgtaaggtgccactgtgtgtgtgtgtgtgtgtgtgtcctgtctgcttgggggcactggcctgtggccctcctgggacctctgctgcccctcggggagagaatgacttgtctggatgccaagggggagtttgctgctgtctgtcaggcccttggcccctacttcctccttgctgagaactccccaccaacctacttctggctttccacccgctcattcctctctgcccaacttggtgatgctcccggaagcttccctgagctccgtctcgtattactgtgtcacttcctcagtgacatatctgtctccccactagccagagcccttggggcaggtgatgagtctaattcatctctaaatcccgggtacctgcccaggagcggtgcggagctgttgaattaatgaatgagcttggctggggagcagttctagcactctgccgctgccaggcagagagcaggagctccacgcatttgaggaacgagatgacagggcattccacagtgggacgggacctggataaagctgtctgtaaggtggcctggcaacccaaagcactattcacagtgccttctgaatgtaatctttaatacacatcccctttcttccttcttcctcacaaccctgtgagagaagtaactacttatagaggggctcactgaaacccagaaaggcaaagcagattggtggcagtcacagctagtggcagagtggggcctgagacccccatgtgatgctcacagtctggtgctgtgccacctggccatggcaggccgcgtgcctgtgtctgtggcagctcttagatgtgtgtctcctgggctccatgttttgctccaggtgcccagggtctgtgactggccagaaggccaggcggcctcccctcttgctcattgggcttgggaagaggacagtggtagagaggggaatctggccctgctcagtgctgccaatcagcctcaggtccagctgcttgaggggcatttctctcttggggctcagaactaaggaattctccagcctcagaatcacagcagggtggagaggaggagggctctcctgagctgagcatttgtaatctggagaatgacatggccagagtcagctgagctggggcaatgtggggagcatccaaggcggccctgggtggtataattagagacagcactgacacctgctcccctccaggggtgcaggcagcccaatactttcccaatagaagggaattagttggcaaagcttgcctcatgtcggcctgccccactccccgggaggcttcattcaccttcagatctatttgatggaacagtgctttgggggacattgctgccaagtctccactccctgctcacagaaagctctgcctcctggaaatgggccaatgggaggagtttctggatttccttctggcagtggcctaagttcctgaggtcttgcattatgagggggttaccaatatatcttaaccccaggcctttaaaaaaaatattatttggggtgggggccaaggagactaggcctcagagacgtcctagggaatgatttaatttaatagaaaataattgaggcttataaaaaggcacaaaaatcctggctaacacagtgaaaccccgtctatactaaaaatacaaaaaataagctgggcgcggtggcgggtgcctgtagtcccagctactcgggaggctgaggcaggagaatggcgtgaacccgggaggcagagcttgcactgagctgagatcgtgccactgcactccagcctgggtgacagagcaagactccgtctaagaataaataaataaataaataaataaataaataaataaataaaaagaataaaataattctcttttccccctcagaagaaaccacttgaattttttaaatttcagggatacccct

SEQ ID NO: 12564 - DNA, 90428 bp, Human
  misc_feature (1)...(90428): n = A,T,C or G
catgataaaatatgcagttatttaaacccttagaataaactcaaaattcaccgccattattcactttggatgctaataacagaatgtagacatagagtagctgttgcccagtttcatggtctacttgtcccagtcaacctgaggatagtacagcataaataggtaaatttgtgcttgaccttgtgatcctacatatggcaggctgtcttagtccctttagtgttgctagaaaggaatacccaaagctggataatttagaaatagaaaaggtttttcggcttatggttctgatgtctggaaaagttcaagactgagcatctgcatctgatggtagcctaagactgcttctactcatgccagaaggcaaaggagagctggtgtgtgcagagattacatggccagagaggacgcaaaagaagaaaggaagtgcgacgttctttttaaccagctctggtggaaataaagagaactcatttaccctctccccagggaggacattaatctattcctgaaggaaccacctccatgacccaacactgcccattagtccccacctccaacattggggatcaaatttcaacaggaggtttaggggaacaaacatctaaattacagcacaggccaaccacatgcatgcattaccaatcacgtaaataattttgaagttaaatgcagaaaactgcaaacttttgaggctgatatccagggccaggattaaaataaaaagtattaatgccttaaacagtatttactgaccatctaccctactgcaaggccctagggagaaactgaacagacatggttactgattcaacggagtttacaatctaggtagacatacaggcaaaccatttcaatagctcggatggagaaaacacctgtgctccaaggaaggtacctaactgagcaagcttccctgaggagcgatcctaaactgtgccacaaagatggttaagaagagatgaggcggctgggcgtggtggctcacgcctgtaatcccagcactttgggaggccgaggctggcgaatcacgaggtcaagagatcgagaccatcctggtgaaaccccgtcactgctaaaaatacaaaaacattagctgggcgtggtggtacatgcctgtaatcccagctactcgggaggctgaggcaggagaatagcttgaacccggaggcggaggttgcagtgagccgagatcgtgccactgcactccaccctggcgacagagcgaaactcgtttcaaaaaaaaaaaaaaaagaggcaggttacggcgcgggggcggggaagggggcctgcagcaccggcgaggggaagaaccaacttactgatgcctcagccagtggctggagccctaagaatggacagacctggctccgaaggtcctcttcataacactactgccgccaagaatgtaagctgcccaagcacgaggacacttttagagggccctcagactcagcttcttttggtctgtgcctcaaattaagcacatgtcttacatttctcccaggtcccaattttcaggtctgcttttctttgtttttctttgtcgctccccgctcctaagaaccttcggctgggatgacattcttcaggtgcagaaaccagggggaagctcccagagcagtgggggctgaactcaggacacagtcatttttgctgttaagtctctcctgcggcgctgaggaggcaggctcaaagtaaccaaccagagcagccgcagagggaaaagctaagacagttctggtccggcccagcgcttctcaccctctagctctctactctccgccgcgcagcctccgctccctccacatcaggcacggcgcttgattgacatgagggcccgcccaatcccagtgcggcagagaccgttgtcgcgtcagggaccggggaagggggcgactgaacctatcagattgggtccagagtgggtttcctgcccgcgcggatccgcctgcccaccgcgcgtgccccgcctctctcccaagagctacgcggcggcggcggagcgcaggcctcgtgccgttacggccatcacggcggccgcagtggcgtcctggagccctcctcaggtgagctggagctgcccggctcggcagcgggaaggtgagacggccttgttggcaggcagacacacacacaccccccttcagtccgctgtccgtccatacagcctgttactcgctgcgtcgcttcctcttctcgcgctgagttagccccgggggcgccgtctgcaggctcggagccgagccggagggggcgcggaggctgctcggagggtccagacttctgcaccgggattccgcgagaccctcgggccgttgccccagggagcgtgaccccgcggcctccttgtcagcccctggagcgctgtgtcgggctgagagcccgggcggccgcccgtgcgagcctgggaggtcgagtgtgcggcgcgctggttgacttgtctgttttctcatgaaaaagtccttttgccagctgtggcgtaatccgaggccgggaaggtagggacgtggtaggaggaagggcgctctcacctccagcccgagaggaggggaggcgtcagcctgcgcggtgctgcgggtggacatcttcgggacgcgccctctcccctccccccacccaccggccgttttctagtctggggctgtgactttaatggtctggacctgcttcagattcgtacgcgagttgctggggctgtgaacttttgacttgagttgtaatatgtttggtaaaacaaaaaaccatttcgataggttttgtaacctttcttctgtattaacatacaagttaaattcgccgttagaagctcaggaagctgggttttgttcaggggtgaggacgtaaccgtaggaacgctctcggtgtcaaactgatggacccggagtcacctgaaaataattatgcacgttagattaggtaagaagccctagaaattaggaaagaattaggttaaagagaatttcctaactcctctttgggtagggagcaaagcagctcaatgtcctcccaaaacgggtgttgccaaaaggtactcatttttaaaattttactttgatagacgtatgacaaaccaactataacgatttcttcagcacctggaaaccagtgtgcctagactctcagccttcggcgaggtcacacagtaaacggagaaataacctaagaagaaagttttgtttggtaattgtcaataatattcgttcttttctttttaaaacacttaattttcttgtggggggtggagtctgtgatattcttaaataggcatcccattcacaacttgatagtaatatgcactggttgataaatggtgctttcttttcatcttgaccacaaactctgagacttctttgggaaaattgtgatctgtggaaattggctgtaatatccataaacatagtttgcagagtgttcacatctactcagctgttggctcatgtattaaattttaaaatgtgtacttatttttctaggcattatcttttgtccaggttttgacagtgctttcaggtccatctaaataaaatttgaaacctacgtgtaatgttttgttcgatactgagggagtccaggcggggtagctcaaacctgtaatcccagcactttgggaggctgaggcgggcggatcacgaggtcaggagattgaaaccaccctagcagacacggtgaaaccccgtctctactaaaaatacaaaaaagtagccgggcgtggtggcgggcgcctatagtcccagctactcgggaggctgaggcaggagaatggcgtgaacccgggaggcggagcttgcagtgagccgagatcgcgccactgcactccagcctgggcgacagagcgagactccgtctcaaaaaaataaataaaatgtgtatttatttttctaggcattatcctttgtccaggtttctgcagtgctttcaggtccatctaaataaaatttgaaacctacgtgtaatgttggccgggctcggtggctcacgcctgtaatcccagcactttgggaggccgaggcaggcggatcacgaggtcaggagatcgagaccagcctggccaacacggtgaaaccgcgtctctactgaaaatacaaaaattatccgggcgtggtggcacgcacctgtaatcccagctactcgggagtctgaggcaggagaattgcatgaacccgggagtcggaggttgcagtgagccaagatcgccactgcactccagcctggcaacagagcaagattccgtcacacacacacaaaaaaaaaacagaaacaaaaaaaacctatgtgtaatgttttgttagatactgagggagaccaggcggggtagttcaagcctgtaatcccagcactgggaggccaaggcgggaggatagctggaggccaggagtttgagatcagcctaagcaatgtagtgatacccgtaaataatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttggcaaggctggtctcgaactcctgacctcaagcaatctgcccacctccgcctcccaaagtgctgagattacaggtgtgcgccactgtgcctggcctatattcatttttcaaaaattttctagagttttacattttcattgctttgtacttttactttgtcttattttactttttcaccatgtgtttttcaaagctgaaggtatatttgatgtgattattataaatcacttgtcaggaagacttgacttaatgaatacagatacagttcatttttaaaatcatggtttaataatttttagaatttacctttataatatagaaaaataccaaatgttctttatctgcactagaaaattaaatgattatttcattaataagtaaaattgaagggaacttttgaaatcactgagcagttaacaaattctctataaatactgtgatgttaggaagacaacaaggctaaatatgacatttaaagatttaaggaaactttatgtctggctgatcctcaccttaaactctaatgaagatagaatttatagtcttcccttcaaaactgattccatatgctgactttgttttggtgacattaccatgctttcaattacccagacacaaactttggttttatctctatgcgcgtaacaatattggctgatttttgccagccatttttatctttgaactactcactagcctttaattgggttttttgcttgatttttctctctacttagtatgtcttcctaaatcttagaattatgcttcaaacacatccttcacttttcggaaaccagtgataactctctgttatcttcagagtatagttcagaattcatagcctaataacagtctgctcaaacctgtttttctggggccagcactatttctttctttttttttaatcagtgccagcactatttctttataggagctgtccactctaaccaaaccaatctctgattcttatttactctttgtatttttgtaccttcgtatcattcctttttctttctttctttctttttttttttttgagacagagtctcgctctgttgcccaggctggagtgcaatggtgcgatctcggctccccgtaacctctgcctcccgggttcaagcgattctcctacctcagcctccctagtagctgggactacaggcatgcgccaccatgcctggctaattttgtatttttagtagagacggggtttctccgtgttggtcaggccagtcttaaactcctcacttcaggtgatctacacatctcagcctgccaaagtgctgggattacaggtgtgagccactgtgcctggcctctttctttcttctttttttttttctttgaggcgtctcactctgtcacccaggctggagtgcagtggcaccatcttggctcactgcaacctccgtctccttggttcaagtgattctcctgtgtcagtcttccgagtagctaggattacaggtgcatgccaccacgcctggctaattttgtatttttagtagagatggggtttcaccatgttggccaggctggtcttgaactcccgacctcaggtgatccacatgcgtcggcttcccaaagtgttgggattacaggcgtgagccactgtgcccgtccagtttgcctagtctttaaaattttttttttctcctaaattaccaagtagcaaatgaagtaaaatttgttgaattttcgcttttggtcctttggtgcagtcttccaaatgtttttcctgttccctatgttgcttgcttttctttctttctttctttctttctttctttctttctttctttctttctttctttctttctttctttctttctttctttcctttccttccttccttccttccttccttccttccttccttccttctttctttcttttctttcttttcccttccttccttccttccttccgtccatccatccgtctgtccgtccgtctgtctctctctctctttctttctttcttctttcttttttgacaggatctcgctctgttgctcaggctggagtacagtggcctgatcacagctcctcattgtaacttgaacctcccaaaggccaggattacaggtgtgcatcaatgtctggctaatttttttttttttttttttttgtagagatagggtctcactgtgttgttcagactggttttgaattcctggcctcaaacgatcctcccaccttggcttctcaacgtgctgggattataggggtgagccactgtgcctggtctgttgctttcctttaaacccataccccttattattttagtattcccttggtttttaatgttgtgtggacttgaatcatagaattatagagcattattgctggaatgttggaatccaaccttgtgttttacagataaggaaactgaaatacaaatagactagatgcaccaaaattcaaacatttagtgatgggggcagaacaaagactcaacccttgatcttctgacgcaagttctgtgtgtttatgaaaccatactacttctcatctcttgtaattttgccttatttgcctcacattattttgcattttgtgtatttatgccttctcatagattgaaaacttcagggcaggggaaccttcatatttacattgtaaatttttttttttttgagacagagtttcgcagtttttgccctggctggagtgcagcagcatgatctcggctcactgcaacctccgcctctcgggttcaagcaattctcttgcctcagcctcctgaggagctgggatcacaggcacctgccaccacacctggctaattttgtatttttagtagagatgggtttcaccatgttggccaggctggtctcaaactcctgacctcaggtgatccgctcaccttggcttcccaaagttctggaattacaggcatgagccaccatgcccagccttacattgtaaattatttaaacaatgatataaagtctatatacagtttctttcccctatgcttgttaggtgtattaacaccattaacaaaaataatattgtcatgtttaccattgagttttttttttcttgagacggagtcctgctctgtcactcaggatggagtgcagtggggcaatctcggatcactgtaccctctgcatcccaggttcaagggattctcctgcctcagcctcctaagtagctggaattacaggtgcctgccaccatgcctggctaatttttgtatttttagcagagacagggtttcaccatgttggccaggctgatctccaactcctaacttcagttaatcagcctgctttggcctcccaaagtgctgggattacagggatgagccaccgcacctggccagtgtttaccattgaattctatcatctgctaaaaaatgaatctcttacaggttttactgctgcaatttagtttgtcttttcgaatctcttgataatgccaattaatctttggaggccttgaatgtggatacagaacaatgtaatgatttagaggaaacctggagggcttatcatataactaaatgcagtgatctagctgtaatgttctttttctcttttgagtgttagaactgtaacaccttcacattttgctactttttgtcctcttgttcatctgtcaggaaccatcacttcttgttgagcaagacaagacaaaatatcttgttgaggccgggcgcggtggctcacgtctgtaatcccagcactttgggaggctgaggcatgcggagcccctgagtccaggagtttgagaccagcctggccggcatggtgaaaccccatctctactaaagatataaaaaaatgagcccactgtggtggtgcatgcctgtagtcccagctacccgggaggcagaggcaggagaatggcttgaaccccagaggcagaggttacagtgagccaagatcatgccattccactccggcctgggtaacagagcaagactctgtctcaaaaaaaaaaaaattttatttgttccgctaggcctgatggctcactcctgtaatcccagcgctttgggaggctgaggtgggcggataacttgatcccaggagttcgagaccagcttggccaacatggtgaaaccctgtctctactaaatacaaaaattagctgagtgtgatggcgaatgcctgtaatctcagctactcaagaggttgagacaggagaatcacttaaacccgggaggcaggggttgcggggttgtgagatcccgccactgcactttagcctgggtgacagagcgagattgtctcaaaagaaaaaaaagaaagaaagaaaaatcatttgttccatttggtgagttagagtgcttttatatgtttgttcttcatgtttatttttcctcttaactctaaagtttctgtaacagaaaccatgtatggttgctttcgtatttttcttatgtgtacgtaacaatagttgaatgctgtaagacagcatagaagactatcaggtaaaatctctctgtggagggaaaggaatgcttattctcttggtctgtttttcatttattttttggttgttaatagttgctttttctatttgtttaaattatcagttaaaaaaacctgttaaaacactgattctcttgtttctattcctgaaattgtaagtaatgattgctgaattggacatgaatatggtatggataatttttgcttttgttcaaacagccagttgaataaaacaagcagtgaaaatatgtggaaatatttaaaagaatggatgtttctcaaaagttttttttttttttttttttttaaaagaatcatcctggcccagcgcagtggctcatgcctgtaatcccattgggaggccgaggcaggtggatcgcttgaggtcaggagttcgagaccagcctggccaacatggtgaaaccctgtctctactaataatacaaaatttagctgggcgtggtggtgcatgcctgtaatcccagctacttgggaggctgctgcaggagaatcatttgaacccaggagccagaggttgcagtgagccgagatcatgccactgcactccagcctgggtgacaaggagagacttaatctcaaaaaaaaaaaaattcatccttttcttccaaaaattttagcacgtattttcatatgttagtgtgtagatcaattcaaataatagatacaacaaatactgtaatatgttgtgtaccttgtaattattccagctgtatcgcagaaatattttataaatttaatagggctgggcagttttttttggaaatgcttgatcatttgcaagtactacatgctcttgaataatatattttcatttttagaaacatttagaatatttagtgtacaacccctgtctcccagtaattctgctgcccaaggaaatcagttactttattttttcttttcatttcttagctatagtctttaaaaaaaaaaaaaaaaaaatggcctgtgaggtcttgcatgatttggcttttgtctacgtctcacttcatctcttgcttttgtctctttcctctttcagccttgaatagcttagcccttttttgctttggtgtctgtgatcatgctcttcctcagggcagatggctcctttaggttaatcagcattaagtttggctactagtatcagacagatgccaaatattaatttctctcacaccagagaaatccagggttggcatggcattcatttattaaatgttatttccaggtgtgtgtatgtgttttgctattgtaaattctgcaataaagatctttgtgtataaggctttacattttttttccttttgattaattcctgttgtggatccaactaaaaagcttactaatttttttttaaaaaattgtttagtctgggcatggtggcttatgcttgtaatcctgcactttgggaggctgaggtgggaggatgccttgagggtaggagttagagatcagcctgggcaatatagcaagagccggcctttacaaaagtaaaaaaaaaaaattagccaggtttggctgtgagcgtctgtagtcctagctacttgcaaggctggcgggaggattgcttgagtccaagaggtcgaggctgcagtgagctatgatcgcgccactgtactctagcttgggggacagagcgagacgctgtctaaaaaaaacaaaattaaaaatttgtttagagaaagtatctttaaatgtttattgaaaactgcacaaatttaaatgtatagaatgtttatatttgtagatatctgtgtagtcatcactcaaatccagatgtggaacatttttagtgttcgaaaaggctctcttgcgccccctccaatcagtgtctctttccctctcaaaggtaatcactattctgtcctctatcgccataaactatttttgcctgtttttgaactttatataaatgtaactgatatggtttggctgtgtccccactcaaatctcatcttgaattgttactcccacaattcccacgtgtggttggcagaacctggtgggaggtaattgaaccatgggggtgggcctttctcgtgctgttcttgtgatagtgaataggtcttgtgggatctgatggttttaaaaacgggagtttccctgcacaaactctcttctcttatctgccgccatgtgagaagacatgcctttaaccttgtgccatgattgtgaggcctctcctgccatgtggaactgtaagcccattaaacctctttattttgtaaattgcccagtctcaggtatgtctttatcagcagcatgaaaacagattaatacagtaaattggtaccagtagagtagagtgctcctgaaaagatacccgaaaatgtggaagcaactttggaactgggtaacaggcagaggttggaacagtttgaagggatcagaagaggacaggaaaatgtgggaaagtttggaactttctagacttgttgaatgactttgcccaaaatgctgattgcgatatggaccataaagtccaggctgaggtggtttcagatggagatggggaacttgttgggaactggagcaaaggtgactcttgttatgttttagcaaagaaactggcaacattttgcccctgccctagagatctgtggaactttgaacttgggagagatgatttagggtgtctggtagaaaaaatttctaagcagcaaagcattcaagaagtgacttgggtgctgttaaaggcattcagttttacaagggaggcagagcataagtttggaaaatttgcagcttgacagcgtgatagaaaagaaaatccccttttctgaggagaaattcaagctggctacagaaatttgcataggtaatgaggagctgaatatgaatccccaagacaatggggaaaatgtctgcagggcgtgtcggaggtcttcatggcagcccctcccatcacaggcgtggaagccttggaggaaaaagtggttttgtgagccagacccaatgtccctgtgctatgtgcagcctagggacttggtacccagcattccagctgctccagccgtggctgaaaggggccagcgtagagcttgggctgtggcttcagagggtgcaagccccaagccttggtgttgatgctgcaatgtggtgttgatgctgcaagtgcacagaagtcaagaattggggtttgggaacctccacctgcatttcagaagatgtatggaaatgcttggatgcccaggcagaagtttgcagcaggggtagagcattcgtggagaacctctgctagggcagtgcagaagggaaatgtggggtcagagcccccacacagagttcctactcgggtaccgcctagtggagctgtgagaagagggccaccatcctccagcctccagaatgatagatccactgacagcttgcaccatgcgcctggaaaagctgcagacactcaatgcaagcctgtgaaagcagccaggagagaggctgtactctgcaaaaccacagagtcagaggtgcccaagaccatggaaatccacttcttggatcagcatgacctggatgtgagacatggagtcaaaggagatcattttggagctttaagatttgactgccctgctgtattttggatttgctagaggcctttaacacctttgttctgggcaatttctcccatttggaatggctgtatttacccaattcctgtacccccatcttatctaggaagtaactaccttgcttttgattttacaggctcataggcagaaggggcttgccttgttttggatgagactttggactgtgaacttctaagttaatgctgaaatgagttaagacttcgggggactgttgggaaggcatgattggttttgaaatgtgaagacatgatatttgggaggggccgggggcggaataatatggtttggctgtgtccccacccatatttcatcttgaattgtagctcccacaattcctgtgtgtggtgggaggaacctggtgggaggtaattgaatcgtgggagtgggcctttcctgtgcttttcttgtgatagtgaataagtcttttgagaactgatgatttttaaaaacgggagtttccctgcacaagctctcttgtctgccgccacgtgagacatgcctttcactatgcgccatgattgtgaggcctctccagccacatggaactgtaagtccattaaacctctttcttttgtaaattgttcagtcttcatcagcagcatgaaagtggactaatacagtaaccatatagcttgtatacctttttgtggatggctacttttgcttaacattgtgtttgtgagattcatttatgatgtagagtgcagcagtagttccttttcagtgatagtagtattccattggatgaatataatgtaattttaaaaaattggacatttgattttcagttttttggctattgtgaataaagctattgtcaacattcatttacagttttttacattttttatactttttttgagatagagtcttgctctgtcacccaggctggagtgcagtggtgcgatctcagctcactgcaacttctgcctcccaggttcaagtgattgtcctgcctcagcctcccaagtaggtgagattacaggcacttgccactacacctggctaatttttatatttttagtagagatggggtttcactatgttggctgggcaggctggtctcgaagtcctgacctcaggtgacccgcccaccttggccacccaaagtgctgggattacaggcgtgagccaccacgcccggcccgtttacaggtctttaatgaacttatacactcatttctcctggctgtatatacacattggagtagaattgtgctgtctttatctagcagtttttgaatctgcttgatctggccctctatggctgatacatagtagtttcctggcatttcttcctttctgataaaactagcgactccctttgtctttctcctgtgttaaatcttttttttccctttccatgaatcatatagtgtttttgtttgttttgttttttgtttaacctctccatttgatggagtatatcatacaatagattcctgtggaagactgaaatcttgcattaatgaaaactttttttcatgttcatgcttgatttggttggctaaggattctaggttggaaataatttgccttcagaattctgaaggccttgctgcattgttttctagcttgtcatccttttgagaagtctgaagacattctgattcttgattgtaaaaatgttttgcttttctggaattttgtgtttcctatattctgaaatttcataaggttgtagcttggtgttacgtctatttttaacaatttttcttggatatttgtgtaccttctgaatctgtaaaattcattagttctgggacattttctttaattattttattgacagatgtattagtctttgaggactgtcataacaataccacagtctgctctctgtttgtctgttattggtgtataagaatgcttgtgatttttgcccattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaaatggaaaacaaaaaaaggcagggattgcaatcctagtctctgataaaacagactttaaaccaacaaagatcaaaagagacaaagaaggccattatgtaatggtaaagggatcaattcaacacgaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatataaaagaacagaaattataacaaactatctctcaggccacagtgcaatcaaactagaactcaggattaagaatctcactcaaaaccgctcaactacatggaaactgaacaacctgctcctgaatgactactgggtacataacgaaatgaaggcagaagtaaagatgttctttgaaaccaacgagaacaaagacacaacataccagaatctctgggacgcattcaaagcagtgtgtagagggaaatttatagcactaaatgcccaaaagagaaagcaggaaagatccaaaattgacaccctaacatcacaattaaaagaactagaaaagcaagagcaaacacattcaaaagctagcagaaggcaagaaataactaaaatcagagcagaactgaaagaaatagagacacaaaaaacccttcaaaaaatcaatgaatccaggagctggttttttgaaaggatcaacaaaattgatagaccgctagcaagactaataaagaaaaagagaagaatcaaatagacacaataaaaaatgataaaggggatatcaccaccgatcccacagaaatacaaactaccatactttgttttctagcttggcttttatgaacatccttccgtgtcagtgtatatataaatctaaaggttttttgttttttttttaaaccaaaaaactttgcctattttgtctctgttataaagttcctgattttctttaatagagctgtttctacttttattcctacaaagaatatacgtattttttttaggtggctaaaaacttcatttttttctcatctctagtatgagagtaatacttagtcaaaggatagctgtaaggctacagtgagaatttacgaatcagtgtaactgctaagcagtgtttggtatccatgaagagcctgtctggatctcccttcctgcctaagatcaatttctaaatgtaaaataactggtttcaaagatacagatgtttatttaaaatgttgctgactgttgccaaactgctatttagaaaagacattccaatttacacctttaccacagtgttttttaactctgtgttatcattctttctaatctttgccagcatggtaggcaaaaaatggacaaaactaaaaggagaattagacaaatccataagcataatatgagatatttcagcttgcctctctgagtaattagaataatgagacaaaaatacataaaagatttaaacactataattatcaaatgaatctaattgacatgcattgaatatttcacctaatacctacagaatgcagattgtttttaagtgcctatgaaagtttttcccaaattgacacatgctggacaataaaaaagatcaaaataatcaattcttgagtgttttctgacgtgttggaattaagcaagaaatggattaccaaaaaaactagaaaattgtcagctgtttgaagataagcaatatatttctgagaaattcggggattagagaagaaataacattaaactatttagaacagaaccatgaaaatatagtataacttaaaggatgtgtatagagccatgcttagaggaagagttatagccttcaaatctatacatgagaaagaatgaaggctaaaaataattgaaaggacttctaaataaagatggctgagtgaaagacacatttacttttactccctttgatagcccagcaaggtgacagtaaaggatacttttagaagatttgaactacacaggtaaagagaataaagaaaagacggcaacaataaaatctggaaactggaaagcgagtgaactgatgggaaacttcttagtggacttaaaaatgttcaatcctaagtggcgggagcaaaagtagaaaatacttcttaggctcaggaattggcagcatcaggtatttttggcagggaggaggtgagggtggtgctaaaaacaggaggatttcttgaaaatctgtttaagaagcagctcagtcataatagccccaaagtagaagcaactcagatgtccatcagctgataaatggttacatgtaatgtatatccacacaattaaatactatttggcagtaaaaaggaatatagaactgatacatgttataacatgatgaaccttgaaagcattatgctgtgaaagaagccagtcacaaacgaccacagtattgtatgatacatgctataacacagataaacctttaaaacatgctaagtaggccggacatggtggctcacacctgtaatcccagcactttgggaggccaagacgggcagatcacttgaggtcaggagtttgagaccagcctggccaacatggtgaaaccccatctcaactataaacacacaaattagccggatgtggtggcaggcacctataatcccagttacatgggaggctgaagcaggagagtcgtttgaactggggaggtggaggttacagtgagccaagatagcaacacagcactctagccagggcgacagagtgggattctgtctcaaaaacaaacaaacaaatgtgctaagtatactaaagaccacattgtatgattccatttgtatgaagtatccagaaattgtgtatttgtagagatagagtggttgcataggactgggagtaggggaggttagagggaaatgggaagtgactctagggtatggagtttctttttggggtgacaaaaattttctaaaattcattgtggtaatagttgcacaactctgaatagactaaaacattgaattgtatactttaaatgagtgagttttatgataatctgagttgtatctcaataaagctatttttttttaagaaaggttgagtctagattcctttgttagtttgtatcactaagttactgccttcttgagtaccccagcaagaagactgactattgtttctgacactgagggtgggccctagacacaattggaggtcaagcgttctacagaaaacactgaattaagttaaaatgctcaatattgagaccgttactgaggcctcttctctttggcttccagaattctggcaatcaagtaggaatttggaggatggttctcttactaacccaagaagagaatctgtgttatttacaatagcttttatggccctccttttaaatatgagaagataatcaaggatcaccagacatgtgaagaaagcttctcatataagaaacctcttaaaagaaatagaaaacaaactgggaacaatcagaacaacaaaaaaaaaggctcagtagaacagtcaatagaaaagttgaagttagagtaaaggagttctttcataaagtagaggaaaagatggaaaataaatgagaaaagaaaattaaaaggtccgtcagaggtcaacttccaaataacagaagtactagtagacatcagagaaaagaaggaattatcagtaaaatattcaagaaaaattcccagaatcaaggaacgtgattttgcagaatgagaggctctatgggtatcctggaaaaatgaaagaaaatagatatacgctttcaattaaagcctagtcaggaaaatggagaccacaccaattactgtaacagaatctaaaataaagagttgtttagccagatattatgggttgagttatatcttcctcaaaaagatattttgaattcttaatccctagtacttaagaatgtgaccttatgtgcactattcacaatagcaaagacttggaaccaacccaaatgtccatcaacaatagtctggataaagaaaatgtggcacatgtacaccatggaatactatgcagccataaaaaagaatgagttcatgtcctttgcagggacatggatgaagctggaagccaccattctcagcaaaatatcacaaggacggaaaaccaaacactgcatgagttgaacaatgagaacacatggacacagggaggggaacatcacacattggggcctgttggcgggtgaggggctgggggagggatagcattaggagaaatacttaatgtaaatgacaagttgatgggtgcagcaaaccaacgtggcacgtgtatacctctaacaaacctgcacgttgtgcacatgtaccctagaacttaaagaatattaaaaaaaaaaaaaggctgggcacagtggctcacgcctgtaatcccagcactttgggaggctgagatgggtggatcacgaggtcaggagaatgagaccatcctggctaacacggtgaaaccccgactctactaaaaatacaaaaaaattagccgggtgtggtggtgggcgcctgtagtcccagctagttaggaggctgaggcaggagaatggcgtgaacccgggaggtggagcttgcagtgagccgagatcatgccactgcactccagccggggtgacagagcgagactccgtctcaaaaaaaaaaaaagaatgtgaccttatttcgaagtggggtctttacagaggtaaacaagttaaaatgaggttattagggtggaccctaatccaccatgacttcgggccttttaaaaaagggagagattttgacacagagacagaacaccagggagaagatgactatctacaagccaactaggagggagcctagagcagattcttcctagcatcttcagaaggaacacgttcctgctgaaataccttgatttcagacttctggcctccagaacagtgagaatgtgtttccttgatgttgccacttgatatctcatggatcttgaacttaagacaatcaacaaactttgtttgtttgtttttttgaggcaggttcttgctctgtgacccatgctagagtgcagcctcaatctcctaggttcaagggatcctcatgtttcaacctcccatgtagctaggaccacctaggtgtgtgtgccaccatactagctaattttttgaccctttgtggagatggggttctcacttctttgccctggctggtcttgaactcctggtctcaagcagtccttccacctcagcctcccaaagtgtggggattacgggtgttaggctaccacacccagccaacaaactcttgatcccttcattcttaaagtacactccaggtctgctttctgcgctctaccctacatttgttcattcctgtctttctcatttcattaaatgatattgccatccactcagtagctagaagccaaggtgtcatacttgatacctttcttttcctcattctaactcacatacttccagtccatcagcaaatcctgtcttttctacctccaaatacatcttgaagtcttctgttctttatctgcatcaccatactactcaagtcaagcagccatcatctcttcacttacactattggcctcttattttatttaattttttttgagatggagtctcactctgtcacccaggctggagtgcagtggtgcaatcttggctcactgcaacctctgcctcctgggttcaagcagttcttcttcctcagcctccttagtagctgggactacaggtgcacgccactacgcccggctaatttttgtatttttagtggagacgggatttcaccatattggccaggctggtcttgaactcctgacctcatgatctgcccgcctcggcctcccaagtgctgggattggaggcatgagccaccacgcccagcttctattttttattgtggtaaactgcataagcataaagttgaacatcttaaccattttaagtatacagttcagtattaagtatattcacattgttgtacaaccagtccccagaactttttcatcttgtaaaactgaaactgtatacatactaacaactccccaagtcttccctcctcctagcccctggcaaccactattcttcatgtttctcctttatgtttgtataaatttgtttgctctatgtacctcatataaatggaatcatattgtctttccgtggctggcttatttcacttaatgtcttgaaggttcatccgttttgtagcacatgtcaaaattttcttccttgttaaggctgaataatattccattgcttatatataccacattttgtttatccattcatttgttgatgaacagcttgggttgcttccacattttagctgttaagaatagtgtttccatgaacatgggtgtagaaatatctgttcaggttcctgctttcagttttttgatgtacacccagaagttgaattgctggattatatggtaaactattttttatcttttgaggaaccaccataccattttccatagcagctgcaccattttacattaccaccaaccgtgcataagagttccaatatcattacattttcactaacacttgtttcctgcatgtttttttaaaaatagtagctatcttaatggtgatatctctgtggttttgatttgcatttccataatggctagtgatgatgagcatcttttcatatgcttgttggctatttgtatatatttcgagaaatgtctattttgttcgtttgcccatttttcatttgggttatgtttttgttgagtctgaacaggtctttttatttttacttttgtctgtccatttaactcattcttcacacagcagcacacaacagccagagaaatgtttttaagatttctgcattaatgatacaacaatacctcttacttggcagcataatacaatgaaagtttacattactttcccacatcactgtgtgtgtgtgtgtgtgtgtgtgtgtgtgtgtgtgtgtgtgttgaggggcacctttgctttatgcagtcacttggagcacaggcacctgtatcttatgtcaccaccataatcagctttggcttctcagattgttttggaaggggaagtgtgtgtggagaaagattttagggtccaggctagaagtggcatatatcacttttacccattcagttccattggtcagaactgagtcatgtgatcttatctaattgcaggggtggctgggaagtgtagtatagcagtgtcttaatgaagagaacacagtcattagtgaatactagcagtctctttcacagcgtgtgttggattataatttccttgcttaaaacccttattacatgacttttttaaagacagtctcattctgttgcccaggctggagtgcagtggtgtgatctcagctcactgcaacctccgcctcctgggttcaagcaattcttgtgcctcagcctcccaagtagctgggattacaggcatgcgccaccacacccagctaattttttgtgttttttagtagacacagggtttaccatgttggctaaggctggtctcgtactactggcgtcatgtgatctgtccaccttggcctcccaaagtgctgggattacaggcatgagcccccatgcccagcctacttcttattacatgtagaataaaattggcctgtgtctctcccaacctcacattgtaccacttttgcccttgttctctggccacatctctagccatacggtcattttctgtaacgtgagacttttttttcccctcctggaacctatgtactttgcagtttcttttgcttggagcactctactttaaatatttacatgactgcctcctcttcatccttaaaatgcccacttaaatttttttttctctaactaaaagctgtaattagagtagcactcatattctctgtcctttatggtagcactgtgttaatctttgtcacagcattttttgcaacctataattattttatttgaaaaaatttaatttcctctgctagaaagaggtgtctgtcgtgctcactgttgtatccctgcattaattggccagtgcttaggatacattagtcattcagtagatatgttgttggagggaatctattatatagaaccgactgaaatggagatagttgaattttaaccaagggctcttatgataatttaggtgagttgctgaaggcttgagttttagtgatgtcagtgtaaatggaacagaaaaggatggatgagagacatttcaagagaaaaaccaacacaaattgatgtgtgacttaaggggagcctgggtgaattggaagataatgatttacaattataattaatagattggtaaagaggatagaagagctggatttttggagatgatgcatattcaatttttggagattgatgcatattcaatttgaggtgatagcaagatatttaagtagaaatgttgaggaacagtagcttggattagagaacacaattcaaattacagagtctaggccagaggtgatacgatgaagtcataataatgaacgagctatctagagagagggtatatgtgagaagagcagatggctcagtggaaggaaaatgaggagccagaaatggaaaccagaagcaggtggcgtggagggagggaaaccaatttaatataggggtaaggaaaccagcagtttcaagaaagagggatgattaagttggctgcatccagtagagctatcccttgtcatatgcatttgaaagttctgaaatgttaccttttattaagtagtttgagatcagagggtaccttgggttttatttattctataagaaagtatagcttaatgagaatgatagagtacagctttgagttcttgtcttttctttttttttgaaacacggtcctgctctgtggcccaagctggagtgcagtggtgcaggcttgctcaccgcaacctccgcttcctgggttcaggcgattcttgtgcctcagcctccagagtagctgggattagaggcgtgtggcactatgcccggctaatttctgtatttttagtagagatggggtttcatcatgttggccaggctggtcttgaggtgatccttctgccttggcctcccaaagtgcaggcttgagccaccatgcctgagcttttttttttttctttttttgagagggagtctcactctgttgcccaggttggagtgcagtggcctgatctcagctcactgcaacctctgcctcttgagttcaagggattctcctgcctcagcctcccaagtagctgggattacaggcacctgccaccacaactggctaatttttgtatttttagtagagatggtttttcaccacgttggtcaggctggtcttgaactcctgacctcaagtgatctgcccacctcggcctcccaaagtgttgagattataggtgtgagccactgcgcctgctgaagttcttatgttttagagatatttacttaaatatttatggatgaaaatattttttcaggtatacactgaaatatttacataaatttttagaggtatacaccgaaatatttacagacaaaagttttttgcttcaaaatacttaagcaaggaaacaggaatgggtgagaatatggatattgtggccgtggacaagtggccatgagttgatgattttagctacatgatgggtttaaggggtttgttctcttctttaatgtatgtttgaaattttacataatagaaattataaaaggagggaattgtcttttccagctgtaatctagggcacattacttaacttttttgagacagggtcttgctctgtcacctaggctggagtacagtggcctgataactcttcagctccttacgtagctggaactataggtgcatgccaccatggctggttaatttttgaattttttgtagagacaggattttgccatgttgcccaggctggcctccaactcctgggctcaagtgattcgtctaccttggcctctgaaagtgctgcaattacaggtgtgagccacagcacccagcgtacttaaacctttgaagccttagtttcttcagttaaaaatggtgatattaatactgattgtatcagtttgctgtggtgattaatgacagtgtattaaaactacttagcatacttactctgtgcactcattgtccagtaaatatttctgaagtgaaatacagtgagataatacagttaggcatcaaggttaaggggtttgtagagggagaaaaggttctgggctctttatagcaacctttcataagagatacgttctttttagaatgttataaagttggaatggctaacttaaaagcttccatagacataatatttatttattttggcatgtttttaataggagttttctgatctgaacgtgtacaaaagcagcagtacagtggtatttcatctgttctaaaccacatccttttactgaatgttattccggaagcatttataaggcaggtgcccctttgaaagacattgtcctttaaagtagtttgaaactaaattttcatttaacattaaagtcaaatgagggaatacttaagatggaagcatgggttaataaaattgtattaacactaatttcttagagcacctgacttaaagtatatattttttggtagtaacttggctataggtagtatatagttatccttttttttttcttttgcagtaaaacttggttatggatagtatatacttgtcctttggtatccatgaggtgttggttccaagactccttgcagataccaaaatttgaggatgcttgagtctcttgtgtaaaatggggtactatttacatataacctatgcacattctcctgtatactcgaactcatctctagattacctaatacattgtaaatggtatttaggtagttaatgctatattgtttagggaataatgacaaggaaaaaacgtctgtatatgtttagtacaggtgcttttttttttcctgaatgttttaaatccacggctggttgaattcatagatgcggaacccatagatacagagggccaactgtactaagaaattgctgtcacagtctgtagatgtcatacagttttgtctccagataaatgagagacctgtgaacacaaaggaaactttcttgtatgccttttcattctcatgtttttaaagttcgttcattttttgtttagggaactttaatgagttacttaggcagagtttggaactgtcctgtagttacatgatcagtcttttttttttttttttttcctatctttctttttctttttttctgagacggagttttgctcttattgcccaggctggaatgcaatggcacaatctcatctcactgcaacctccgcctcccaggttcaagcgattcttatgcctcagcctcccaagtagctgggactacaggcaggtgccaccatgcccggctaatttttgtgttattagtagagacggggtttcattatgttggccaggctggtctcgaactcctgacctcaggtgatccacctgctttggcctcccaaagtgctgggattacaggtgtgagccactgcacccagcccctatcttttatattgtgttttatttctttagaaatgaggtttcactgtgttttccagactggagtacagtggctgttcacaggcaccatcataatgctgtgtggcctccaactcttggcctcaaacgatcttcccaccttatcctcttgagtagcggggactacaggagtgcaccgccatgctcagcattttttttctatcttaacataaaatggaaaagttactgttgccttttctcctgataaatagcagcctaagtaagactggtagtttggaataaaggataagttaaaagggcaggaaggtgaggaaagaagtgtttaaaaatgaaggcgagaaggagaaaaagaagttgagagataaagtttatattttcctgtgccttagtatcgacttgcagtgaattagttgaaagttgccttgccagttacatataattggtgacttttaagttatttgtcacctggaacagacataacttctttagcatacaattcagatacaactgtcattgaatttatgtttccataaaattggtggtagaatttttagcattaggtaggagaagaggacagggaaagacagctgtgtctcaggcactgtactgttttacctattttgttaaatcctcacagcaaccctgtaggtaggtgttaactgaagcagagaggttagataacttgctcagtgttacacactgatgataaatgacagagcaagaattcaaactgtaatgtttcggttcttgttatcttttattcatcgcctttattgtttcttttctttctttctttctttctttttttttttttcttttgagatggagtcttgctcttgtcgcccaggctggagtgcaatggcatgatctctgctcactgtaacctccgactcctaggttcaagctattctcctgcctcagcctcccaagttgctgggattacaggcgtctgccagcacgcctggctaatttttgtatttttagtagagacagggtttcgccatgttggccaggctggtctcaaactcctgacctcgtgatctgcctgcctcggcctcccaaagtgctgagattacaggtgtgagccaccgtgcctggccctccttgctttattttatgattccattcagtcattagtcttgtcggtttttaaaaaaaggttttattgagatatgattcacatactatacagttcactcattaaaagtatacaattcagcttttagtatattcagagttgtgcaaccatcaccacaatatcagaattttttttttttttgagacggagtctcgctgtgtcaccagggtggagtgcagtggcaaaatcttggctgactgcaacctctgcctcccaggtttaagtgattctcctgcctcagcctccgcagtagctgggactacagaagcttgccaccatgcccggctaattttttgtatttttagtagagacggggtttcaccatgttggccaggatggtcttgatctcttgacctcgcgagccaccgcacccagccatattggaacactttaatcacctcccaaagcaatgccatactcattagttgtcacccctaacctcccctctccgtgtcctaggaaaccattaatctgccttctgtctctatacatttgctcattctgaacctttcatatacatggaatcatatagtatgtggtcctttgtaaccgctttctttcacttagttcaatgttttttttgttgtttgttttgtttttttcttttttgaggcaaggtttgctctgttgcttggactgtagtgcagtgcttgatcacagctcactgcaacctctgccatccaggcacaagtgatcctcctgcctcagtctcctgagtagctgggactgcaggcatgtgccaccatgccaggctaattttttgattttttttttttttttttttttttttttttgtagagacagtctcactgtgttgcccaggctggttttgaactcctgcgctcaagtgatcttcccatctctgcctcccaaagagctaggattacaggagtgagccactgcacccagcagcttgatgtttctaaggttcatccatgttatagcacatactggtactgtgtctggaattggtgggttcttggtctctctgacttcaagaatgaagccgcggaccctcgcggtgagtgttacagctgttaaggtggcgcgtctggagtttgctccttctgatgttcagatgtgttcggagtttcttccttctggtggaatcgtgatctcgctggtttcaggagtgaagctgtagaccttcgcggcgagtgttacagctcataaaggcagtgtggacccaaagagtaagcagtagcaagatttattgcaaagagcgaaagaacaaagcttccacagtgtggaaggggacccgagcgggttgccactgctggctcgggcagcctgcttttattctcttatctggccccacccacatgctgctgattggtagagctgagtggtctgttttgacagggcactgattggtgcgtttacaatccctgagctaggcccaaagttctccacctccccaccagattagctagatacagaatgttgacacaaaggttctccaagtccccaccagagtagctagctacggagtgtcgattggtgcattcacaaaccctgagctagacgcagggtgctgattggtgtgtttacaaaccttgagctagagacagagtgcccattggtgtatttacaatccctgagctagacataaagattctccaaggccccaccagactcaggagcccagctggcttcacccagtggatcccgcacaggggttgcaggtggagctgcctgccagtcctgcgctgtgtgcccgcactcctgagcccttgggtggtcaatgggattgggcgccctggagcagagggtggtccttgttggggaggctcgggcggcacagcagcccatggggcggggaggctcaggcatggcgggctgcaggtcccgagccctgccccacggggaggcagctgaggcccggcaagaaatcgagcgcagcgctggtgggctggcattgctgggggacccagtacaccctcttcagttgctggcccgggtgctaagccccccactgtccggccggcagggccggccggctgctctgagtgcgtgcggggcctgccaagcccacgcccacccggaactccagctggcccgccagcgttgcacgcagccccagttcccgctggcgcctctccctctacacctccccccaagctgagggagcaggctctgcccttggccagcccagaaaggggctcccacagtgcagtggtgggctgaagggctcctcaagtgctgccaaagtgggagcccaggcagaggaggtgccaagagcgagcgagggctttgaggactgccagcacgctgtcacctctcagtacttcattcctttttattgctgaataatatgtaattttacagttaataccacattttatgcattcatcagtttacaggcatttgagttttttctcccttatgcctattacgagtaatatggctactggcattcatgtacatgtttttaaaaagttattgtggtaagatatgtgtaacataaaatttaccattttaaccatttttaagtgtacagtgataagtatattcacattgttatgcagccatcaccaccacctgtttgcataagtttttcatttttgccacctgaaactctgtacccattaaacaacaactcccaagtctgccatccccccaacctctggcaatcaccattctactttctatctctatgaatttgacaactcctggaaccatgtgtaagtgaaataaatcatacaatatttgtcctttatgactggcttatttcactgagtatagtgtcttcaaggtttattcacattgtagcatgtgtctaaagttcctccccgaccaaaggctggtactgttccgttgaatctatatttaccacatgttgtttactcattcaactgatgacagacactgaggtggagttttgctcttgttgcccaggctggagtgcagtggcacgatctcggctcatttgcaacctccgcctcctgggttcaagtaattctcctgcctcagcctcccaagtagctggaattccaggcatgggccaccatgcctggttaattttgtatttttaatagagatgggggtttcgccatgttggtcaggctggtcttgaactcctgacctcaggtgatctacccgcctcagcctcccaaagtgctgggattacaggcatgagccaccacgcctggcctgatcatggacactttggttgcttccactttttggctgttgtgaataatgccaatatgaacatgggtgtacaagtatctatttgagttctcacttttacttcttttgggtttgtatccataagtgaaattgctggattgtatggtaattttgtttctaattttttgaagaactgccatatgggtttccacagtggctgtaccatcttatcttcccaccagcagtgcacaagggttctaattttctacattttcaccaacacttgttattttctgtcatcatcatttttttaataataaccatggtgatggttgtgaggtggtattattgtggttttgatttggatttttctaagggatggtgatatgatcatcttttcatgtgcttattcactgtttgcatatcttctttggagaagtgtctattcaattcctactccatttttgtgttggatttttattttattctttttagagacaaagtctcactgtatcactcaggctggaatagagtgacataatcatggctcattgcaatctcatcctcctgggctcaagggatcctcctgtctcagcctcctgagtagctaggactataggtgcatgccactgcttggctcatttatttattttttgtagagatggggatctcactatgttgcccaagcaggtcttgaacttttagcctcaagggatcctcctgtctcagcctcccaaagtgttgggattataggtgtgagtcaccacacccagctggattttgttgttgttgttgttgttgtttttgacttgtaagagttctttatatattctgaatatcagtgtcctatcagatgtgatttccaaatattcctttctgtgggttaccttttcactgtattaatttagtgtcctttcatatacaaagtatgttaaaaagatcttaattttgatgaagtccagtttgactcttttcggttgcctgtgctactgatgtcctggattatctgagtgggctctggtaatcacaagagtccttatcagagggaatcaattagtccaggaaagggatgtgatgctgaaagcagaaatcttgatgatgtggccaagtgcaaaggaatataagcagcttctaggagctggaatagacaaagaacagattcttctctagagccttctgaaggaatgcaggctttgattgtagctttgtaatctactccatccaggctgctgcaaatgccaaacaggcctgtaagacctgttttagacttaatgacctctagaactgtgagatcacaaatttgtgttgttttaagccactattgttacacagcattaggcaattaatacaactagaatcaaaggagagactgagagcatgaagattatacatgagacttttaaaatactttatttcagtaggtttttggggaaccgatggtgtttgattacatgagtaagttctttagtggtgatttctgagattggtacaaccatcacccaacagcaatgtacactgtacccaatgtgtagtcttttatccctcacgccaccacccttatcattcatatgcttttgcgtcctcatagctttgctcccacttatgaatggagaatatacgatgtttggttttccattcctgagttacttcagttagaataatggtctccagttccatccaggctgctgcaaatgccattattttgtttctttttatggctaagtaatattccatagtgtgtgtgtgtgtgtgtgtgtgtgtgtgtgtgtgtgtatatatatatatacacacatgtgcaagtatctttttcgtataataacttcttctcctctgggtagatacccaggagtgggattgctcgatctactttcagttctttaaggaatctgcgccatccacgtcaacatctattttttgattttttgattgtggccattcttgcaggagtaaggtggtactgcattgtggttttgatttgcatttccctggtaattagtgatgttgaacattttttcatatgttggccatttgtgtatcttcgtttgagaattgtctattcacgtccttaggctgttttttgatgggattgtttttttcttgctgatctgagttccttgtagattctggatattagtcctttgtcagatgtatagatggtgaagattttctcccactctgtgggttgtttactctgctgattgtgtcttttgctgtgcagaagctttttagtttaagtcccatctctttatctttgtttttgaggcatgagacttttgatagaatctacatcttgctttgctcagattggcttaaaccctacattgattctaatccatcaccaagtcttgacatcttccatggaaatttgagaagggttagtgatataagccagtggtacctgctactgcaactggtattgaggcaggaattactattcatcattaccttcttttactacctattctagatttcctttatgctgggccagcatttaagctggtttaagttgcttctgtcctttaggctttcatccttgtgggacttgagcctttagttgccttgcctgttttgagccatggttgctgtaatttcctgtttaccctattagcaagcatggaaataccctgcattccagacagattgctccctaatctcattgtgtacaacaggtcctaataatcagggtcatttatcactgctagtatatttattcctttctttgcctgctcgttcatcagtatgagaagcccatagtgaccaagtggtggttgtggctttaggctccgtgaacccctactgtggaagcattaccctcaggatctctagtacagcagagattttaaattgtggggataggaaatccacatgccataagtgagttactgggagtgatggtgaagagtcaatctaacttctctaccccttggtttctaaacccgtgcatctcaggtagtagggatataataccctagccattggttcagtgcatatgctgcatcccaaatgaccagcagaatgacttcttaatcgagcttttaatttaatgcaccactttatgattttgttagccggacagtttctaggtgatgtggtatgtggtgtaggaccagtggatgccatggtcatgtgcttaatgttgtatcttcttcaccattaaacgagtcctttagtttgaggtgatgttaaagtgaatcccagattggcaaagcaaacattttgaaaccattgaggtactgtaaatgtccagagacactcagggcaggaaaggcaaactcatttctacagtaagtgtaaatcctacttcccctggaatgcaaaggttccaattccatcctgccacctgctcagttctgtgtctgataagttgtttcctgcattctgctgtgatcctaaattttgctagattttttaaatcttattagtacttttaattatatttttcagaaataagctgatttttttgttttgttttgttttttttttgagatggagtttcactcttgttgcccaggctagagtgcagtggcactactatctcggctcactgcaacctccacctcctgggttcaagcagttctcctgcctcagcctcccaagtagctgggattacaggcatgtgccaccaagcccagctaattttgtatttttagtaaagacagggtttctccatcttggtcaggctggtctcgaactcctgacctcaggttatccacccgcctcggcctcccaaagtgctaggattataggcatgagccactgcgcccagcaagctgattttttttgataatagggatgtgataaacagttttcactttaacgtagtcaactatatgattccatttgtatggaattcaagaaaaggcaaactgatgatagatgtgtataaggctttggtatgtttttggtttattttattatatatatatatcatgtttccgtaccttttaatgttgcaataaaattgttttgtctgacattaaaattgccataccaccttttttaaaaaattgccataccaccttttttaaaaaattgccataccacctttttaaaaaaaaggtttgtcagaatttatttttttcatcttttctctgttaatgttttagttcacttttataaacagctttagttgaatttgtatgttgtttttattttattttatattatttattttttgagatggagtcccactctgttgcccaggctggagtgcagtggcacaatctcggctcactgcaacctctgcttcctgtgttcaagtggttcttgtgccacagcctcccgggtagctgggattacaggtgcgtaccaccacaccccgctaatttttgcatttttagtagagacagggttttgctatgttgaccaggctgatctctaactcctgacctcaggtgatcctcccaccttggcctcccaaagtgctgggattacaggtatgagccaccatgcccagtctgtatgttatttttgttattttctgttacaaatgagttaaattcattcacatctattttaattatgatatatctggatttttgtcatcttgctttgtttgccatcctttttctttgcttctcttctcctttcctgttttttgttttttattgatatataatattttacatatttacgaggcacatgtgacattttgttacataggatgtgtaatgatcaagtcagggtatttgggatatctatcaccttgagtatttatcatttctatgtgttgggaacatttaaagtcctctcttctatctactttgaaatacacagttttgctagctatagtcaccttagtctgctatagaatattagaatttttatactttttctttaacaatatgtttgtgtacattgagcaacctcttttcattacctaccacccatgtacccttctcagattttggtgtctgtcattctactgtctacctccatgagatcatcttttaaacccactgaatgagttagaacatactatatttgtctttctagtcctggcttatttcacttaacatagtgacctccaggtccatccatgttgctgcaaatgacatgatttcattattttttaatggccaaatagtatcccattgtgtatatatgccacatatgtccattaatctgtttttgttttgttttgtttttaaaggcagggtctcactctgtcacccaggctggagtgcagtggtgcaatcatggctcactgcagtgagtagccgggaccacaagcataccccaccacacctggctaattaaaaaagaattttttttgtagaaatgggggtctcactatgttgcccaaactggtctcaaattcctgggctcaagcagtcctcctgcctcggcctcccagagtgctaggattacagacctagcactgtgcctggccccatacatctgttgatgaacacttaggttgattacatatatttgctattgtgaatagtgctacagtaaacatgcaagtgcaggtatccctttgatatactgatttcttttcctatggataactacccagtagtgggattgctggatcttgtggtagttctgttttcaattttttgagaaatttttgtaggtttccaaaaagtatgtactaatttacattcttaccaacactgtataagagttccctttttttctacatccttaccagtgtctttttttcttttgttttacttttatttattattttgagacagaatctcactccctgtcacctaggctggagtgcagtggtgtgatcttagctcactgcaacctctgcctcccaggttcaagtgattctcctgtctcagcctcccaagtagctgggattacaggtatgtgccaccatgctcggctaattttttgtatttttagtagagatggggttttgcaaagtgttggccaggttggtctgaaactcctgacctcaagtgatctgcctgccttggcctcccagagtgctgagattacagacatgagctaccacacctggccttttttgttatttaaataacagccattttaacttggctgaaatgatatttcatgtggtttttatttgcatttccttaatgattagtgatgttgagcattttttcatatacttgtttgccatttgtatgcctttctttgaaaaatatctattcatgtccttagcctacttttaaatgggattattggtggggtttttgtttttgttgtttgagttccttgtatattctaggtattagtcacttgttgaatagttcgcacatattttctcccattcagcagattgtctcttcaccctttttttagacaaatgctcactttaatcacagttctaaattaattattttcacgttaacatagatgttcccataaactgagaagaactgagctaagtattatacatttttaatggttaatatgatttgaaaattttttataaaaattgatcagaagctagttgaaattctcaccataaatataaaatattgattacaattgtttttcacagtaaattgagatctgagcttcctaaaaagctgtattatctaatatcataatagggatgactaaatacttgacaactactttctgaagactggcttaacaaaaagttactatttgaagaaacagctttcccttgtttatatttacaagaaaaaggctaacatttttgcagaactctcattttatcatgaagtgtggacagtcagaagcaggtggctgttggtggggtgcagtggctcacacctgtaatcccagcactttgggaggccaaggcaggcagatcacttgaggtcaggagttcaagaccagcctggccaacatggtgaaaccctgtctctactaaaaatacaaaaactagctgggtatggtggtgattgcctgtgatcccacctattcggggaggctgaggcatgagaatcacttgaacccgggaggcggaggttccagtgagctgagatcgtgccagcctgggtgataggcaagactccctctcaaaaaaaaaaaaaaaaaaaggtggatgcagtggtatcaagaaaaaagcatttcaaaacatttccacttttattaaaggttttgacaatgaagatatcactaaatgtcttcaaattctatttgttatagaataaccatctaaataggagacacatgccataatacagcaaccattttagtgtgtaaaatacttctgaactcttactatgaaaaaatttggctaaaatacaaaacatctttgcaataaaactgataatatagcttaagtagcttataagatttcagaaatgtcttatgaaagaaatgagaatgtttccctgtgcgagataaaactgaacggttaacgttaaggtgctataaactagacaaagctggaaaggcacatcatgtaactagaaaagaacggcatgtgatgtggacttcctccatgtcaaactgacaggaaaatagaatatgctcttcagaaggaaaggcatgagaagataattcttacaaagctctcattgagatcttgaagagctttacagagaacataatcataaaatggctagagatcatttataggacatggtaatggattcctttgtattacaatacctgcctcagatataaacacaaatcaaatataaacacccttgtaaagctgtgcttctttcagccaaacatttctctggtaccacagtcagcctctagtagcatttggatgcaaaggtttaactggtgctgatctggacaagccacagcagagactctgatttggagacttcatggacactcctgccagtgcgctgctgctattgctgctacttccagatgctggtagaaccatttaggtctcttgctttcagctgaaggactgcatatttgtaatggtttcctagtggcatctgaagaaagataaatctcttttggcgaggactgagattctgatttgatggcagccagagcagtctaccaaagtcactaaagcattacatttggatttaggttccttctctttcttttctactggggattttaccttcatttcttttcttttttttttttttaaatttctttaactttactttttctcatagaggagtctttgtcattatcctcactctcaccaaaatcagaatcatcctcagaatcttcaccagttgccaagtctggtttggtgttattagcactattgccatcactgccttccagaaaaattttcctctgttgtaccgcagctttagatgctgcttttcttttcccttgaataccaccattgtctttcttagtaatcttatccaaatctaaataatcactggctacactgcaattagagatacgaggagacttactcactgtttctgttctactattgccatgtttttcaactcttttatcttgagacttctgcacattagtggtgactgttgaaagttccttcactgataaagctagtgcaacttctaagtctctctggtagagcttatcatctaaagccatccttttttttttaggggttttctcttctagtgggatttcttctttctggagattgttcaaattaggttttggtttatcttgttttaactcctttgatgttctggattgcttgtttaaaggtacagttgcagaaacaaaatcatcatcactgtcagagtcgccaaactgtgagtaattgattggtttcttacatctcacaggctgcaccatggtccctttcagggcttgatatttacacttcccaagttcttgttggctgtagtggtggtttcagttcccacccaaaaccagacattggcgctctcccttcactcttcattgtttcctttgctgtgcagaagccttttttgttgttgttgttgtttaatataatcagttggctttaaatatgtggatttatttctgaattatctgttttattccattagtctatgtgtctgtcttataccagtaccatgctgttttggttactgtaaccttgtaatgtattttgaagtcaggtagttttattctttttgcttaagattgttttggttgtttgggctcctttttggtttcatatgaattttaagattgcttcttctatttctgtgaaaaaagacattggtattttgatagccattgcattgaaaatgtagattgcttatggcagtatggtcattttaatgatgttaattcttattcttgagcatgggatgtctttccatttgtttgtgccctctttattttatctagtgttttgtagtttttatagctattgtaaaaagggaatgccttcttgatttctttctcagctagtttgttttattggtatatagaaacaggttttgtatgttgatttttttttaacactccctgcttcacagatggatgcatattgatttatgtgtgttgattttgtcctgcaactttactgaatttatttagcagaactaagttttttggtggagtctaggtttctctagatataaaatcatatcatcagcaaagagggacagtttgacttcctcttttctaatttggatgccttttctttttttccctcttgcctgattggtctggctaggacttgcagtactatgttgaataggagtgattaaagtgggcatcctcgtcttgttccagttcttagaagaaagggtttcaacttttccccattcagtatgatgttagctgttgtcatatatgacctttgttatgttgaagtatgtttcttttatgcctagtttgttaagagtttttatcacgaagggacactgaattttatcaagtgctttttctgtgtctgttgagatgaacatatggttttgtcctttattctgttgaggttatgaatcatatttgttgatttgtgtaaccatccttgcctctctgggataaatctcacttcattgtggtgtatttttttttttttaatgttgttggattcagtttgccagtattttgagaatttttatctctgtgttcattagggatattggcctgtagttttctttctttttttttttaaatattttttattgcatccttgtctggttttggtgttaaggtaatgttggccttgtagaatgagttggggagaattgatgttagttcttctatgagtgtttggtagaatttggcagtgaagccatccagtcccggacttctgtttgttgggagactttattactgattaaatgtctttactcattatcagtctgttcaggtttcgtatttcttcctgattcaatcttggtagattgtatatgtctatgtctaggaatgcatccatttcctctcaattttccagtatgttagtgtatcgttgtttgtaatagtttttaatgttcttttgtatttctgtggaattagttgtaatgtctcttttcattttctgattttacttgggtcctctctttttatgttgattagtctagcaagtggtttattgatttaccttttcaaaaaatcagctttttgttgttcttttgtgctttttaaaaaagtcgtttcatttagttctgctctgatctttattatttctttccttctactaatttggggtttggttctagttccttaaggtgcattgctagattgtttctttaaaatcttactacttttttgatgtaggcatttgttgatataaatttccctctttgcactgtttttgctgtatctcatagattttcggtatgttgtattagattttcatttgtttcaataatttttttgatttcttccttaatgtcttccttgacccagtggtcattcagaagcatgttgtttaacttctgtgtatttatatagtttccagagttcttcttaactctttgttttttttttttttttttgtttttgttttttgagacagagttttgcttagtcacccaggctggagtgcagtggcactatctcagcttactgcaacctccgcctcctgggttcaagcagttcttgtgcctcagcctcctgagtagctgggactacaggtgcacgccaccatgcctggctgatttgtattttagtaaaaacggggtttcagcatgctgcccaggctggtctcgagctcctgagctcaggcaatctgcccacctcggcctcccagagtgctaagattacaggcgcgagctatcccacctggcctattattcttgatttctagttttattccattcttatctgaggagatacttgatacgatttcaatttttaaaaatttgttgacacttgttttgtgtcctaacttgatctatcctggagaatgttctatatgctgatgaaaagaatgtgttcacagtggggtgctggtgcccactttaatcactcctatttaacacagtactgcaagtcctaaccagaccaatcaggcaagagggaaaaaaagaaaaggcatccaaattagaaaagaggaagtcaaactgtccccctttgctgatgatatgatcttatatttagaaaaacctagactccaccaaaaaacttagttctgctaaataaattcagtaaagttgcaggacaaaatcaacacacataaatcaatatgcatccacctgtgaagtagggagtgttaagatgttagatgaaatgttctgtaaatgtctgttaggtctatttggtctgatatgcagtttaaatccagtgtggctttcttaatttttgtatctacatgatccatttaatgctcacagtggggtgctggtgtccctaactattatcgtagtggaatctatctctccttacagatctaataatacttgctttatatatctgggtgctacagtgttgggtgccttatatgtttggaattgttaaatcctcctcctgaatttttccctttaccattatataatgaccttctttgtctctttttactgtttttgacttaaagtttgttttgtttgatacaagtatagctacttctagtcactgttggtttctgtttgcatggaatatctttttccatcccttaatttcagcctatatgtctttacaggtgagatgagtttattgtaggtagtatataggtgggtcatgctttaaaaacattttaaaaaatctattcaatcagtatctatcttatttatttaattgagatggagttttgctcttgttgcccagactggagtacaatggtgcggtcttggcttactgcaacctctgcctcctgggttcaagcgattctcctgcctcagcttcctgagtagctgggattacaggcacctgccaccacgcctggctaatttttgtattttcagtggagatggggtttcaccgtgtaggccagcctggtcttgaacccctgacctcaggtgatccacctgcctcagcctcccaaagtgctgggattgtaggtgagagccacaccgcgcctggccaaattagtctgtatcttttaagtggaaagtttgatcagtttacattcagagttattgatgtgtgaaggcttatttctgtcattttattaactgatttatggctgttcagtatatcatctattccctctgtctcttattaattattattttggcttggtggttttctgtagttgtgagtctcttccttgtttgtgtttggtctatcagtggtttttatatttttttgtgtttttgtgatggtagatagtgttcttttgcttctggatgtaggactttcttaagcatttcttctagggccagtctagtggtgatatattccctcagcttttgcttgtttgtgaaatactttatttcttactcatttatgaaggataactttgctgggtatagtatccttgactgacagtttttttttcattgagcactttttaaaaaaattatttttttagacagtctcgctctgccacctaggctggagtgcagtggtgcagtctcagctcactgcagcctctgcctcctgggttcaagtgattcttctactttggcctcctgaatagctgggattacaggaatgtatcaccgtgcccagctaatttttgtatttttagtagagatagggtttcactatgttggccaggctggtcttgaactcctggcctcaagtgatccacctgcctcagcctcccaaagtgctaggattacaggcgtgagccaccgtacctggccttctttcagcattttgaatatatcatttcattctctactggcctataaggtttctgctgagaattccactgttagtttgatgggcgttcctttataagtgactagatgcttttcttgccatttttagaattctgtgtatttgattttttgacagtttgaagataatgtgctgtgaagaagacctttttgatttgtatttactgagagatccctgaacttggtgtatctgatgtgtaaatctgttgctagacttggaaaatttttacctattattttattgaacaggttttctaacatttttgttttctcttctcctgagacactgaaaatttgaatatttggttacttaatggtgttccatatgtcacacaggcttttctcatttttttttttttaattattactttttgtctcactggctcatttccaagggcctttcttaatgttctgagaatcttttatctgcttaatctagtctgttgttgacactttccaacgtagtttgtatttcattcagtgaaatcttcagttctggaattcctgtttggtttttcctttttttttttttttttctttttgagatggagtctcgctctgtttcccaggctagagtgctatggcacgatctcagctaactgcaaccttcacctcccaggttcaagtgattcttctgcctcagcctccgaagtagctgggactacaggtgcctgccaccacacctggtgtggcggcaatttttttgtattctttgcagagacagggtttcactgtgttagccagtcttgtcttgaactcctgacctccagtgatttgccttccttggcctcccaaagtgctgggattgattacaggcatcagccattgtgcccaacctggttttcctttgtgatatctagttcctttagtaaatttctccctcatatcctgaattgtttttctgaattttttgtattgtttttcagaattctcttgtatctttttttttttgagacagagatggggttctgccaggttggtcttgaactcctggcctcaggtgatctgcctgcctcagccttccaaagtgctgggattacagacaagggtcacagtgtctggcctcagaattctcttgtatcttactgggcttctttaaaatcagtatttgagttatttttctgggatttcataaatttctttttttcccccctgagacagggtctcactctgttgcccaggctggagtgcaatggtgtgatcatggctcagtgcagcctcgacctccctgggctcaggtaatccctcaacctcagcttctgagtagctgggactacaggtgcatgccaccacacctggttaatttttgtattttttttagagatggggtctcactatgttgccctggctggtcttgaacccctaggctcaagcagtctgcctgcctcagtctcccaaagtgctagaattacaagtctgagctactgcacctggccagatttttttgattgggatgtattgcccgtgaattattgtggtcttttggcggtgtcatatttccttgctttttcatgtttcctgtgtccttacactggtatctgtgcctctggtgtaacagttgctccttctaattttttgaattgtctttcataggggaggacattttcctgaagatgtatttgtggtgttggttgaatatggcactttggctttgattctaggtatgtgtcatagtgtagtctctgtgtgttttctttcaatgtgaatgctgtcagtggtgtctgtgatttcttaggtggcttagattgtggttgttagtggaggctgtgataaagttttttataaaagaaaattttaactttcaataaaagaggtctcactctgttgcccaggctggtctcgaactcctgagctcaagtgatcctcccgcctcagcctcccaaagtgctaggattacaggtatgagccaccatgcctggcctgtgataaggttttgctgaggtctgggttgccaagtaggccagctctcaggccccagtggtggcaccagtgggttgaaattgcctgtccttgggcttcagggcagtgtatgctggcaccagtgttagcaggttcaggtaagccaatctttgagcctccaggtgtcttgcttgggtaccaggagtggcacaggtgagccaggcaggttgacaggtttttaaacctctgtgcagtgggcatggtgtggatgatggcagtagcagtggtgggataacctttaggacccaagctgtctgtgctggtgtaggcagtggctgtgatggactggacaggccaatcccccaggcttgcaggtggcacgtgtggttagttgccagctgtggtggtagaggcaggttgaataggtccaatctcagaccctgggaggagtgcttaggtgccaacagtggtggtctatgctaggtgatcgccaggcccacggattgcatgcttggttactgagagggatggagccaggttgtaggagcctgtccttaggctccccactggtacgtgcaggtactggctgtggtaggcaggggagagtgatcctcagactgccatcagaatgctctggtggcaacagcagggcttgtgctgtggccttgttaccgggaagggtggggttgctgtcagtgggagcattcataggcaggtggcttgcagggtcacatactttgcttgtgccttgctcctgctgctgcagcagctattgcaggcagtggaatttttcctcagtgcatgaaaatgcacgggtccccctctgctgcagtgtagggagacagttgctgccagtggctttggtcttggaccctgtggagcagctataggtggagaatgtcaatggggtctccagggatgtggagatgcagggtctgttgggttcccgggcatgacaaagtctggtgggggctgggctctcaaaatgaaggtacactgtacctgcttaggtttgtgggacttagcgtgagctctctctggaataatgttgttgcatggtttctaggcacctctttatgttagactcagggcctgcagcacttgagggcttctcccatggctaggattgtaagagtctggtgggactgtggaccagtggaggtctctcagctctccgctgatcctggttgagcaggctgtcttgcctcctcctcctttcttgctttcagtgcttctcgtcaccaccctgctgaattccagtgttctctcttaggtgatctatttgaagtgtgattatctcctcactattttgttcccttttcatggaagaggcaagtaccaaatgcatgtagtcagccatcttgaagttcctccctttcctgtttttttgatgaattgataattgaatactgtccatgactcagactgtaacaaagtgagaacatagaatcttacctattgtcctcagtgctacaggtattatatccttatatatgtggcgtcagcctcagtccccagatctttttgtacctaataagctaggaaccggtaatatcatggtcagcaagagagagaacatccttaacctaatatttgatcacttactctctttgggaatattttttcaatcttagtagtgatggtgtttctgaaagtccagtagttaaaggtagaattgaaagtgtttaccattcaaaagtacttcagtattttagtaaaaacatacattatagtaaacaatgataaatatgattttcagggaggaaaaaaagcatgagattctttataatagcaaaatagtctgtttacttagggtacataggtccgcaaccgtatcacttcgtcatattaacattccttcaccagtagctgcagggacccatatagtcttaataattaaagtacttttaaattagtttttaaaaatattagaacagatcatgtatgcctggtttaaatacaaaggaatgatagagggttttaaaagataaagccttgttcaaaaaatgaggtaaatttatctgtagaattagtggactagatgtacagcttgcaaagtgagggtgaggccacagtgccagcatttggatatggaaacagggttgacgtggttctgaattcatgtccttataagatcatcagggctgaaagagtcacacatgaaactggagaccaaatctgtggatactgagtaaaacaagaaacagggataggttgtcccacctgttaaaggaggcgaactgcgactgattactgccaatgtggtgacatctaactccaaaggagactgacaatatatattttttactgtggttgccatgtcccttactcaaaattggtagctcttaggaagaagagaaaagatattaaaagtagacagctaatggtttctgcatgtgaaggtacaaaaattataagaccattacaagagaatttcagattcagtgggatatatacagtatagtgctgtggtttgaatgtgtaccccaaagttaatgtgttggaaagttgatgcagtggtgttgggaggtggggcataatgggaggtgtttgggtcttggggacactacactcatgaatgaattaatgctgttattttaggaatgggatccatgactcttcccccactcacccccagatatttgatgccttcctccttgttgttatgtagtaggaaggccttcaccagatgctagtgtcttgatcttgaacttcccacccttcagaactatgaggaaataaatttctgtcctttataaatcacccaatctcagatattctgttatagcagcacaaaatggactaagacagtaagagagaggcagaagttaggtagaatcacagagaagggagtcactgactactcagagatatctaggcaaatggtgcaaagaaaatatgtgaattgggtcttaaaaatacgtagaagtttgctgagaggggaagggcatgctagactgaggactgaaacaccgtgtgaaaggagctgaaactcataatttgtaaatgctaaaaaccacgtgtatgatattctgttgaggtgccagggatacaaaatgaaacaaggctgtttcctctaagagcttgctctgagagacaattatttaaacaaccaatttcaatggcagaatgtcgagtgctgtaataatataaatgtcccatgtgcacttgagaagaatatgatttgtgttgttggatagtgttctctgatacagctaattggtttatagtattaagtcctctttcctcttttgtctgattattctacccattattgagagtcaggtattgaagtttccaatgattactgtagaactgtcttgtttctcccttaaattctgttagtttttgctttatatattttgatgggctgtcattacatgttaaatgtttatcatagtatcttcttgctatattaaactttttattaatgtatagtatccttccttgtctcttacaccttcttgttttatagtctatgttgtctgatgttaatacagcccacctcacttctcttacggttcctatgtgcatggactagcctttccctccttacacgttttacctatttgtgtctttggatctaaagtgagtctcttacggatagcatatatttagaattttttttctattcatcttgccaatctctgtcttttgattggagagtttatttacattagagtagttactgattaggagagactgctgttattttgctatttgttttctttatgccttacagctttcttgtcactcatttgctgcattactgtcttttgtgctgaatttaatagaataattccattctaatttccttttgtgtctattcagtagctactttttgtagttaccatggggattacatttaacattctgaagataaaacactccaatttaaatttataccagcttaacttcagtaacatagagtaacttcctgtacagctccatccctacccccttttggttattttatgcatttgtctcttatgtagaaaataaaatgtgtagtaacaaactaaagttacaattattctagcttttagagtaatgtttttgttgtgtagtaaagttatgtttaaaaaattacaaactgaataaacctcagagttacaaactaaagttacagtaatactagcttttatacttgcccatgcatttacttttactttatatagcttcaaattactgtctagcatcctttcctttcaacctgtttgactcctcttagcatttatttattccagttttaaatttaatgttgttaattgacaaatcataattttatacttttctggggtacaatgggatgttctgacacatgtatacaatgtgaaatgattaaatcaagctaattaacatatccataaccttgtttacatatcattttcataacgagacatttaaaatgtactcttagttattttgaaatatataatacattaatactgactggaatcactgtgctgtgcaataggcctcaaagcttattcctcctctctgaaacttgatatcctttgaccaacaccttcccatcctggcttctccccagtctctggtaagcatcattctactctctacttctatgagttcaacttttttagattccacatgtatgtgagaccatgtctttctgtgccggcttatttaatttagcataaagtcctctaggttcatttatgttgttgcaaatgaaagaatttacttcttttttaaggctgaatttcattgtgtatatacaccacattttttcttcattaatccattgatggacacttaagttgattccatatcctggctattgtgaataatgctgcaatgaacatgggaatatagatgtccctttgccatattgattttagttcctttggatatatacccagaagtgggattgctggatcatatggtagctctaatttagttttttgaggaccctccatactctttttcataatggctgtactaatttaatttacatccccaccagcaatgtacaaatgtttgcttttctctgcatcctcatcaacctttttattgttctttttgataaaagccatgctaacggatcttagtgttttaaattgcatttccctaatgattagtgatgctgagcattttcttatgtatctgttgccattttcatgtctttttttgagaaatgtttgttcaagtcttttgcctattctaaaaccaggttgctttcttgctaccgaattgtctggagttccttatatattttggatattaaccccttatcagttgtatggtttgcaaatattttctcccattctgtgtgctgtctcttcgctttgttaattgtttgctgtgcagttgctttttagtttgctcttttagcatttcttgcacagaagttctagtggtaatgaatttccttaacttttgtttattttggaaagtcataatttttccctcacttttgaaggagagttttgccagtataggattcttagctgacagttttttttttattctcccctttggtagttaattagactattagactatattagcccactgtgttttggcctacagagctgctgatgagaaatctgcttataatatcattgaggatcccttatatgtgacagattactcttactcctttcaagagtctctgtttctttttggatagattataatgtgtcttgctgtgcatctccttgtgttcatgctacttggagtctgttgagtttattgaatatgtatatttatgtctttcatcaaatttgggaagtttttagctattattttttcttttttttttttttttttgagaccgagtctcgctctgtcacccaggctggagtgcagtggtgtgatcttggctcactgcaacctctgccttccaggttcaagcaattctcctgcctcagcctcccacgtagctggaactacaggcacatgccaccacgcctggctgatttttgtgtttttagtagagatggggtttcgccacgtttggccaggctggtagccattagtttttcaaataatctctttgcccctctacttttggcattcccacaatgtgtgtgttcgttctcttgatagtgtctgtttgcctcttttgacttttcttcagtcttttttttttttttatgttgccctatcatcacacttgttgattctttcttctgcctgctcaagtctttattcaaatccctgtagtgaattttccattttagttattgccctcaggagctccacagtttgtttttagtttcctttgagatttttccctcctcttttttttttttaagacagggtctcagtttgtcacccaggttggagtttggctgtgtgatcacggttcatgggctcactgcagcctcaaactcctgggctcaagcagtccccctgcttcagcttcctgagtagctggaactacttgcgctgctgtgcttggctaatttttaaattttttttgtagaagcagggtcttgctgtttcccaaactggtcttggtcttgatatcctggactcaagtgatccttctgcctcagcctcctaaaatacaaggattacaggtgtgagccactgcacccagcctcctttgaggttttctatctctttactcattttcctactttctttctacattgttttcttgcctttctctgtgtcttcttttagttctttgaacacctttaaggtagctttttaaaagtctttgtctattaggcccgtcttctgatctttctctgggaaggtttctgttggtttatttttttttctttcatataggccatactttcccatttctttgtatccctttttgttgttgaaaactggacatttaaatctgctaatgtgataactctggaaatcagattgtctcctttcctcaggatttgctgggtttttgtgtgtgcttgtttttctttttgtttttagagtcttgctttgtcacccaggctggagtgcagtggcatgatcatggctcactgtagccttgacctcctgggctcaaaggatcctccttcctgaggagctgggactgcaagtgtgcaccactatgcctgcctaatgttttattttttgtagagacagggtctcattatgttgcccaagcttgtctagaactcctaggctcaagcagtcctcccgctttggcctctcaaagtcttggaattacaagtttgagacactgcacccagccctttttattttttgattgttgtaggctatctcagatcttttctgagcctttgccttttcctggacatgcacagtgattttcttttgttttgttttttgtttgttttgttttgtttttttgagacggaatctcactctttcgcccaggctggagtgcagtggcgcgatctcggcccactgcaagctccgcctcccgggttcacgccattctcctgcctcagcctcctgagtagctgggactacaggcgcccgccaccgcgcccaactaattttgtgtatttttattagagacggggtttcaccgtgttagccaggatggtctcgatctcctgaccttgtgatcctggcctcccaaagtgctgggattacaggcgtgagccaccacgcccagccgcacagtgattttctaaattccccatttatatggttgcttctgaatgtcctagtcctttaatgtctggcttccaaaaagggagaaagagaaaaatgaagaaataaaaataaaaggccctggtcttttaaatcccctttagcctgactgcggggagcagtggcctctagctattgggagggaggtgaaacaatagctgcctgcttctgtgtctgtatctcagtgatcagaaagcgcaattagctgtcagagcatagatacctgatagttggaggacaggtcttattgcccgaaagctgtggaacacatgcgtgtctgcctggagattggggaatgggtagtcactgctgaactaagagctgaaattgactaaaagtaacagcagtttattttcaggccctttccctggaacttgcaagccttagaatgtgctccagagttccaaaatacttaaataagacagattatactagtacaattgttgtctaggtggagagaagattcttgttgcttcctactctgctttctccccagaatcctctaatgttttttaaaggtttcattagagttagaagagttctttttctccttaattttgaggaactcaagaatagtaagttcattataactcaaagaaaatccattggagaccttttatttagcttttatcttcagttagcaaacatttatagaaggaatttgtgtttcagatcttttttgcgccctaatgtgacaactaatgtgacaacttctggcttccagccagaagatattgggacttgaaattgggagatcgcttgctatggtttgaatgttctctccaaatctcatgttgaaatttgatccccatgttggaagtggggcctaatgggaggtgtttgggtcgtgggagtggatccctcataatatattactgccatccctcttgagtaagtgagttctcactatattagttcctgtgggagccagttgttaaaaagagcctgacacctccccattctctctcttgcttcatctctcgtcatgtgatctgtgtacatgctggcttctctttgccatctttcatgggtggaagcatactgaggttctcaccagatgaagatgcccaatcttgaactttctagccatgagaattttgagccaaataagccttttttctttatagattagcctcaggcattcctttgtagcaacacagacagactaatacgtaccttaaggaggcttcatcaagtagatcacattactactaaggggtagtagtagtgagaatggagatacatggattcatttgagtcctattgagaagataaaagggacatgatttggtctgtggggggttgacgtagtagcattaattaatccagacagctggatttatggtggtactttttcttgaattataggtcacagaagcacaaagtattgtagggaaaggtgtatgaagatgtgcctatgcaataatattgtagaagttgcaaagttcttttatacccaggatttttaagtaagaatgtacggagtgtactggttccctgtaactccagtaggtcttatggcttgcataggccaaaatgataatgggaggcatgataaactttaatagggctgtattagtctgctctcacgttgctataaataactacttgagactgggtaatttataaagaaaagaggtttaaaaggttcacagtttcctcaggctgtataggaagcatggccagagcagaaggaagagagtgaaggtgaaggtgccaaacacttttgcttttgtttttttttttttgagatggagtctcactccgtcatccaggctggagtgcagtggagccatcttggctcactgcaacctccacctcccaggttcaagcaattctcctgtctcagcctcccgagtagctgggattacaggtgtgcatcaccacgcctggctaacttttgtattattagtagagacagggtttcaccacgttggccatgctggtctcgaactcctgagcccgggtgatctgcccacctcggcctcctaaagtgctgggattacaggtgtgagccactgggcccggcctagccaaacacttttaaacaaccaggtctcatgagaattcatcatggaacaacagctatcacagaacaacaaggggggaaatctgtccccatgatccagtcacctcgcagtcacctccagtcacctggagattacaattcgacatgagatttgggtggatacacaaatccaaactgtatcaagggctaagtggtagagtcctaaaaccattttgtgattaaaaatgacataagctcatggaaggcatgagggggaattggaattaagtgcagcaattaatatgaaaaattctcaaatgttatgattagtcataagttaaatacgtctgatatttcaggttaacacaggttttatgtatgtgaactcactcaagagggatggcagtaatgtattcatgaggtatccactcccacaacccaaacacctcccattaggccccatttccaacatggggatcaaatttcaacatgagatttggagagaaccttcaagtaagcatattcaggttttatgaatatgcttactagaagagatgacacaatctaaaccttattaataatgtaaagcatggggaaattatagtcagtgttctctgtgttagtttgtgtatgttgttttggaaatatgtataacttggagtgacactgaaatataataattagattagaagggtaaggatcagaatgagggtttagtgtaatgaaaaacttagaaaataaaacagtttgtttagttcaaaaaattgaaattgtaattttgatactcaataaaagagacttttttatattatccagttcaattcccttattttgtagataaggaaatggagtttctgggaggttggtatgacaggccctgagtgatcactaacggcagagcagtggctacaacccaagtgtgtggctaggagggaaattaaatatattataagcatattttgcttataggggcagccaaacagggctgaaaactagggtaagataaacaagttgcctaaggtgaaatattgtacatttgtaatttatcaaatgtattcatatgtaatatgtaaacatagtataaaatgtggagcattggttcagtttatgtgagaacaatgtggcatgttctgtgtcaagcttgtccatcctatgggctgcatgcagcccaggacagctttaaatgtggcccaacacaaatttgtaaactttcttaaaacattatgagcttttttttttttttttgcttaatcagctatcgttagtgtattttatgtgtggcctgagacaattcttcttccagtatgatccagggaaaccaaaagattggacacctctgtccatgttaagcctcatagatctttctcaggcctggcctggttcctattctcattttttccttgaatcagatctcagagactatattttactttgcatctttaaagttgttttaaccttcacaatcctttgggggtttttctccagcttttgaaaaattggagaatctagaccatcttcctagtgccctccaccttatagcccatgtaaccaaatatgaaagcaatttagagataatagtaaaagggaaataaaggatagttcatatcttacacttttcctgtcatgcctctggtttctagtttgtgactcccattttacttttgagggtcaagttacctaggtcagttctctctccttaggtaaaggtcacgtttctttatttataacagttctttcccacagcacttacgagttagaggtggtttaggttgagtaaaatctctgcttccatgtctcaggaagataattcccagaaccttcgcaatggatgacaaatacatcagtaagctctcaccaaatattagtgcttccctttttggcatcaccctttgtgaggagaataagaccagaatccatagtctctatcttacaaccagtgggtgtaaatttcttgtgttgcttctctggatctgtcctgttttatacctgacacctggcctgtccccaggatcattattctttttgttctttacacccttagagttcaaggcaggccgtttgtttttatattacatttaaaaataaattgtttatgtggagcattctgggagcttagagtttgtaaagtgaaaagatgggtggttttattgatccagcaagagttggctaaatgtatagctaggtttcttctgatattctttatagatacatatctaaataatatatacatattatctcttagttcatttctattaagataaatgaagatacagtcagccctccacatctctgggttctgcatccacagattcaaccaaccacaggtaaaaaatattctggaaaaaaaaatacactaattaaaatatacaaacaaaaaacccaatacagtgaaacaactattcacattttattatattaggtattacaagtaatctagagatgacttaacgtatacaggaggttgtgcataggttatgtacaagtactaggccattttcatataagagacttgagcatctctggattttggtattggggaggaggaaactggcactgatttcccttagattaaccttatccaacctgtggcctgcgggctgcatgcagcccaggatggctttgaatgcagcccaacacaaattcacaaacgttcttaaaacatgatgagattttttggtgattattttaagctcatcagctatcgttagtttagtgtattttatgtgtggcccaagacaattcttccattgtggcccaggaaagccaaaagattggacactcctgccttagatactgagggccaactgtattcattcatgtaacctttcttggcctcattgtcttgataaagtgatatatattcagtgttttcactaatgaccgtgtaaccatgtgagtattgttcattactggctcacctcctatgattaaatttattttcttgtttaacttagtttttcttgaaatttataaagttctcattaaataaatgatggttcgtccgtacaatggactactcagcactaaaaaggagtgaactactgatttacacaacacaaatgaaacaaatgcattatgttaactggaaaagccagactcagcgtctgcataaaacattctggaaaaggcaaaactacatagggacagaaaatagatcaatagttgtcacaaattaatggttggggatgggtttgaatacaaagcataaagcaatttttttttttcttgagggggagtgatagaactgttcttattttcttatttagattgtggcagtgattacataactcttaaatgtttgtcaaattttattcacaacaaacagtgaaaatcttactgtatgtaaaataaacagcaaaaaaatatatggccctatttttatccatctattatgtatcattcctcaatatatattgacagttttgtagatcttacaaatactgacaatgtaattgaatttcatgtagcctctggaatctctagtgaaaagggaaattaacatcctagtattatgaaaatagttttggctccgtagaccccttaagagatccactttagtaaccctttcttagagaactgctaatgtaaatacatgaataatgctagacaaaacacctgaaaacatgttctttcccaaactacttttataaattctataggtatagctatatattaatgacacaaagtttgtcaaatcatttaatcagtcatattgtgtataatttgtaaactgaggaagggtactgttggctgtgtatataggtcatgataaatatgaccttttttggcaagtcagtagttataccctaaggaaaatgtaaggaaccagctagcaataaaataaaattctaaagggaaatctcttgttcagttttagattctgttgtactttaacacataacttgacaatttcctgcttctgataagaatcagctaagtaacaatacccaagtgactaagtccggaagtttggttggggtacagatctcacagtaaacaatgaagggggagaaagtccccaattaactaacttggatatgctgtaagtaatgcaaaaagacaaggcaattcataagatgattttattctcttcagctttttaaaccctagtatctcatcaagtaattttaattggtaaatactcttactaatgaaacaactaatgaaacagatcccaccactgggaaaacaaaaaattacaggctagtcagaaataaaggctacttaaaaattaagtttttcttcttttttttttaaaaatagtgtaggtcaaataaaattccatctaattctgtccacttttggaaatatcactttgaaatcatccccaatatgagaaggcacaaaataatgacaaaggcaaaagtgctgtgcatagcacaattcattcacgtattcactcaacaaatgtttattgagtagttagtggagactaggagacagagcaaaggaatgagaataaagaaagataagcaaaaagtttgctcttaaaaaaacctcaactataattctgtttctttgacaaacttataaatatcttaggtatataagacattactgtctatatgattattttgttaggcattacagaatattacttattacccctctgaactataataaactgatccaagatcagtatcatcatcctataatctgaagattattacattttatctaaagaaagaagccattatgtgactacaaacgtaagagcaataatcttgctaaattatgagcaattagatataaaccaccaattatgaaaacgtgtaacataatgaatttattgtcataattaacacagcaaacatgtaagtacattaattgatctaagtcttatatactatatgggaattaaacataaatggccttatagttgattgtaatcatatttttaaatttctaaaaaattgtggtaaaaacaaatgttatgaactgaattttgtcccttcaaaaattcacacattgaagtcctaacccccagtagttcataatgtgactatatttggatatagtgtctttaaagaggtaactgaggtaaaatgaggtcgttaagatggaccttaatcccttatgactcctcttcctggttcacctggctagaaatattggcattaagtacattcacattgttgtacaaccatctatttccagaataatcttcatcttgcaaaacttaaactctgtacccattaaacagtaactcccctgtatatagatagccaaactaccagtcatgtatgagagaacaaaatcactttcagatatgcattctaaaaaatttaattccaatatatttttaactcaggaaacaactagaggacgtgctccagcaaaatgaagggtaaagcaagaaaaagtaagacataggatctaggaagcggaggaactgtgggcagtagttccaatattggtttcattttctaaacttttgctgtggtatttgcatctttgctttatgcagggatgtgtggggcttgagtggtgtttatattgtacttcatttcttagtgcctttgtgatgcttctttggatattctatgcatgtccaatttgggagagcccagtacttgtgttggtccataactagaattatagatgtcgaagataaactggacactagttaaaatggtaaggacagattttattcagtaactattgcagtagggaagagtgtccagtgtgaactcaactcacttttgccaaaacaaaaggggaagagacttttttaaaggttgagtatgctaagggaaagacactgctaagggaaagaaagatggtttttttgttttgttttgagacggagtctgtctctgtcaccaggctggagtgcagtggcgtgatctcagctcactgcagtctccgcctcccagactcaagcaattcccctgcctcagtctcctgagtagctgggactacaggcacgcaccaccacgcccagctaattttattgtattttagtagagacggggtttcaccatgttggccaggatggtcttagtttcctgacctcgtgatctgcctgcctcggcctcccaaagtgctgggattacaggcgtgagccaccgcgcccggccactgagtggtttttaagggcaataggtggtccatgtgagtaggccatctgggtttgttattggcatttatctggaagagaaacaaacttattatttatgacaggaggtggtggtacaaattaggcccaccaatgtttggcccttaccctctcgccagggactgggaacaaaagtgaaagttatctttttgattgtttgcattccaaagaggtagttctcaggtccttgggaagatagttcttgatggtagaagatttaagtcacaaagggacagagaaaggatttataatttcaagctttctaaggtaactgctctaaatgggggttcaggtgaccatctgcctatcaccaggttttggctggaacaaacggtaaattctggccatgtggagccttttcaggtaaggaacttgatggagttggagtcattattctaggatatggggaaaagatatgaacaagcactttacacagaaaaacaaatgtaaatgtcccttaaatatgggaaaagaaatcactgtaataagagaaatacaaattacaactctgaaatactatttctcccctattagattggcaaaaatccaaaagattgacaacatagtttgttggcaaggctgtggggaaataatcactgatatattgttaggagtttttaaaaatagtttatgaatacagaatttagcagtatctcacaaaattatacaaactttagctgtaactcagcattcttctatgattctaacccaaaggtacactaacagaaaatcaaaatgacacatgtatgaggctgttcattgcagcactatttaatcccagaaaattacaaacaacccattgaccatcagtaaggtctagttgaagaaagtgctacttacataatgatgacgcactctgcaattgttagaagtagtagatgtattagtaaaggaagtctcatgtgctgctgtggaatgatcttaaggatagattgttaaactgaaaatgaaaagattcaggcaatatagtctatgcctatgtgtatgtgtgtgtgtgtgtgcgcgcctgtgtgcatgtgtgtgtgtatgttttgttgtgggggtagataaaaattagaattttcaattttcttatatatttttcttgaatactttccttaaattatttaaaaaaaaatagaaacataaaccaaaacaaataaatagctgtccaggccgggcgcggtggctcacgcctgtaatcccagcactttgggaggccgaggcaggcggatcacgaggtcaggagatcgaaaccatcctggctaacacagtgaaaccccgtctccactaaaaatacaaaaaaattagccgggcatggtggcgggcacctgtagtcccggctactcggaggctgaggcaggagaatgccatgaacctgggaggcggaggttgcagtgagccagggtcgctccactgcactccagcctgggtgacagtgcagtgcgagactccgtctcaaataaataaataaataaataaataaataaataaatggctgtccagtggggtggatgggagaggggagagaaaagagaaggtatgggaagaagacctctctaaatgttttaaatatgtttgatatttaagcatatttaatgtttaaacattcatataaacaatattaaacataatgttcaaacatgtttgatatttaaacatctaccttgcttgatagtttagcttttagaaccatccaaatgttttacataattatgaaacaattacattttaaaaagggaaaataaagtgatcttcaaaaaatgaaaacaagtgagcctaactctacgtccagttggtgtcataaccacacagaagtatatattctaccttttctgtaaggttttatgttttagggtaatagaacaataagcaaaattttcctttgagaataatcacagtttctgaaagcaggtagagctagcacatcatcattattgaaatagttgatctaggcagtgatcatcagtggcaggtaaaaccattgggtagaggtttgatgggggaactttataataatggataaatcagttcagtgctacaaatctaccattcagtcttaacatcacagaaaatggttcaggcagacataatgtgcctcctaataaatggcaataacaagtacacaagaatacttaacgaattattcttgcaacaatgacaaaacaacctagaaaaagtaaagcctctagaaataattaccagtttataggagataggggggatagaggaacaccatgaaaatatacactagccaaattcacgatgtgggaaatgctacaggacaagtgaagccagcttcttaaataaatgacatagagtggggaaagagaacagtgtcagagacttaaaacatgttagcttaagtgcaatatatcgacttagtttggatcccagttcacaccaactgtaagaatgtttaaaaaaatacacttagcaaaaattgaatattagcattagatgaaataagtgttgcaggagttcttaataaaggaacaccttttcaaaatgagcttttgaaaatatactgataatttaattttagtataattgacttgtttgcaatcttatatatttttatgcatcagaaacattgtgagtagaggttctatgtttcaccacactgccattaggcaggaggaggggaggtccatggcttaacccatttgtgcctagtgttccattattggaacgctaagcttgtgagagttatttatatcatgctcaaggtcgtcaccaaggtctgatttttcacacaagaaattgcaacctccggcatatatgggttaaaaaggggaaaaggtcaggagcccttgatttgttcatttttgaggggtatgggtttttaatctgttagtgcttaatgaaatcatgggattccagttcccccaccaaaaattagggggatagctgaaccacaaggcataatattgataaaattgggtgataggtataggattcattatactattctcttctgtaaatgttgaaaagtgccataattataaaacttaaaagcattatataaatttttagttattataccagtaatgtagtagaatgctatttttgtacattctggggaggactagataatattggtaatacttttgtcaccctgataggtaaagtgtggtatttcagtttagttttcatttctttaattataaagatattcaggatcttttgaatactttttgactatttgtgttttctctttcagtttttattttaattaaactttttattttgagatcattatagatccacatgcaattctgagaaactttagaacttattgcgagatccagtgtatgctttcctccagtggcaatacatctggcagaagtatagtacaatatcacaataatattacaaaatttcttcatattgcccttttatagtcatacttacttccctcctgttcctgctgccccgttaaccctggcaactactaatctgtttctaatttccatattttgtcattttgagagtgttatataaatggagtcatatagttaacctttgagattggcttttttcactgagcagttataattccctggagattcatccaggtcgttttgtgcatcaattgttctttttggtatgaacgtaccagtttgtttaattatttgcctgttgaaggacatctgggtggtttccggtttttgactgttagaaataaagttgctgttaacattcatgtaaaatgtgaacataaattttcatttctctgggataaatacccaggggtgcagttgctagcttgtatggtagttgcatgtttagttttatgagaaactgtcagacaattttgcggagtatctgtaccattttacattctcatcagcagtatacgtgtgatccaatttcaacttacccttgtcagcatttggtattaccactcttagccattctgacaagcgtatgtagtgacatctcagtgtggttttaatttgcatttctttaatagctaatgatgaataccttttcatctgcttatttgccatctgtaaatcttcagtgaatgcctcttcatgtttttttgctcattttctagttggatttgtttttctaatgtttctttaacttttctaactgcttaagatagatactcagttcattaatttatttttagctctttttaaaattttattttaaattttattattattattattattattttttgatacagagtctcgctctgcggcccaggctggagtgcagtggcgcgatctcggctcactgcaagccccgcctcccgggttcaagccattctcctgcctcagcgtcccaagtagctgggactacaggcacccgccaccacgcctgtctaatttttttgtatttttagtagagacagggttttaccgtgttagccaggatggtctcgatctcctgaacttgtgattcacccgcctcagcctcctgaagtgctgggattacaggcatgagccaccgcgcccggccactctttttgttttttaatgttactatttaaaactaaaaatctgtctatatacactcctcttgctacatcccacagagttcgatgtatagtttttaaaattatttacttctaagtattttcaaaattcaatatgatttcttcttagattcattagtttttagaagtttccaaacgtggtatttcaaaagttatctttttgttatggttgttggagaatatggttgtaggatatcagttacgtgaacattgagacattctttatggcctggcatttgattgctttttgtatgtgtttcatttgttttctatttggaagcaatattctgtatatgtctattaaatcagacttgctggttgtgatatgagttcttctctagccttaataatgtttttatttatttatttatttttttgagaccaagtctggctgtgtcacccaggcctggagtgcagtggcacgatcttggctaactgcaacctccgcctcccaggttcaagggattctcctgcctcagcctcctgagtagctgggattccaagtgtgcgccaccatacctagctaatttttgtatttttagtagagatggggtttcaccatgttggccaggctggtcttgcattcctgacctcaggtgatccaccagcctcggcctcccgaagtgctgggattacaggtgtgtgccaccaggcctggccgtttttatttctttgttttgttactctgataatatgttaaaaattgtcctctgtggtaatgggtttgtcaagatctccttgtggttctgtcaacatattttgaaactatcttgttactaggtacatagaagtttagatattgtaattgagtagaacatttttcattgggtagtgaactttattgctagtaatggtttttgccctttaagttttgtttgatactaatagagcaacaccagtctctttattgattggttgattgattgattgagacagattctccctctgtcgccaggctggagtgcagtggtgcgatatcggctcactgcaaccttcgcctcccaggttcaagctattcccatgcctcagcctcctgagtagctgggactacgggtgtgcaccatcacgcccagctaatttttgtattttagtacagatggggtttcaccatgttggccaagctggtctcgaactcaacctcaagtgatctgcctgccttggcctcccaaagtgctgggattacaggcatgagccactgcgcacggccatacagtcacagtctctttaaattactatttgcctcatgtatttttttccatattttttacttttcatctttatgtctttagatttttaggtgtgtctcttttgaaaagcatgtgaactaatactacctcaaccttacataaaaatattttccatgtgtttacagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggtaagatattttttaaaagaaaagcaactttgttttaaatgaaacctgcaacttagttctttgtacataattctggcagcagtgtgcataattgacttgaaaaggcaagggctaggtaagtttgagtcatagcaggtggtcaacccagaagaccagtgaaggtcataagtgttaacgtgcagtttctgtaaatctaggcccatgctccaagtcaaggcagagtgataccaatgagtagaactaactctcaccttctagcaggggctttttgaaccatgaatcactgttggagtttagacttataggcagaattgcctctttggcaccaaggcaacttatgtacatggcacataatgaattttaacatctaatgaccttatgttttgaacttcacttaaaaccctccattttgtttttctatttgataagagaactgtggatcattactgtacattagcacctacagagctcttttctattttgtttctctttttccctttatttctccaaagtttttgttttttatttttactggccctccattagggcctgagacagtggagcccacttcacactggacttggctaagctgataggaaggaaatatgcatgggcaaggaatggcctcttctttaaaaaaaaaaaaaaaaaaaaaaaattaaactctccttagctgacaggaaggaattgggagggacagaatttcatttttggtgttcaggcaaacatgctatttgcgtaattgttctttgtctaggtgtagaagaaaagtacaatttctccttgtgcagacagtttgggagcaatatagcatgactgacaaatatgaaatactgttgactcactactttacattagtttttatttatttattttttatggttttgtagagatggagtcttgctctgttgtccaggccaaacttgaactcctgggctcaagcaaccctcccacctcagcttcctgagtagctgggactacagatgcttactaccatacccagcttagtttttattcttattcaacattattgttattctagaatgttcttctaattatcaataaaatacaaatatttaatgtttttaaccattgtaaaactgcaaaaactaaaatatagtacaatttggagtaagatataaagtagtggattatcagtttctgagataaaaatatttccagtgttctaaaggtaattaagtagatataatgtgatgtttaactgctgaggtaactttttaaatacttttgggttttgtgattaagaccattatttttagtttttcaatggaagacaaatcagaaagagattttccttcagtagcagaagagaccagggttagaatcagcaatactggttttgtaaatactggaatttatttaaagcatgatgattagagatattgggagaaattaaggtaatttctgtcaagaaagtatgcctcatagtgatacgtgcacagggtactaagacatacccagttagacttttttgttccattttaagaggacactggtatcttgggattagagtgaatgtgacagtaattaacaaaatatagtgaaaaaactattatcatagagcaaaggggggaagtagtccagtattaggtattactgtatgtaaatctaaaatcccatttaaatataatttttatttgttaatactccaggatgcattccgtactacagtattctgatgttattgagacagttttatcaagattttatctctatttaagtcttaggaaatctctgttaactttattactgtattacagttattgctacctttattccagggtgcttggaaacattgttttgagttagtgatctgtagttaacctgtaaagagatataagtccagcttttacattagataaacttttcccttttctcataatttctgtatccctttttggtaacttaaatatccggtgtaattaatggatttgtttcgcaatggttgtgctggtggagacattgtttgaaagttgagaaggaaaaggggaaaacaaaaggattaattcatgaatatattttaactataaaaaatatatatgctttaaagcatcttccaaaataagtctgaataataaggtcatatttttggccatgattatttacttgttatacaggctgtgttataatttagaggaaaaaaaagttttggaaagagaagcctcagaaaaattttctattgcctgggtgtgggccaggtcacatggattgggtgtgggaagtttcagtgttgcagaacagacgaggaagctcactgagaattatcctgagctgtgttaacaaactgacagaacacagaatttttactcaaaatggattggttaaacgtctttaaagattttttcagtaagttaatctgtttattaaatccactgttttcttgaagttgtgaattagattttctgcttttgtaaatttaaaggaaaactcttatttggtgggtttatgtaagctactacattatgtgtatgtaatataaaccaaatgattggtgatatatccaaaaattgtagtttcgacttggtaagtaaaataattttaaaatgttttagcatgaatgtttaacaagtagagaaaggatataaatggtttgagtttgatgcagttctaattcagtaattttcaacttagcacagacatttgaagtgaattaaataaattgtaaacattaaaaacattagataaaaaggattaggtgaacaaatttcttcatcctcaactttggaattaacttttttttttttaactactttttgcttactttttttttagcggaacagtgtaaagataatctttaataaaaacactagtaaagagaatatttttatttaattaatgtagtattgctagaaattgatgttttgattaatgtgagatttgatattttgatatgagttatgagaacagctatacaaccaagaggaaaatagtgaattcttgactgttattgagtttgggtcatgaagtaaaactaataataatttataagagcctaattctgctgattctgctagtggcctccttatgatcttatagtgaacttaatttgatctccttgaacatttgcttggtgtttctagaaaaatgaacagaggaattattatagaagtctcttatgcacaacaagcctaaggaaacaaagagtaacctgacaagagattccagagaaaagggcaaaagagaaaaggaataagcactttgttgaaaaagaatgttgtaattgtaatgtgaagactcatttgttagctttagtgactccctctggaatatgtctcttctgtttactttttggggagttactaaaatttcagatctttgcatttttcattttttgggtaagttttacctttgaagaacttacttatttgctcattcatttgtttatcaacacattcttattgagagcctactccaagccaggcagaaatcatagggtgaaaaactaatactaactctagcaaatcttacattctggtggagaggtatatgatgattgttattaataatacagtggatttcatatctagatttagtcataagtgatgttgaccataaagcaaccagaaatgacataaaaagaatccattgtggctaggcgtggcagctcaagcctgtaatctcagcactttgggaggccgaagtgggtggatcacttgaggtcaggagtttgagaccagcctggtcaacatggtgaaacactgtctctactaaaaatgcaaacattagctgggcgtggtggcgggtgcctgtaatcccagctacttgggaagctgaggcaggagaatcacttgaaaccagaggtagaggctgcagtgagccaagattgtgccactgcatgccagcctgggcaacagagcgagactccatctcaaaaaaaaaaaaaaaaaaagaatccattgtatcattgatacagtgattcaatatatatcatcaatacagtggtaaaattattctttttgctgagtcttaggaagttgatagttaatgcatttgcagactgggagtcaggatttgaaatttgtaaccaaaatgtttctttgctcaatccctgcagcaaccccagatttttatttattttgccaggcagtttgtcagagtagagacaggctattcatctacttcctacctgaatgggcttataaagtagaagaaacagagtattatgtgctttttgtgtggcagccagagtatctttgaaaacaaaaattgtacaatgttttaaataaaacaataaaaaataatttatttcatgtagatgaagtgaacagatggacatataaaaatttaaataaaaacctgtaatggaaggaataccatatatttatatgtggtatttcttagttctgttcccagacatatcacttacaagccatgtggcctgcaaaatataactgaacttctctgattttctgttccttgtaaaagacagagttgggcaagactaaatgatcctggaaagtcccttctaactctaaaagtcttacatcctggtaaacaactaagcagtcttaggtgtgtcataggaattgagcgaaagcaatgagtgagaaattggttttgaagaagtagaaacatgggaacagaattgtagttgactaaggaattagaagaaacagaaaaactttctttggccccattctcaacacttactcagtgatacaggtgaaggaaaaacaacatgcttaaactaaagaatactgaaatcactaataagtacactgggttcagaaatatatttggaaactaaaatcaagatagaaataaacaagatgaataggaacagacagtattgtaaaactctacattaaaattttaaaaggaattgtatagattggtgagaacctagcctggcagcagcttacatgagtaaaaaacttagtaagagctgctgtggtaatgtaggtactaaaactctcaacacagtccatggtgacattgattcgagtctgagaggtgcttaggtggaggtatgctcccttatgtgtgtgttggccaaataaaacatgatgtaattaatccacttttgatagatattctttaacaatggtattgagaaacttggatgcttccaaatgctggcatccagtatatcaaggatttgcaaaccaggtcacataaggaatagttatgggtacaaagacttgcctcagggagcacagctgtcatatgaagaaggaatgttcacagtgcttaaccaggttcttaagaattcttgtggagtttataatgcattgttctggttaagaaacagtgctataggaaaagagaagtaaagaccagtgggtggtagtgagggaaagatcagaaattatctttacactttttttttttaatttaagcaaagctaacaataaaaaactgcctcagaatggtacacttcctcagtgcttagatctgagcagtttccttccaactacagccaggtccagctatataatgcaagaataaagatttaagtaatctttttttttttcttgagacagtcttgctctgccacccaggctggagtgcactggtgccatctcagctcactgccacttctgtctctcaagttcaaacgattctcgtccctcagcctcccaagcagctgggactacaggtgcatgccaccacacctggctaattttttttgtatttttagtagagatggggtttccccatgttggccaggcatgtctcgaactcctggcctcaagttatctgcctgcctcagcctcccaaagtgctgggattacatgcctgagccaccttgcccggccaagtttaagtaattttgaaaattaaacaccataagcactagaaggtaggaaaatagtaaccaccattgatggagttcctgctatgtactgtaagtgctttacacatagacttctaaaaattttttacaagcattttatgaatttatttttttacacaccaccattgtacaaacaaggatactggaggtttttttttttaacttttagggttgggggtacatgtgaaggtttgttacataggtaaatacatgtcatgggggtttgctgttcatattatttctttctttcttttttctgagaccaagtctcactctgttgcccaggttggagtgcagtggtgtgatctcggctcactgcaacctctgccttccaggttcaagtgattctcctgcctcagcctcccgagtagctgggattacaggtgcctgccaccacgcctggctaatttttgtgtttttagtagagatggggtttcaccatgttggccaggctggtctcgaactcccaacctcatgtgatccatccgcctcagtctcccaaagtgctgggattacaggtgtgcaccaccgcgcctgtcctgttgtacatattatttcatcacccaggtattaagcccagtatccaatcattatcttttctcctactctcctttgcccacccttccccttcaagggggaagcatttggttttctgttcctgtgttagaaataaaaaagattaaataacttgaccaagatcacacaaccagtagcggaactaaaatttaaacttgtatctcctattaaagttctcatagtagatattttattactaaagagtagagaattggagtcggttaagcaatgggttagaagggtttgatgcaaaaaggactagtcaaggttaagaagattgtggtgaactgtgaggtcaggaagtgctatgacctgagtgtttgtgtcccccaaaactccgcatgatcttggctcactgcaacctccgcctcctgggttcaaatgattctcatgccacagccacccaagtagctggaattacaggtgtgcgccaccatgactggctaatttttgtatttttagtactgacagggtttcgcatgttggccaggctggtcttgaactcctggcctcaggtgatctgcctgcctcggcctcccaaaatgctgggattacagtgtgagcccccgtgctgggccattctttttttgacaatgtgtaattagtcttagacataatgtttttaaatataagcttccagagagaatcattctaggttttactgatcttttgcatttcttttaccatacaaaactgtgcaaattctgaattttcaaaaatatcatttgaaacttagtctgtattttcaggtttaactttttttttttgtatgtgcctcatatcattattcacttttactcaatttgacatttattgagaatctgctatgtgaaacagccactgttggcttttgagcagtgatgtcatgtgattgcagctttatttataggaagatcagactggttgatatggatgatgggtcgactgagggagaaactgaattaataaggaaactagtttagtggggtcacgaaacctctggtacaacataataggcctgaagaagagtgaccatagtgagaagggaaagtgttggcaataaggagataggattgtgaggatttgatgtaagactcttaaaaatttttttatgaggtaaaatttgtataacataaaattaaccattttaaagtatgtaattcagtagtattgagtacattaacagtgttgtgcagccatcacttctgattccaaaatgtttccatcaccccaaaaatagtcactctcaatcagtccctggcaattactaatctgctttctgtctctatggatttacctattctggataatttatataaatggaatcatacagtatgtgaccttttgtgtctggcttctttcatttagtataatatcttcaagttttgtccatgttgtagcatatatcagtaattcatcccttttatgtctaaataacttttttttttttttttttctgagacagagtctcgccctgtcacacaggctggagtgcagtgacgtgatctcagctcactgcaacctctgcctcttgggttcaagtgattctcctgcctcagcctcccaagtagctgggattacaggcacatgccaccacgcctggctaatttgtgtatttttagtagagatggggtttcaccatgttggccaggctggtcacgaactccttacctcaagtcatctgcccgcctcggcctcccaaagtgctgggattacagacgtgagccactgtgcccggctggctgaataactattatatgtatatatcacattttgtttatccactcatctgttcatagatggacatttgaattgtttccatattttggttattgtgaacagcgttgtgataaacattcatgtacagttattgtttgaatatctattttcagttaagtgtatacctaaaagtggaattgctggatcgtatggtaattctttgctttttgagaaaccatctgtttttcacatggtggcaccattttacattccaaccagtattgtaagggggattccagtttctccatatccttgccaacacctattttctttctttctttgcttatatccattgtagttggtgtgaggtagggtcattgtggttttgatttacatttctctaatgactaatgatattgaggatcttttcatgtgcctgttggccattcgtataccgtagttggaacaatctttattcaagtcctttgcccatttttgaagtagttgtttttgttgttgggttctaagagttgtttatatgttctggatactagacccttatcagaattatgatttgcaaatattctcttctaattctgtaggttgtcttttcacttcttgatagtgtgttatacacaaatgttttcaattttaatgaagtataatggatcttgtttttttggttgcttatgcttttagtgtcagtatctaagaatccattgctaaatccaaggtcacagatatttgctcctatgttttcttctaagagttttatagttttagctctgacatttggtcatttcgagttaatttttatatatgatgtgaagttggagtccagtttcattcttttgtttatagatatccatttgttccagtaccctttgttgaagaaactattctttcttcccattgagtgatcttggcaccattgatgaaaatcaattgaccatagatccatgggtttattttaggactctcgattctatttcattgctgtatatgtctgtccttattccaataccacactgttttgattactgtggctttgtagtaagttttgaaatcagaaagggagagtcctcccacttgattttcctttttcaagattgttttggttgcttagggtccaccttgcagttctgtgtgaatattagaatcagccttttcatttctgtggaaaaaacaaaatggttgaactttagtaagaattgcattgaatctgtggattgttttggatactgttgccatcttacacagaatatctttccgtttatttaagtcttctttaatttctttcagcggtgttttgcagtgtttagtatatgagtctgatacttggttaaaattattcctatgtatcttattcttcttaatgctgttataaatggattattttcttaattttgtctttgaattgttcattgttaacgtatagaaatacaactgattttgtgtgttgatcttgcagctttgctgaatttttttattctcactctgtgtgagtgtgtgggtgtgtgtgtattctttaggattttctatttataagatcatgtcatctgtggatactttttcccctccctaattgctttgactagcacttccaatacaatgttaaataaaagtggtggaaggagagcatccttgttcttgtcttgttcctgttcttacggtggaaaactttgtctttcaccattgagtgtgatgtcagctccacagttttttgcagatgccctttattatattgaggaaattcccttctaatcctagtttgctgagcattgttatcatgaaacggttttggattttgtccaatactttttctgcatcaattgagatagtcatttgttttttcccctttgttttactaatatgaggtgtcttatattgattttcatatgttgaaccacccttgcataaatcccacttactcatatacagtccttttaatatgcttgctggatttggttttcctagtacaaatgatccttatttttcacagattctgtatttgtgaattcacttattggctaaaatttatttataagcccaaagttgataattgcagtgttttgtggacatgtgcagtgtggcaaaaatgtgagtcatctgatgtgcacattcccagttgaggcaatgttcttccttcttatttcagctttcatactataaaccagtgtcctttgtgcagtctatttagtgccacattttttgcatttttgtgcttgttgatgattttgctgtttaaaatggcccccaagcatagtgatgaagtgttgcctagagttcataaacacaagaaagctgtgaatttgcttatggaaaaaatgtgtgttagataagcttcatttaggcatgagttatagtgatgttgtgaattctatgttaatcacaatttatattaaagtgtctttaaagagaaacacacataaaacagggttgtgtagtgattggttaacaaaaacatgattggagcctaaccctgtttttcccttaggagctgtggttcagtatttgctaattcagtatttatggtaactttatagaacataactactgcaaacaatgaaaatcaactgaattttgttgaggatttttgcatctatatttctaagtgatattagccagttgtcttgtgatagctttggtattctgggtaatattggcctcatagaatgagttaataagtattctctccttttttctttttagagatgttttagaagcattgatgttaattcctctttaaacgtttagtaaaatccaccagtgaaaccatctggtccagagcacatttttgatgcgagatgttttgttactgattgaatcttttacttgttatatgtctgttcagattttctattttttcctgagtcagctttggtagtttgtgtgtttcttggaattgatgtttttcttctaggttttttaatttattggcatacagttgttcatagtatttgtttataatcctttttaaaatatctgtaaggtctgtagaaatgttatttctgattttatttatttgagtgtctctcttgttggtctagctaaagagttttcaattttactgatattttcaaataaccacattttggttttgttgatttcctctgtttttctgttctcttttgtgtatatctctgctctgatttttattatttccttctttttgctttgagtttagtttttcttttccagttccttaagattaaatttaagttggtaattcgagatctttcttcttttttatgcaagcttttagggctataaatttccctctgagcattgcctttgctgcctcccataggtttttgtatgttgtgttttcattttcatttgtctcacagtagtgtctaatcttgtgaaatttcttggtgacctattggtttaagagagtgttagttgccacacacttgttaattttccagttttcctttctgttattgatttctaggttcattccattgtggtcagaaaagatactttgtatgacttcaatctcaaatttattgaggcctttttttttttttttttttttttaaaatagagacagggtctctctttgttacctaggctggagtgcagtagcatgatcatggctcactgtagcctttgaactcctgggttcaagcaatcctcccaactcagcctcctgagtagctggaactacaggaatgcaccaccacacctggctaattattttattttactttttatttttgtagagacaaggtctcaccatcttgcccaggctgccgtcagactcctgggctcaagtgatcccccgaccttggactcccaaagtgttggaattacaggcttgagccactgtgcctggcctattgagccttgttttgtgtcctaatatatggtctatcttgcagaatattccatgtatacttgagaaaaatgtgtgatatattctgcttttgtttgatgggatattctctatatgtctattaggtctagttggtttatagtactgctcaaggcctctatttccttaatgatttttcatttagttctgtcccttacagaaagtggggtattgatgtctccaagtatattgaactatttttctccctcaattctgtcattttttgctttatatgccttgaggctctcttgttaggtatgcatatatttgtaactgttacacttcttgatggactgattcttttatcaatatatgctgtcctttgtctttaagtctgtgttgtgtgatatatatttatttatttttagacagtctcgctctgttgcccaggctggagtgcagtggcgtgacctcggctcactgcaacctccgcctcccaggttcaagcgattcttctgtctcagcctcctgagtagctgggattacaggcacctgacatcatgcctaactaatttttgtatttttggtagagacggagtttcaccatgttggccaggctagtcttgaactcctgagctcaagtgatccacccgcctcggcttcctaaagtgcagggattacaggcatgagacaccgcgccgggcctatgctgtgtgatatttatatagccaccccactctcttagttatcctttacatgggatatcttcttccatcctttcattttcaaacctatttgcatctttgtttggatctaaagtgagtgtcttgcagataacagttgcatcatgttatttttaatctatttacatttaaagttatatctgataaggaaggatttctgctattttgctgttttcatttacttttttttctttcaattcttctattactgtcttcttttgtgatttctttttcttttttttttttttttttggagggtgggggtcagggtctcactctgtcacccaggctggagtgcagtggtggaatctctgctcactgcaacctctgcctcccaggttcaagcgacacttatatgtcagcctctcgagtagctgggactacaggtgcatgccacgatgcctggctaattttttggtatttttttggtagagacgaggtctcagcatgttggccaggctgatcttgaacttctgacctcaagtgatccgcccaccttggcctcccaaagtgctgggattacaggtgtgagcctctgtgactggactattttctctaatatattgttttattacccttcttgtttctctttctgtatttttgtttttccttagtggttaccctggggattaacatcttaggtttttaacaatcatgtttgaattaataccaacttagtttcagtactatgcataactctgctcctttgcagctccatctttgtatattacatctttacacattaaaatatatgcccattaacctagaattgaaatttttgttttatgcatttgtattttaaattgtgtaggaaagaaaaggagaatttacaaaaaaaaactgcaatactactgacttttatatttacttatgtagctacctttaccattgttctttatttcttcatatgacttcaaattactgtccagtgttttttcattttagcctggaggattctctttagcacttcttttttgagacagtcttgctctgtctcccaggctggagtacagtggtgcggtcttggctcactacaacctccacctcccgggttcaagcaattctcctgcctcagcttcccgagtagctgggactacaagcgtgtgccaccacgcccggctaattttttgtatttttagtagagacggggtttcaccatgttggccaggctggtttcgatctcctgacctcgtgatccacccaccgctgtctcccaaagtgctgggattacaggtgtgagcccctgtgcccagcctctctttagcatttcttagcacaggtctggtagtgatgaattcctttagtttttgtttatctgggaatgtcttatgttctccttcatttttgaaggacagttttgctaaatatagaattctttgttggctcttttgctttcagcatcagatcagattctatcccctccccagggcttattactgctgcttattgtgagtggttgttgtttgcttgtttagtgactttactaaactacttttataagctctatattcctggtcatgtggggccgctgaagtctattccatttgcttagtaatcagctagggttttaacagagtttcgttaaacacctggagccaaaagaaaaaacaaacaaacaaaagaaaacctctccccatctttacagatggctttatgttggggcagtttttgaccacttagtgatgccatttataattctgccttagcctttgcttactgtttgctcaaagcctgaagatcagccagggtgaaagcttagggtcttcttgggcctttcctgaatgtgcatccagccctggccatgtgcacgtccttcttgattggtatacacaccccttattaccccatgtatattctttcccatcccctttctgtccaggcttttccatctgtctgttccttgtcccagttgttgtcccttgccccaggctgctgcatccattaaatgatttttgcaaaaaccacccaggaagactccctatgcctgggaatgattcaagtcaggcaaagccaaggcaagccattgctcaggtccttcagggagctgccagacaagttgaaacccacaatcacaattgtttaagaatgagatctgtattgcttcctctggcattaggagtgcaggttactgtccacacagccatcactgacttggggtgtgggggatggtgggcaggcaacttaggatgcgatagcactctctttaccacaaagcagcaacttctttctttaccaagccttgccctagattttataagttttttttttttactagattccagagttctgcaaaagttgagtctgacagtatttaccagctcattaattgcattcattgctttttgcagggacagtgccttggagttccttactctactatttttggtggtatcaccccaaatgtagggatttctccgaaggctatcattaaccggaagtaagaaaattaggaaggaagaagttgatttaggggtatagactggattatttttatttggacatgagtgttgggtttgaggtactgatggcacaatctgtgggtgtctagtgacagttggaattgtaatgcctgaattccagaaaggtcttagagctgcaaagagatctgggaaccttctgcacagaaattatagaaaatgaaagtgtatgatttccttggaatagagaggaaggtcaagtatgtcatcttgtgaaacactttcagctaaggaattcttcatttattcattcagcatgtttgctgactgctgaatacataattttgtttttcctttgttcctactactgatgtatgtactgctaagcgttggagacagaaacgaataagatctcgttttctgccctcaggaagttcactcatattgaggaagacagacaaataaacaagtacaatgcagtgttataataacaaggttagaggagcctagacagaggtaaacaagaatatgtaaacaggttgggagggaaaataagaaattcggggaagtcaaagaagaagaaaacataatggagagagtgggctgtgatcttggttgctgcatatagagtttgagaaggctgaggactttaaaagttactgatttgacagtaaggagagatgacataagaatggtattcataagaatggttttaattgagtagttttgttagaatgttggagacaaaggatcagataataaagagttgggagtgtgagtggtgaaaaagtcgagggaaaaggaaaaacaactttttttttttttttttttttttttgagacagagtcttgccctgtcgccaggctggagtatagtgacgtgatcttggctcactgcaacctccgcctgccaggttcaaacgattctcctgcctcagcctcctgagtagctgggactacaggtgcacaccactgcacccagctaatttttgtatttttagtagagacggggtttcaccatgtttggccaggatggtctcgatctcttgagcttgtgatctgcccgcctcagcctcccagaatgctgggattactggcatgagccaccgtgcccagccgggaaagacaacttttaaaagagtggtatagtttattctataggaaaattggaccagttagagaaaaaataaataaattaccaaaatgttacggtttaaaagttgtagcagagttaaagtaacttcattttggagtagaaaagatatgagtgtgtttttagacaattgaagggactaaataggaaggaaaacaaggatgtcgagagtcccaagagagtcaggaaagatagtattaagatcctagaaggatcaggatttggagacttgagtgaagaacgagagtgaggataatgagagttttgagacaaaaggaatttgagaagttttacctagggaagcctcagttttctaggtaaagtagagcataaaatcacacgctaagaaatgggcagcagtgaaaatgcctgactgaagttgatgtagcgtacatttgtattgatagtaccatttggtgattttctcatttctttcaacacatatgtgttaagcatttactgtgtactaagcactatacaagatccttgggattctatctgtaaacaaacaaaactccctgtccttttggaggttacatatgactggggtaaggggagaaaaacaaataatattttaaaataaacatatgaggtaaatagagctacctgggtctgggaaccaagaaagcaaatgggaagattagccagacataactgcaattttatattgcatatcatattctgatttaagatagaaataattttatttttatacagctcattgtagaatctagcttgcttaaactaagacaagaagagtatgggtgtggtggagcctttgtgtacttagattgtagctatgaaagaaatctatatttacatttaagagggaattcattaatttaggacaactttataattatgttatatagttatttcagggcctttgacaagagaaaagatggtgaactgtcatataataacaaattaaatatttatttggttaagaaaaagaaaatttgcatcttatttccaaaaagatgatttttaactacatagaaatttgttatatttaaaagctttaaagatctatatagagttgaagatctctttttaataatgaataagttcattcttttggtaatcatttttttatattctcctctcatggccctttttaatttcaacaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcggtaagttgattttcggaggtaaatacaaatagagctctgggtattttaaaaaaaagagagagagaaatggagaggttaagtggcttccctaaagttaaccaggtaacaagctgggacgtaacataagcataaatgttccaaagctaaagtccgcattctttctagctatctattttgaataaaagagagctgtggcagtgttgctacacactgaattatttcgtcttgtctagttctgttgattttgcattcctgatatattttctgtttctgttgcattaaactaaatggagaaaatggaacactggcctcttcattgagagtagaataatactatagattaaactgggaaacatttaaaaaattgctatgagcaatgtgtaagaaggtagtcactgtagtccttatgacataggaaatccctgaatttaaaaaattgatattaagtttcttcataaattggttacttggaaattggaatgcacttttattataacctcaaaaaacctattttagcagtgtttgaaatgcatttgcaataaaagataaattatattgcaatactagtaaacaataaaactataaaaccataaaagttgaaaaataatatggtttcatggtctcttttagatactgcttaggatattagaatttgatgacactcattttccttaaaaatggcctttctttttccttgatgaaagatatcactacttttccatttattaaatcatggttaatcttggctttgcgtgagtatatttgtacaaaagggaatgtgtaattgcacaaaattttgaaagaaaatgtgtggaagtggggtgtggtggggagagagattaattgaacttcctgatgtgaagttcaggaaaatggggcctgtgcctaatccctcagaaaagcagttggttggcagtagggaagagtgatgacatccattttctgttagttgcctgatctggctcactgtttgaaactttgggagtaactgtagaaaaagaggctttgggggttgatatagactgtaacaacaacaacaaaactaattaaaaagaagatagcttgaatgcagaattgtatgtattttcttgtgggtaattgagtgtagatattagacaaaatgcaatatataccattatttttagcagtatactttttaaggttagaggtctcaagtaggcatattttgtttagccttcacagtgttttttaaacatttaaattcattgccgatatttaaatattaggatatttattataaaaattcagactttagaccatttaaaattggaagaactaccaacattgagacctggttcctgcaaggcaacaatcacagctgagaagtcaccacttgtttagattggtgatacactgtcatttcctctgcccatctacctttccactctgacacttatttacattattcttttggctcttgtaggcatttgagtttgtggcctctccttaaagtttagattaattctcatttgtgtattcttcatttttgggaattcagcatgttatctctaagacagctactgttagctacacattgaaaaggggttgggtgggtatcttagactttctcatgtgtttctctgactggagagaagatagctcttgttcttcaaatatttaactaaaggatttgctgtgggtgtctgctgttggagccgtgggtgttaagagacttttgattatgcaggtttgaatcctggctctgttgttaactagatggatgatattggccaagttattaatagcttctttgagactcagttttcacatgtgtaaaaagggtttgttttgaagagtaaaggagataatctatgtaaataatttaccatggtgcctaggacttagtaagtgcttagattttagcttttagtttaatataaaaatactgatagagggctttcaaaatgtttactatatgtatcttttttttctcttttagccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttccagtgcttctccctcatctggttattcaagaaaacaaaacagtctctgagatatttagcttttcaaactgtaaatagatgctctagtgttatttatttttttaatcccacttgtattattttacctctagagcatcttgtattaggacatgttatatttatgccagtgggaaataagttatggccaagttttgcaaaaacaggaagcagtgagatacttgtttttttctcctcactaaatatcagtaattgtcaggaatggtattacctattttcatttcctcttttcagctttgttttgttgattgggacactaaaactgatgtatacctgaggaaaaaatagaatgtgctcatggttagggaaaattatattatttttaattttttaatttgttttttaaccaagtaggaatttgggtgtatggataagaggccaatctgcttctgtaggctatagaagaaaaccagttgtattttatggtcataatttgtccccctattattctggagatttaaatttaagtaaagtagccatcagtattttaattgaaaaatactaaagccacataactgagtaggatgtcgtatgatactttcaacaaattccctaatgctgcctaagcatatggatgttttaattctttgctgttataaatagatatctaatacgccagaattactgatggtaaaattgaagttgtgtaacttgtgaattttttttatcaatgttttaaatattatttaaatcttaaaatcatttaaagacttatgttgccactgggtggcagccatggcttctcccactaagcaacagaagtgaccaaatataattaagacaaattttcatctctattacatctgcttttaaaacattttagttcatattctattatttttctaactcagtactcctttgttgagggtaattattagtagttaagtttttaatggaaataaaaatcatgtatgcttatctttgctgtaaaatcaaatgaatataaattgaggaaaactttaaattgttgtaggatgactagtagtaaacatcatcttaatttttaacatatatttgatgatgctttccttttctctgtatgtttctgggtttttccccagtcttccttatgaaaaaaatgtatgtttgtaaaaagagaacaattaatgctttgcatcacagacataaactattcatagtaaactgcactgagctgatattaatagagcagacttttgagaaagtaggagtgtagtagcactggaaacagaatgcaaatttctgttccataattaggtttattgtagctatagcgctcccagataacccatgtgtgctagtaatatctattgtgtgctcttactatggtataaaaacctcgctggaagctacttattttgtacttaaatattttaccaatttttaaaaagtcttaatccaatgcttataccagtgactgtttttataatacttgaagtaactttaagaactgaaacaaccctggaaaact

SEQ ID NO: 12565 - DNA, 136058 bp, Human
  misc_feature (1)...(136058): n = A,T,C or G
cagcctgagcaacatagcaagacctcatctcaacaacaacaaaaattagaaataaattagccaggtgtggtgacatgtgcctgtagtcccagctactcagaaggctgaggcatgaggatcacttgggcccaggaagttggggctgcagggagccctgttcatgccgctgcactccagcctgcaagacagagcagaaaaaaagaatcaggatcctgggcagagggaggagaggggaccggggtccagcaagcacttggggattgactgaatggcgttggggagagatgactccaaagtcctggagtgggtgagaatgactgcgagtggcttttaggtggggaggttcctgcctggccactccgggaggggacgtggggctgaagggtatcaggtgccgtgctgagcagtttggccttgatcctaatgccctggacacacgtctagggtaggaaagttgactgatccattggtgatctgagtttttagacatggtggtagtccatgaggtgggtgttcatgctaagagtttagacagggaaacctatgaagcccttagcaaccctccagggaaggggcgtggttaaagagatgtttcataagtaacagcatggtatagaaactctgaaccccaaatgtatgggtcctcaggaacaccccagactttagaaggaaagtcagaaggtgctgacacgggtgtataactaaagggaaatccttctttctcagctccaaccatggctgtgaggttcattcacactgacttaaaaaaaaaaatctcagtttacttaaaagtaaatagctttttctataattctggtttgctaatttaatcctagtctccagaccctggctaaataaatgcccatttctccagatggtctcaagagtctctggacatcgtgggggcccttccctgttggttggaaggtgcctcaggaagaagggggtggattctgagttgagtcaaaacctcaaagacccctgatgggaaaagctctcaagtgaccaccgctgtgggccagaatgcaaaactgcaggaacagaacattcgcaggaacagaacacagtcgtattaagtgattttcccgagcaggaagtggcatctggcctgcggttcagtagggggaggaaaagggtgggcgcacctgcccctggctggcgcacctgccaggtagccccacgcggcaccgcgtgtgccgagcgcccctgaggatggaaagccccacgcggggcaggtggcacccacccctccgaagacgggacgggatggagcgttgagcttcggggcagctccggcccggcccgcgctggagacgcccgcatctgccaggatggcgtctcatagccctggtgctcacacatgacgccaggaagccccagcaacagtgaccgcccaggctctagaaaatattggacggggtggatgaacacccaagtgcgctccaggagaagggatttggcaccccaaggggcttttaaaacggtaagcttctaggggtgtctttgcccccaataatccatagaaacaacagtcatctaaaaatagtcttgttttctgtcctaagctccttttaactttgttagtcatcaccaatcctaaaataaaacccgtgtaacgtctcccctagtagcggctataaacaaacctacgaggaggcaggaggaagaggaaaggggcgcagggcgctcggggagcagagccgggggcccgcggtggccgcagaggccgggccggggcgcagaggccgggcgagctggccgcgctctgggccgccgcctccggaactccctgcgcctggcgcgcggccaccgtggtcccggcaacggcattaaacagagggaaacagacccgggattccgtcacccgggcggggggataaggacggctttgagagcagacaggaaaagggagcttttctgcatggggtgaaaaaattatttattgaaggaggaggaggcggcagcggaggaaggggaggggcgggaggaggaggaagagccggccgcccccgccccggccccggctcctcaggagccaagggcagcctcgccaggtcggtcccgggctcgaggaccgcggctggggtcgaggggctcagtctcccacgtgaccggctgggcgcgccccgccagacccggcctcgggattccctcctcccggcgagtctccgcccgccccgtcctggaggtggggagaaggagggcggggcgggggggacggaaactctccccgccaaatcctggccccaggcctggggacactcgcggcgggaagatttggaggggaggggagggggaggggcgtgggggcgcggcctcgctggagtccccctccccccccgacccccgcccaccggcctgggcgtcctcccgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgaaggagaggggcgggcgctcggcgactcgtccccggggccccgcgcgggcccgggcagcaggggcgtgatgtcacggcagggagggggcgcgggagccgccgggccggcggggaggcgggggaggtgttctccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaaggtaagccccgcgcggcctccgcccccggacccctgcgccccccacggcccgggccgcgccccccgaccccgcccccgtcgcccgcacggaggggtccgggccagagaacgaggtcggccgggtctgtgcgcccagggaggggcgcggcgcggaccgggaacggcgtcccccagctcccagcagcccggttccgagcgcgccttctgccaataggtgtctcctctgccccagcgctgagggcgcgaggcgaggccgccgcgggtcccgccgaggaagcggctcgcaggccggcgatttggggacgggcgaggctgggccgtcaggaccacagagggcacgtgggagggaggaagggaggcttccttgggagtgaaggatgccccgtgtcttcctgagcgaggcagagccaccctctggcgccaagatcgcggtttgggggttctgcgccccccacccccaccccgagctcgtggcggcgtctccctcgcgccgcgcccctgaattccccagggccgagcccgtcacgccggctcctggacctgcaggaccaaaagatccaaagcgcggccgcagcacagccccgaatttaagccattttgaaatcctataggcaggagttccagccagagaagatgtttcaggcaagtttgaaaaggaaccgccaagtttcgagctgcttctttatagtgaaaaaaagatggcacagtgtgggtccctgaaacccggtgtggggggcgctgagacccccctgcggcgcatctcacattccagtcccccaccttagcccgtccccggcacacacccctggcgatgccgggtgggctcctgcaagtggctttgaaaatacccttgcagaggtgtgagcatacgagttagggattagggattgcaatgctaatggaaattggaagacgcttttccaaattccttaccagctctgaaatattttatataatttatttaaagagcgccagcacacctgccaacatatgtacttcataagggcagacgtccttccgagcgctgccgcttcctgcgcgaccctgataactgcggggcttgcttgagaaccgggctcccccagctctggaaaactcgctggtcttagcagagctgagcacagggccgtgagctccacggaggggggtccgtgtggtcggtgccctgacgcttcacgggacgggaggtagacaccacttcatcccaatgttagaaaatgttgacatgtttaaaccatgtcccgtgtcagtgttttacacaatgtgctcttgctagtagcagagtttaaaaaatttttttttgttggagtttcggttttaaatcctgggacacttacgccgcagtgttcattatcactccctttagaaaggcaggtctttccaagttcagatctctgtacctgaagagccggtggccgacctgtagtaaggagcccctttcttttacgcaaggaaaaaacacgacggggcagtggctagttttcgtgtttcctactgaagaaaataagctcgaaaaggtccctgctgcaaggcagtgcgccgggcagcgacgcccgaccgacatgggtgtattttatgagggctgcagaactgggccagccggaaagtgtgatctagtccttgatacacacaggccggcagcatggggacacgcgtggtttccacaccagccatcgctgagaccaccgggaagaactctgagtccttctgagtaggccccacgaggccattcctggcccatctgaggacctgggcgcctcccctgcgtccctcgggtttcgggaccatctgggtggaagctcattaggcgtcgtggttcctgaaggccccgggcttgcttcctcatggagaacgcagagaagtacaggcctgtaagtagccacccagtcagaagtcgctccagacacaatgccccacgggctggggccaaacaaagctcaccctgttctctgccacttaacttcacagcgttgtttcccagctcagattagaaaatggcagggcgctggcaccccgcttcatcacacccagcggggcttctgtctccgcagacatccccagcctctgggaggatgcgtccaagctaaacatttccatggagacacccagtgtctgtggaacgggcagctttgaatctggaccaatagctctgaaccatttgcaggaaggaagcccagcactggggcgggggaagggggggctcctaggagcagcaggggagccgccccaccgaccccttctctgggatggagaccagtgcagtcctaggacagcagcagtgagcctccatccctgcagggcccgcggcctggggccaccagcaggcgggacagtttagcaaaaagttttagtctaaacagatgataagggctgtcatttgtgtataattttatggtgggggtaaaaaggtggctggagttttaaaaacaatgtacaggccgggcgccgcggctcacgcctgtaatcccagcactttgggaggccgaggcaagcggatcacgaggtcaagagatcgagaccatcctggtcaacatggtgaaaccccgtctctactaaaactacaaaaattagctgagagtggtggcgggtgcctgtagtcccagctactctggaggctgaggcaggagaatcgcttgaactcggaaggcggaggttgcagtgagcagagattgcaccactgcactccagcctgggtgacagagcgagactccgtctcaaacaaacaaaaacctgtacaatggaaagagaatgaaacgttgtggcttctcaacagaaaacagaacttccacttgcccaaggtcggcaaaagcagcaaaactacaacaaaacaacgctccaacatccatcccaaagtcagaagtattattagaaactaaatcaggccacacggaacgatggcttatcactggagaaaaccagccagtgaaagggtcgcgggagaagcccggggacgaccctgggactggagggtttctcgcctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctgggggcggggggcacagtggatgccagtgaacatgggtggtcagtcccagagctggcgtcttgcagctggggcagatcctggggatggtgtgtgtgtcctgaccagaggccaggctggaggctggaattggcgtcaggatgcccagctccagctccaccccagtccctgcctgtggctctggggaaagaaagacctccttattgatttattgatttattgatttgacagggtcttgctgtgtcgcccaggctggagtgcaggctggagtgatctcagctcactgcaacctctgcctcctgggctcaagcaatcctgctgcctcagcctcccaagtagctgggactacaggcgtgcgccaccatgcctggctacttgtattttttgtagagatagggtttcatcatgttgcccagattggtcttgaacttctgacctcagatgatccgcccacctcggcctcccaaagtgctgggattataggcgtgagccaccgcgcctggccacctccttgatttattgacattactgttctctctccggtgcaggagactgcgtggctcccgtcctcttgagggcatttctttacgatggggaaggcgggactggggcctggctagcaccatccccaaggcgctcagcctcagcggaggggcccttcccatacgaagacatcctgagcaggtctcacctcccacccctgagagcttctggtcgcacctgtgaggtgtggctccatcgcagctctgtttcttttctctttgttatggctctgccccctgagtgtctggaatttccagaaagcagctgtgactcctgggattgaggccacggtgtgtcctcttaccaggctgccgtgccgtgtttcccacctacctggggcgctagaaccatttctgttagtaaatacagtgggtttgtattggtattttgagaccctagatttttttggcatttatccgtgttggtttctgaaccacgacttagcggaaagacagcactgtccttgaataaagtatcttccagccagtgcagttgcaccaggagatgaatatagaatttccatgtgcttgtttgtattatttagaggcctgggaatacccacctctaggcatgtaatcatgaggttccaagatgtcataaaaagtcttttcaaatcagaaatccagaggcacgtctttcctgttaaaattactgatttccctaataatgattttaaaaaatattttattgagtgtaattaacacataatgattcttaggactagctgtgtaccagaatcttctgttttgttctaaaagatggattcgtaggatatgagccagtatcagaatctccatgagggggatttcacagtctgtgttttcatccaatccttgaggagttttctttgtagctggtgattagggcaccttgacagtgataagcctgttaaaatctgtttacatatgtaggtccttagatctaaaacacatccaccatccatcatcatccatccatcatcaaaccattattcctccattccctatgcatccatgcatcatcatctgtccattattcctccattccctatccattcattcatcatccatccatccatcatccatccatccatcatcaaaccattattcctccattccctatccatccatccatcatccatccatcatcatccatccattattcctccattccctatccattcattcatcatccatccatccatcatcatccatccatcatcaaaccattattcctccattccctatccatccattcatccatcatccatcatccatccattattcctccattccctatccatccatctatcatccatccatcattatccatcatccatccattcctccattccctatccattcattcatccatccatccatccatcatcattcatccatccatccatcatccatccattattcctccattcctcgtccatccatccatccatcaccatccatttatctatccatccattcatccaccatttacctatcatgcctccatccccaatgcatcattcatccatccatccgtttagctgtccatccatccatcatccatccattcatccacccacccataatccatctctttatccctcattcctcccttgtttgtccatcaccatccatctacctactctccatctacccatcatcccttcaccccccgtccatcatgatccatccatcagtttctttacctgtctatccatcatccattgtccacccacccaccaaccatccatccattaaacaaattgaacacattttatgtgccaggcacagtctttggctctgaaaacagcggtgagcagaatagactaaggcgtccagatgttctgtcttcatggaacttaggtttctgtttgtcaaagagatgacagtgtgggatgaatgagtaaaaacaggctgttagattgtgatacgtatttaggagaaaaaataaactagagaaggatggcccacgtgttgagtttggggtttaaatgaagatggggtggttgaggaaggtggtttttgaatgaagagtggaacccgtgaggacccagtcgcctctctctgggaaggacgttcggatgaagatggggtggttggggaaggtggtttttgaatgaagagcggaacccgtgaggacccggccgcctctccctgggaaggacgttcgggggcttgtgctgctgttaggggaggaggggaggtgggcagtgaggggctcacgggagccttgttggccaggtgggactggggctgtcactccaagtcgcccggagctgtccggcagcgtggtctcagggacgtttgctgaggcccgctccttggggtccgttggtcgaggccgggggttgctggccggccctgagttcatgggtttctgctttgtgatgcccagcccctcatgctcccatctgcttctttttctctctagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccgtgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgaggtgagccggcagcgcggggcgggacggggaggcgaggggaggcgcggggcggggcggaacgcggggagcgggacggggggcggcgcggggcggccgtgtctggggacgagagtcaggacctgggtgggcaggtgggctcctcgtggagctgggaggcagagtctgtccccatgtctgcctcctcatgcagacttttccttgtgcgcctcgcctctgcctccgtctgcgcgtttcccatctgaagtctccagatcctctcgggccctgctgatggcctcgtgttcgctcagtctctgcaaacacccatttcaaagagggtggccctgctggcggtcagggcttccacgtgggaattccgggagacgccatccgcccctaaggagggctcacacacgcgcagtttcttcctcggggaattgcacgtgcctggcccccctcggtggttgcctgctgctcccgcttcctcccctgcagtaattgccttccctgcctcgggtgcagatgggaccgcagctcaacagtgccccagagcacccagtccgccacgctttggaacagcacggcctcctgctccccagagacgccggctgtggcatcaggctgggggagctcacgcgccttccttctttgggtcccaggttgttggtttttctttttaaccgtgtgaggggctgctggaattccgctgggtccacttaaccagcttggtgtttttatctctaacgaaacagctttcccagctggtgggctgtgagtggcccctgagagtgctttctgctctgggatttttatctgaggcatgaaaacgtccgtgcaggaggtcgagggcagtgccccatggcccgtgacgtcagggctgccgctgtgtcctcaggaagaggcgtttgccacgcgcagcccggggtattccaggctgggtgttttcctgtttttgtttttttttttttttcgtccctccccaccccccactccttttttattagcgagcactcagggggcgagaccccgcagagcggagggcaggtgcagcccccatgcctgcagggtgaggaaggcaggcagtgagggtgctctgggaggacccgtctctgctctgcagtctcaggccatgcttcagccatggctggagcacgcatggacagaattagagctacaagcagtaacaagcctccaggctgggaacgaacccacccaaacctctctgaaggcttgtggcaaagaaacagtgttagagctgacagttctttgagcagccccatggctgattctgcctttctactggcgtgatacttagaatcgtcgtcagctgaggtttcgagagaaagcaaggattacccctgatttttcttgacttgcagtgggcgcatttacctttctatcccaacttctgtttttaatacattaaggtttaaaaggctggcgtattctaggtgatcacaacgagcctgtgtcaggacccggattgtatttacaataaaaatcccattcagttggaggcattgggaaaatttaagaactgtttttgcctgctgtactatcactgttattgtttaagtaaaagtacaagcgtagtggcactgactctccagcccacagtcatgtacaacgcgcttcatggtctccaggcttacggacggtgacaaagtcgtccatcaccgcggaacttcactgaactggcgagataagggaagagtgatgtcatcaaggtcccaagactgggacttggcatgaggagtgtcgtaatgcagttgtgaacctttgggtgaaccccacgtatttgtttcctggggctgccctgacaaggtcccgcagacgggtggccttcatagcaggaaggttttctcgcggggtcctgagactggaagccgagatcaggggctgttcttttggaggctgtgagggagcatctgcctgacctgtctccctggcttggaggcgccgtcttctccccatgactcctcatctctccatccaccgtgcatgtctgtgtccagatgtccccttttgtgaggacactggtcctgctgggttggggccaccctggtggcctcatttgaacttgatcgctctgtaaagaccctctctccagacacagccccacgctgggcaggactccattatgtgagtttgcggggagcaccgttcggctgcctcagccccggtcttactgtcgcagtaaaaatggcaggcagcctttgaaagcgcaagctcgtcctggttccttcttcgtctcctgggcggcaaggtgtccgcagggatgtcgtgttctggcaggcacagcccctcctgtccaccttggacctgtgtttggtgtggaggttggaaagcatgggtggctgtttattttttcctctgcttgggggtttcaggaagaattccgtgcccacgtgaccctgttagctttatctcctggctgcagagcgcccagttaggtgtgatgcctgtaacatttctgagtgttcacacaaacaaagctcagtaaatatgtcccaaactcgctcctggggtttgcagttaaccttttcccactgttctggttccacatcaaaatatgtttcctggttccttgtgccctgtttccaagtgacctcgtcagcgggtgccctggggcagctggaagccacggcagagatgaaatgttagttttttaccagcgaggtggagaggccagacttccttccccaggaatgcctctccgtcggtcacatgcagcagctctggcaggcgtggaaaatgtcaccaggatctcaggctgcacaactagaaagctgtatttttaatgatctccaaagtttgggatggagaatgcacgacatgcccatcttctccccaccgtggtacagaactgctgctccattaatcctgtccctatgccagaaggagctttctggtggaaagtgtgctgtgtgcatccttcccagggaccgtctaggattgttgtcctttgaggccttttgttgcttgttcagcacctgtggcccccagtgctatgcagagcctctgagaggcccacaatggtcaaagaacgatactgaattcttgctgcaattgaagccatgataatgtttgtgaagttagtaagagtaggtgatagaaccttgatagttttagagtttggagccattttagagctcagcggaatgatgtgtctattgtcaaagcttggggggactggcacaggaatcacaggccacctgctataccccctaaaaattagaatcttaagctgtgaattctggcatcagaaaggagtggttttcttcccgccttgcttctttccaggggtaatgacggtgatcatagcaagtggcctcccagggcacctttccgtgtgctgttgagggtgcaacaggaggcgttgccgggctgcgtctggaggaggccagggcgagagtgcacgttgaaggctgtgcgggttatttataaatagtggttctcaaatggtagcttttaaagatttcatattgaccgacaggaactaaagtctacgtgattgcttcctcattccttcatcgttcggcctcctccacctgggcacctgccacaggccatgtgcgtccatgtccaggtctgtctgtgccgacatctgctctttgggcatcagcctctggaaagtgtccctgtcagagtctccacgtgtctcactctccgcacccagacagtctctggagttgcctttgtagaggcaaggttgtaggggaattggaaaggcggaggtattttgactgaatttattggtaactttaacagcacaattcttgaattcaatttctttttattttatttatttattttttttgagatggagtctcgctctgtcacccagactggagtgcagtggcacaatctcggctcactgcaagctttgcctcctgggttcacgccattctcctgactcagcctcccaagtagctgggcctacaggcgcccaccaccgcgcccggctatttttttgtatttttagtagagatggggtttcaccatgttagccaggatggtctcgatctcctgacctcgtgatccacccgcctcggcctcccaaagtgctgggattacaggcatgagccaccgcgcccagcccttgaattcaatttctacacatgaaacattgcctcttagaactgaatgtttaaaaagaatttctaaggagtgaggtaaagaaaaagaattcctaaggggcgagataggctaataaacaatgtttacttagagtccgcttggtttcaatgatcagaaatagccgctaggttggtgcaataacgtatattcaaatctcttggccaggcgcagtggctcacgcctgtaatcccagcactttgggaggccgaggcaggtggatcagctgaggtcaggagttcaagaccagcctggccaaattggcgaaaccccatctctattaaaagtacacaaattagctgggcatggtggcgggcgcctgtaatcccagctactcagaaggctgaggcaggcgaatcatttgaacccaggaggcggaggttgcagtgagctgaggtcgtgccactgcactccagcctgggcgagaggagcgagactccgtctccaaacaaacaaaaaaaccctgtttatttcagacattaagttttgggctgcaatattgaagattttagcatatcggtcacttttctgctatgcatagtattagtttcaaaaggtctgagaaaacgttcactctcttgtgtttcataagttatctgaaagtttcacagtttatcacaatttggaataagatcagctaacccccagcacagtaacaggtggactctgtcttctctttcgcagacacgagtcctctgccaggctcagtagcgattcctcctgcgtttgaatgccctttgctcttgtggctctggtacctgaggggttcgggccccggcagtgttgggggaacagtgcaggcttttgacagctcccaggtcctgtagtggggccatctctgggctctggagccagactgtccgcgggcgctggtgggccctttggggtgatggtgaacatagtctctaaggcgttgtaccgaaccccagcatagcgagacgtgtaaggtggtagccgtggggtcttccccgagcttcccgctgccatcacctcctgggaagacggatagcaaagaagccgagggtgtcgagttgccccatggtttgtaaaacactggcatgggctggaacggctcaggactgactgccactgcgtctccctgtaagcccctccctttctggggagggaagccccccaacaacccacagccagcctcgaagccacgtcgccctggctctggttcccgctaacccttgctggggagtcccccgcacaacctgtcctgctgtttcctgctgtttctggagctagacaagcctcagctggcctcctggctcccggcatgggtgtcaggccctggggagtctccagtccctcctgtgggtactgggctgggctggctctgaagggtcttgaagaacgtggctgtgtgcctccctggcattcgcggtggtggctctggagcttgcgtttggctgagcaggccagcaggtgactcgcgcaagccagacggtccccaggaagccctcagctgtggtgggagatgggagatgggctatggtgggagatgggctgtggcgggagatgggctgtggcgggagatgggctgtggcgggagatgggctgtggtgggagatgggagatgggctgtggtgggagatgggagatgggctgtggtgggagatgggctgtggtgggagatgggagatgggctgtggtgggagatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggctgtggtgggagatgggagatgggctataccaggagatgggctgtggcgggagatgggctatggctgggcctgtcctctgtggtgctgtggatgcgtcctattcaggagctgcctaccaagtttcattgcgatgttggaatctgtccttggtccctgccaccatggggtgggtggagcccccagcaccctgccttcttcctccccttcctgtgggtctgcagggctcggggtgttgatggagactgtgggggtcgggggagccagcagtttcgttgtgtgatggcaggaagaatccgcgtgctgccccaccatgccttgcgacgctctgtggtagggagctgtcgggtcacagtcaggcgcttaacggccacccgactgtggacgcagctgaggccatttgtccagggtggcctagtcacaaccaacagaactggactctgccatgatgagcagaccccgcaacctacactccagactccaccggtgctgggaccccgactcccaggagacctggcgagctcagccctcttgtcacaaggcctgtacggggtgggggcacgtgtcacggggaccctcggcccagactggccttctgctctcgtcaccaagatgtggagccttctggggtcagagcccagtcgaggggctttacgcagcctgtggtgtccttggagccacagctccctggagaaggcactgcgtctgccagcctccgctggtgaggggctcagagttgagaagatcatgcctcctgattgcacgagcaccctggtcttggctcatttgctccttcttgagccgcttcggtagcatttggcagcccacggttttctgcctgcgttgtttagtttgtttctgctgttatggagttcacagctgacacttggagggcggggtttgcaacaccagtttctgatgggaaggactggtgtgagggtgtgaggaggctgcggaggccgagggcctgtgcgttctcccaggcgtgtgtggaagggctggggcatcttctccctggtccttctcaatgttactctgtccatgtctgttgttagccatgaggaggagaaggcactctgttcctggaaaggagaaaacaacgtggctttttgctcagatatttttttttgagccagggtcttgctctgttgtccaggctggagtgcagggtgtcatcacagcttactgcagcctcgacctcctgggctcaggtgaccctcccacctcagcctgccgagtagctgggaccacagacgtgcggcaccacacctggctaattgtttaagttttgtggagacagagtcttgccgtgttgtccagggctgatctggaactcctggcctgaagcagtcctcccgacctgtcctctcaaagtgctggcattgcaggtgtgagccagagttttacagtcagatcatggagatctgaaatgttgccccatctcaccgaagaccgagtgcccgggagcccccctaggagggtcagaacctgcccgggagccccctaggagggtcagaacctgcccgggagcccccctaggagggccggcacctgcctgcccgggagcccccctaggagggccggcacctgcctgcccgggagcccccctaggagggccggcacctgcctgcccgggagcccccctaggagggtcagaacctgcctggttagctcagatgcccccgtggagacagcgtgagggcggcagggagctggaaaccttcccaggttcccaattttgagatttcctaagctgcctgtggtccagctgggaggaagtgtctggtcctgatgtgcgtcggtgaccacagacaaaacaggatttgctcctgcgccaacgttggcttttgagcagcgggataggtgggcctggtggtaggtgcttcggcagccgggcagccgcagggacttcctccctcgggattaaacctgagtcgggagttggagggcaacagttattcacattcaaaaccagatcttaagtgcaaattaacgttttttggattcttgagcaaaatgttttctacattatgatgggattttcttttttataagtgcttctagaacatctctggaagctgggttagacgcacagggcttagtcggctttggggagagacagtagttgtaaaggccacaccggacgccgtgtgcacctcccaaggtttcccatgtgagaccatgtggcctgcatgctgcgttccatcagcactgggctgtgcgacagatgtgtttccaggcgaggttgctgcagaggggaagagggggacgtgtttccaggcgacgtcgctgcagagaggaagagggggacgcgtttccaggtgacgtcgctgcagagaggaagagggggacacgtttccaggcgacgtcgctgcagagaggaagagggggacgcgtttccaggcgacgtcgctgcagagaggaagagggggacacgtttccaggtgacgtcgctgcagagaggaaggagggtcgcgtttccaggcgaggtcgctgcagaggggaagagggggacgcctttccaggtgacttcgctgcagagaggaagagggggacgcctttccaggtgacttcgctgcagagaggaagaggcagacgcatttccaggcgaggtcactgcaaagaggaagagggggatgcgtttccaggtgacatcgctacagacaggaagagggggatgcgtttccgggagacgtcgctgcagaggggaagaggtggatgcgtttccaggcaaggtcgctgcagagaggaagagggggtcgcatttccaggcagcatggctgcagagaggaagaggaggacgtgtttccaggcgacgttgctgcagagaggaagaggaggacgcgtttccaggcgatgtcgttgcagagggcaagaggggaacgcgtttccaggtgacgtcgctgcagaggggaagaggcggatgcgtttccaggtgacattgctgcagagaggaagaggaagatgcttttccaggcgacgttgctgcagagaggaagagggtgggacgcatttccaggagacgtcgctgaagaggggaagagggaggcccctccagcagggccacctagatgtttgctttgccccgcgtggagtcatattccaggaacccccgaacccacctgcagcttgattctgctcctcagggccagaggttctagtttatgggaggagtgttttctcactggaaacatggagcccacacacacttctacgctggaagccgtgatgtgtgtcaggaacgtgttctgatgttggtgtgcaaaatcagtattgtgcctttgtcccctctgacccccatcacggcagttctgaggcttgtggggcaccccagctcctctccctctgcacaggccactgttcccagaactcgagggttccctgacaccaagatgacatgtggcacagacctggaatcacgaggaaatgcccgtcctcctcccacgggcagacaggtcgagtgtgtttccagagaccgggccgtccgtggggcagtagcgcctggatgacgtctgctttcgcctggagccctggctgcaaggggcggtgccgggcaagggccaccccaggggtctgggagtgcagtgtcgggcctgtggaggtggagagcagggatcagcctctttttgtggatgaggaaatggagacacgtggaaacttctggtaagaagctgtcaagcctccaggtttcggttctggacaggtgcggggcaggtattggagcactttgggctctgaggtccacgtggcccagcggcctccaggagtcagctgcaaggcggagtccctgtccacaagctgcgttgcaggcacagagaccaggagagggctgtgaagcaactctgtgtttactgggctgaagcagcagctcttggcagtgccgccaccatgggctgtgtcctgtccccgtggcgacatcacagctgagcgcgaagctggaagcttgggcacgtcttggtgctgggtcttctccgaccccgagggccaagggtgctctgtagctccaggcgtcagagtctgagcatcctttgttttggcaacatccaggacaggagtctttggagagtaacacatccttattttgaaagagccctttaggtgatttgagaaaccgctgtatttgttgtagctccaagtattacccgtgaatcacctaggctgctcttcagtgaacatccagaatgccgtcagttcttgtgaaacccccaagtttcccgtaggtccaagctgagaagattgagtgaactctgagagctgagccgggccgtcttggcaccactagaaacggaatcagttccatgactgatctgtgccccaccccacattaacttgtgcaatatgacatttctggttttggtttttgttttataagccatccatggcaagtgcagtcggaggccccccactgccaaaacttcctgtgagtaataatgacagatgggccctgaccctggagacgtctgagaaggtgtttggggtccgagaagagtccgcgtgtgcagtgactggaacctgtccctggtgtgaacttggggatgagtgggtgacgggggtggtgggggcctggggcacttccccgccctccggaccacactgttgctctccagccacgagaagatgcagcggcccccggctgcagcagctactgtcccggagggcaggggagtgagggagagggagggtgtacggcatggggcctgctgcctggggcgctgggatcccacagcgaggccctgttcccactgcccaggggcactgagatcccacagggaggcccggttcccactgagcttgggttcccaacgggctccttttgcttcccaagcaccctctcccacccttgagctgcaaggaatgtttcagagccatggaaggtgctttctcccatctgtagtttttctgggagggagaaaggctgacatcgggggctttgtagaaagcgtgctctggcccacacgttaacatttgggaggaggcctacagggagctgtcggctctgggcgagggctgggggctgcctcgggggcgggggttcagggtcttgagctcagcttctcacccatccggggcagggcagggcagatagaggggtggggacagtgttgggggctgctgggcctgggatggcagggcctgtgtccaaagctgttgtgaggctcacgagatacaggggtggacctgggagggttggggcgcgtacagaggggatgacttcgatttttccaaagaacagggaagggtctgtgtcctggtcgtactccaatcccgtgtggtggagccacgggacgccatcagtttttatgaaatccccaaatgtgtcctttaaaacaaaacctctgcactccggcctcacagcccagatcccgcgcgctcccggtctgtggctttgactttggtttgagttcctgggctgggcttacctggctggcagggccgcagctgtggcactccctgtctggggacggaggctgcccatgcacccggctgtccaccttcttcccaaaggcggcgtcctgggctccctcccatgcggacccgggatccacttgcccagccttggggaggacagatggggacagcagatcctgccccagggtcattgcccgtggccacatcggtcctgggaactgtgggtaggccatgggccgctggtgcctgcaccactgtcctggtggaaggggctggacctgggactgcctgggacaagaggccaaggcacagatggctgcaggggctgcccctgcatcctgagcctcacccggcgggcaggagggccgggctgggtgtccccatctttctgttcccaccctggccccagtcacctgcttctcatccaccgattccatctttcctgctggcttgtgaggcccgtgccctcctctgggccgccttccctcccatgggcacagagcttgggtcccacgtggagaggaggccctgcccgcagcctcagagtcaggcggccttggcttcagggagggttggacgggagccagcccattggacagtagcccggggcctctgggtgaccctccagggtgggacagcagtggtcccaggcccccctctgactcctgaaatcctaaggttgcccgggccgccgagccctccctccactccccggcctgctgggcaggattttgtgaaaggccttgtcttgggtcgtggaagaaaaccacgtggtctgtggggtcatccctggggcaggctgtgggagggtgaaggctgcgtccagcggccaggcccagccagaggtcgggaatcatgtcgggggtgacgcacagatgccgccgcactatcaccgagaaacgcggcgtgtgcgggcccacctggcctctttaggccgggctccgggctgccctccaggaaggccgacctctcctgggcgggcaaaactttctcagggccgagttctgccggcacaggtcagggggcaaagctggcctccgaggagcctctgaccgctggccactgtgtggtcttggggcagctccagacacacaagcccagaagacccagaggctgcctcacgtcggagaaatgcgctgatcgtctctctctctctttgtctctccatctctgtctctctccgtctctgtctgtctctccatctctgtctccctgtctctctctctgtctctgtctctctctgtctctgtctctccatctctttctctgtctctctctgtctctccgtctgtctctctgtctctccgtctgtctctctgtctctctttccgtctctgtctctccatctctgtctctgtccctgtctctgtctctctgtgtttctctgtgtctgtctctgtctctctccgtctctgtctgtgtctgtccctgtctctgtttctctgtctctctctgtctctctgtctctgactctctgtgtctgtctgtctctgtctctctgtctctctccatctctgtctctgtttctctgtctctctctgtctctccatctctgtctctttctccatctctgtttctccatttctctgtcgctctgtctctctgtgtctctctctgtctctgcctctctgtgtctgtctctccgtctctgtctctctgtctctctgtgtctatctctgtgtctgtctctctctctgtctccatctctctccatctctctctccgtctctgtttctctctctgtttctctctctgtctctccatctctgtctctccatctctctgtctctgtcgctctgtctctctctgtctctgcctctctgtgtctctctccgtctctgtctctccatctgtctctctgtctctgtctctctgtttctctccctgtctctgtctctctgtttctctccctgtctctgtctctctgtttctctccctgtctctgtctctctctctgtctgtctttctttctcactctctttctcttttaactaagggaaaagccgtcacacaaccaaatggccatgaggcccgcggctgccggctgaggagggctgcgggaggaccctgaaaccctcgccctcctgaagctgctcctgtggagtcctgtgggcgggtgtggccctgccgagttcagagtctgtcgcttcgtctgtctggaaactgcaggagtcatgagcagccttcacggttttcacctaagcaatgagcacgtgcgggctttaaccctcggaaaatcagaattaaaggattttacccaaaccacttaaacaaaggaactgcctctgctctgggcttctgctgccgagggcgcgattccgggattctcatcgttcaccggcggagtcggggcgactcatgaggagagtgttttcagatgctggggacgtggcctttctaagggagagggacatggcagggcctcaggctcagctctttggaaactgaagcccattcaccaggtgggcgggggaggagctgggcagaggttgagacacaagacctgagagcagagcaaagtttctcatttttttggttgtacaaataacaaacaccgttcactgtagaagacttttaaacacagataaaccacgataaatgagtcctgcaccagcgtggcagctcacacctggaatcccagcgctttgggaggccgaggcaccaggatcgctggagcccaggagtttgagaccgccctgggcaacatggagagaccccatctctacacaaaatataacaattagccaggtgtggtggtgcgcctgtggtcccagctgctcgggaggctgaggtgggaggatcccgtgaggccactgcactctagcctgggtgacagagcgagaccctgtctcagaaaaaagaattcgataatcctgcgattgagaatcagacagtgatcatttcaggatatgtctttttttttttttcctccccctctgtcccagcgcagacggcatctctgtcgcgagctttcggctgaaaaaaaatccctcacgcccttcccaggcgagggagacacaggttcaggggcatgaacggctcctcccgtggaaaggactgtgtggccggctccccaggccacgggggccactgtcctccatgccacgtcccatgccgcttccaccgcagcgtgaggacagcaggacctgagccacgagccacactgctgtgggacccgtgtcgggactcgcagggcctggcaggtgtttccatttgacctgtgggctcacactcggcagttctgggccccctggtgtccacctccatgggagcaccgtccccggacccccagaggggcggcaaacacaggagtcctggggagtgttgccggggcgggaagcccggacccccctgtgactcagctgcagcctctctgggtgttgctgcgggtgtggaggttgcatctggctcagtgagaagcatttttaaacttgattctgcagccactgcagattcgcgggaagctggggggaggcaatgccccacccggcccccggggctgccccatagcagccaccatgccctggccccaggccccaggaggaggatcctgccgggagcgccttgcattttgcctaggaccttcttaactctccagactcatcagggaagctctgcaggagctcaggataaacaggtccttggcttgaagcctgccggcatgggttgggaatggtgggggctccatgtctgcagcagccacggcagaagctgtggccacatgagctgggctctgggtgcggctgtggccattgaggagggagcatgtcccgggttcttaggttaagtgcgtcttggcaggggggcccggggctgcagcccttcgtgtacccacgtgtccgatgtctctgtgccatgccgtgacgttgtccttcacgtaaagttttcaagacccacgtcccattgtctgtgaaatcacaaggttttactttatggactgtgtggaatggacccagggaagggggaccagtatatgcccaatttgccagcatgtgcaacagtgaacttccctggacagctggccttggtgtggcagtgggtgctgtacggctggcctctgtgcagtgggttggggggagctggatggctggcctctgtgcggtgggtgggggggagctggacggctggcctctgtgcggtgggtgggggctgtaccactggcctctgtgcggtgggtcgggggaagctggacggctggcctctgtgcagtgggtggggggagctggacggctggcctctgtgcagtgggtcggggggagctggatggctggcctctgtgcagcgggtgggggagagctggacagctggcctctgtgcggtggaggctggacggctggcctctgtgtggtgtgggggctggatggctggcctctgtgcagtgggtggggttgggggggtgctggacggctggcctctgtgcagtgggtgggggggtgctggacggctggtctttgtgcagtgagggggctggacaactgccctctgtgcaggggtcggggggagctggatggctggcctctgtggggtgggtgtagggggagctggacggctggcctctgtgcagtgagtcggggaggggggtggctagacagctggcctctgtgtggtggcagggctggacagctggcctctgtgcagtgggtggcgggggggtgctggacggctggcctctatgtagtcggggaggctggatgactggcctctgtgcagtgggggcaggcgctggatgactggcctctatgcagtgggtcggggggcctggacagctggcctctgtgcggtgggttgggggggcctggacgtctggcttctgtgcggtgcgggggccggcctcgggccggtgggcaggctggaaggtcagccaggccctgtggtgtctttagtgagaaacaggaaataaatcaaggggatgttgtagaagttttaccgctgctggtttagaagtgtttgtttttattatttgtatataatgtgttgttttcagtcttgcactggtgtttttaactatcgtgtaaagatgcaaacagcaggccagaaaactgccttgatatatcacattggcaaagaccaagcgcaccccggaccctagtgggtgagccggacccattggcagtggcctttgtggtgcctccagggagcctcacgatgctcacgcctctgaccagtggttctgcgctcagggcatgaccggagatgtggtctgggagttggttgtgtggatgtttgcgttgccagcgtttacaacaacagaggggaacagcccacagcccagcagtacaatgaggatggtccttgtgataaatgggatgctgtgattagattgtttctgaataagctaaaatgctcaaaatgtgatctttcttttataaaaaggccaggtatggtgatacgtgcctgtaaccccagcactttgggaggctgaggtgggaggatcccttgagcccaggagttggagaatgcagtgagctgtgatcacaccctctagcctaggcagcagagcgagaccttgttctaagaaataaaaagagaaaaagaaaagacaaagtaccaaattatgtgtctcattttcttaagatgtatcattttgtaaaaatgtttatagaaatacacccagtgggctgggcacagtggctcacgcctgtaatcccagcactttgggaggctgaagcgggcggatcacctgaggtcaggagttcgagaccagcctggccaacatggtgaaactgtgtctctactaaaaatacaaaaaattagccggtgtggtggtgggcacctgtactcccagctactctggaggctgaggcaggagcattgcttgaacctgggaggcggaggctgcagtgagccgagatggctccactgcactccagcctgggccacagagcgggactccgtctcaaaaaaaaaaaaaaaaaaaatggagagagagagaaacagagaaaaacaccctttggctctgtgggcgtcggtcaccgtccagaccgggtggacgttcgtcggtcaccatccagaccaggtggatgttggatgcaaatttcacccgagcttttttttttattttttcagttgtgttgagtgtcacttttttaaaaaattgacttatgttgaagatgagtttgaagttgttggaattatctcagtcctgagcttagggcttcagcaagcgagttgccgttccgggggatgggctggtcagagacccccgactgaagcacgcctgcccgaggctgccccaggcgtcgtcccccagaaggaagcacgcggagtggagtggggtggagagcaggcagcagcggtcccgtctccgcagcagtgcaggctcctttcccgctcatttgggctcttttgtctgaaccagagacacagatttgtagagctgccaaattcatgctgaaaatttctaaccaaaaccaatcatcttaattgtctggattatgatatttattttgtaaaccattcttgctgtaagccatgcacacactgtgtcactaaatctgcaaatgattccagagccaaatgcagtcctgcaccgcggcgtcgggtcaacggcggacttcacctatgagggttctcgtgagatcgtgagagcgtagttttactgcatcttttccatgtttaaatgtgtttagattcacaaactgtgaccgctgtggggcagtcacccacggtgttcagtgcagccacatgccgtgcagacgtgtactggggagccgtgggccacgccacgtggctagggtgtgcactggacacaccgagtcggttcacacgagttcccacgacgacaaaatggcctaaggacgcgtttttcagaatgtgtccttgtcataaagtgacacgtggctgcgtttacacaaacttattcttatgtaatagtcagctgcagagtggtttagactgccttatctttaggaaatgtgtctgcctttaaccagaccagcggtggggggaggcggcttttcttttcttctttcctcctctctcctctctctcgctgtctcttctctgtctcttaactttcctgggaatccagtgagcccagttttttcactgtgaattttgtttttggtttgtttgttttgagatggagtctcactctgttgcccaggctggattgcagtggtgcaatttcggctcactgcagcctccgcctcccaggttcaagcaattctcctgcttcaccctcccaagtggctaggattacaggcactcgccaccatgcccagctaatttttgtatttttagtggagacggggtttcaccctgttggccaggatggtcttggtctcctgacctcaggtgatctgtctgcctcggcctcccaaagtgctgggattacaggcatgagccaccacgcccggccatgaattttgtttttcatttgtttctttttcaattcatagcaaaagataggtgcaaggtgcctgagacgggcaccgcctcgcatcatctgcgactttgtttggtgcctgcctgtccaggagcaggtgtggccactgcagaggggcccttcattgcccagccctgcagctgccccctctcccttccccagaaactcacagctggccgcgagctctgtgcagagaagtctttctctggaggctcttgtccttcctgtgtggaggcctgggtccagccgcctttccttctgcctggcagcgttagctgatactgggtgtccatgctgatcacctcacgtgggaaacagctctgacagtacagcccatgaagctgcgtcttggagattcctctgtcagggaagctgtcgtggctgagttggggtccagcaggcacccgcagggcccaaaaccccacagagcggaggtgggtggtgagcctgccaggtgcatctttggataaatccatttctgagttttcaaattactatgaagcttccaatgtcacaaaatatgtagtcttgttcttgctaaggaacattttaggtgtttgtatttttaaaaattacgtagttgattccattcaagctgcctcctgggctttttcctctttaaacgagtcttctattctgcccatcgtttttagtttgtttgttttgagacagagtcttgccctgtcgcccaggctgaagcacatgcgatcttggctcactgccatctcaacctcccctggctcaggcgatcctccccgctcagcctcctgtgtggctgggatcctccccactcagcctcctgtgtggctgggatcacagatgtgcaccaccacgtcctgctcatgtttttattttttgtttcgtagagatggggtctctccatgttgcccaggctggtctcgaactcctgagctcaagtgatctgttccccttggcctcccaaagttttgggattacaggcatgagccactgcgactggccttgtttttgttgttgtttgttgtttttttttagatggagtctcgctctgtcgccaaggctggagtgcagtggcgcgatctcggctcactgcaacctcctcctcttcggtataagcaattctcctccctcagcctctcgagtagctgggactacaggcctccgccaccacgcccggctaatttttgtatttttagtagagacagggtttcaccatgttggccaggatggtctcaatctcctgaccttgtgatccacccgcctcggcctccccgagtgctggggttacaggcgtgagccaccatgcccggcccttgttttgtttttaagtcactttgggttcacagtgtgtcctgaggtgtgggggccttcggggggctcgggaggcagtttcctttaacttgcagatgcccctgctctgcgactgcatcgcatggaacctgcccttctcgagaagctgccccgcatgtcccatgtctctggggcttgtacttaaaactgacgtagaatgatggtcagcagctctaggcaataattgagtcctggccagaggggctggttctgaagatgggggagtcacaggccctgtgtggagggtgacctcaggagccccggcccacggtgctcggggtgagcctgtgtggtgaggacagtcggcgggccctgggtctctgcccacacggaggtgaggacggtcggcgggccctgggtctctggccacatagcggtgaggacagccgttgggccctggactgcctctgcccacgcagggtcttgcacctgatctgatgagcagtgctggtccagggagggtcccaccgcatcctccgcctgccttggcccctgcagtaggcagtgctggggagacagactgagcgggagaggaggctgggccggggctgcagcggccacagagccttggccctcccagaaacggactctgatggcagaggcgccggcctcttgcacagggtggaaggtggtgcctgcgtggatggtggtgcaccggggcaggccaccccctagatgcaagaaccccttgggtgcaccgtgtggcccccaggagtgttgagacagtctgcctgggcctcctacagaacacagttgggaagacacgccgagggcacgggcaggacctcaccttagcctttcacaccaaacattcatctcctgaaaagacaggggccgtggggcccccagctgggctgtaggctctgaggacagccccagcacctgtcacccgccaggtcatgcagctcgtgtccctctgtgcaaagtaaccgaacagcctcccacagccctcaccgtcgtaccccgccctgctgcgtttgctcccaccgccctccatggacgccgtgtccctcctcctggccctcagtcagggccttctgtttgtcttgcagcaatcatggaatttgggggctggcggcgctgcgcacatcacaacttccaaacccactattttataaagggcccagtcagtcacctgtctcatggcagccacacagctggttcatagcgaggagaggtttgagcttcctggttcttaggccacagcccatccctcttagattttaaaacagattttcaatgagttctaaaacctgtcttactggagggttaagtaactgatagaagcctgtcatgaaggaagagaagcgtgttaaggttgtgcttggaaaatgtttccatcttagagaactggccgggccgtggccacaggtcacgatgagtaagcactgcattgacacaggcttctccatctccatgtcaggacgtgcactcgccgatgaagtgtccacccaagatggcgacgggtgagcacgggcacgtgtggcccgggcgaggtctgtgtggtgctgaacgcctcctctgctctgttcccttccagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcaggtaggcactgcggccagactcgcacgtcacttggtgcttttgtggtcaaaaagtaactttggagccacagctaactgtgcttagactctcccagccaggccagctgaatgctctgtcgtggttagtcccgggcggctgctcaccgcctctgagctggaatgggagcatgccacagctcctcctgcttccacacgtgcaggccctctctcgttgttttcagatttgcccgaagcagctctcgtatccgtggatgctgcctgtggtgtggatgttttgggggttgattctcccctctctaaagcctctgaacttggaggcaggagttctcaccagcagcaccagcctcgcctggtgggggaccctcagaaatgcaggttctgtggcccacccaggcttgcaggatcccatactctgggcttgggtgctggggggcaccagggctcaaggtgctccccgaggagaggaggagtggcttccagagcgggcctgggcctggcagccacatccctgccggggtaggcctgggcctggcaaccctgcagccgcgtccctgctggggtgggcctgactcccccgggctgtggtgtggcttcctcaccttcctcacaccttgcgggaaagccacgtggagttaggctgtcgagggaggggtgtaatgaccgcgccagggacgggcagcgtctgcacagagccatgctccctctgcaccccaggtgttgatgtggatcccgggtagccgtgggtgttggcattttcttcgttccacctgttacctcgtcagctataggccccaggccctagatctgctgctttggcagccacagagcagcaagtgtgtccagccccagggctccaggctacgcggcagcacagaggatgttttccgagcacaccccaacagcaaaaaaccgggtgccccagccccgttatttagggaatgatgcaagccggaaggggtgttcagcagagtgcctcgtatttttattttcttccatttagataaatagtggagagaaggtggccgcagggacaaatggctgtttgccaacgcagcagccggcggcagggaattagcgggcagggcgctggggtgaggcgttttcgccagcacttgcagatgatgttaatgtgatgtttgtggcctgtgtgcttgatgccaattagtacctccctcgttggtgcttgaagcaaggaaatgcgggagacacctgagcgcacagtggcccgtttgacatttaaagtctccaccctcccaggtgggaaaggtcagacagcgctgcaccacgctccgtcactgcaggcctgcacctccccatccctgcctcggtttttactgaccgaaagcttgttattgctcagtgggaaggatattagataggacaagaaacgaggctgtgaaaggaggagtggaaataaagcaatagagaaataatggcccagtccaccctatttgctgtaaattatgtcggtgaggggcactgacgtcgcccttttcactgtatctggatgaggggcgggtgtaggaatcgaggctgttacttggagggtaaagcaggaccatgagtgtggagagagctctgaggtttctgtttgttttgttttttggtttgtttgttttttttttttttttgagacggagtctcgctctcacccgggctggagtgcagtggtgtgatctcagctcactgcaacctctgtctcctgggttcaagtgattctcctgcctcagcctcccgagtagctgggactacaggcagccctgggttttaatggatgtattttcacctgcctgtgagtagcgccggtgcctggtgccgcccgtctctgcggacacagctcagtgcttgggtactctccctgcgtcttctggaatcttctggaatcccgtctctggttctgccatctgggtgtcttgggctgagggtgcagaaatctatcaatacagatgccactgagaggatccaggtgttctggaggactcaggaaacttgaaacagtaattaaaaatatctttaaaatgtaccctcaacaattattccaaatcaagtggcccgtgtgtgcgcagcagcgacacgggagaggctggctctgcgtttccacagaaggagccctttccattgaaacgcgggagaaaacggtcccctgcacggagaacgtcaggagctgtcagcatatctcatttgtagaaattagtaatttaaagagttttgtgatgtatctgtggcagagtggatttctgtctctgcaagtgtgaggtaaaagcagctaaaaagagggggttttgggggttagttttctctttcagttggtggaccacaaattggataaaaatagaatttgtgcataatttaaaaacaaacgagaatagaaagctctcagttgccgtggaagctcctcgtaaccgcagacgtgccctcggtgccgtcgggttattttagtacatcctttgacgcggcccctttcccgcttttcagaaacgaggctcatcgcactggcctgggggcgcgaggacgaggccgtgggtagtgggcgctgcgggcggctggtcagagccactgggagccgttgggaacaactggcgcgggagtttcctgcatttgagaaatgctgttctcttcgttgtgaatcgtctgtccgctgcatctcaaaaagcttgtccagaaaattaaagcccgctgtctcctgcagtgcagctgagccctggagggtggcggggggccgggggatgtgggtgtcagctctcgcggccaggggcacgctgtgcccccgcgcccggtatccccgtcctcccgcacccggcgtccgcgtcctcccacgcccgctgtctccgtcctccccatccccatgtgtttcgcagttgggaagtgaagcacgtgagcagaacgcagcaccttctctccaggaagcattcggagcatggactctgggttaggaaagggtgtttgctcctctggataggtgctcgctcttacttgtgggtgctgaggggcgtgagggggtccggcatccgggtacctgtgggcgctgaggggcgtgagggggtccggcatccggggcttctcccatttagggcctttccttcagagggaaggaggccagccccctccagtgagcactgagcgtgccccctgccgtctctgtggggatgtcattgttcccacgccggggagagaccaccccaggccagcccctattcttctggccacattgccatgatcacaccgtccgcaccctgaggccacccccattacggctgccacggcgctaaaaacaccagcatcaaagcaacagggccgtggtttagcctggaagagcggggccctggagccgtctgcgagggggtctgggtggttcaggatggccggcagcccctggtggacgtggtccctgcggggtctggcgggacctcggccatggtgatgggtgcgccccctctgcagggtggggcctgcgggtaaggacagtcccgccccctgtgcgtgtgaggggatagtggagagaggggtctggcgtgggcctcactgctcctgggaaaccaaagatgaagacgcctgcttaggactcaccttgccctggtagaacaagtgactcagacagagcctcccagaggcttctggccaggcagggagtgaccagcagcgcagccagcctcagctcctgcccacacagcccccttgtcaccggctcctcctgcccctgctccagcaccttggccaccagttctcggtgggccggtctggatctgccgatgccgggacctcgccaggccgctggttgcaggggaggctgagggggcgtccgcctgctgtctgcttctcaccagcatttccagtgaggcatgaaagtgatgcgtggcggatgtttccctctggcctcagctttcccccaaatcccagctcacactgagtgtcctgatggtggcacctcgggcagccgccaccctctgccctccaccctctgccctgacggcaggctctgcctgagggggagggtctctctgtacacacagtctcctcaccctggagggcctgctctgctctcaacggagctggaaccaggagttcgcgagtgctctgggtggctgctggcttttctccttgtctcacctcctcatccgcacacagcctctgccctcagcgctgctcacctcggtatgtaggcagccggcatcaggatggtctggggtgagacaggcagtgttcttccccttctctggccagggagggtggagaagcacccgggcacagccattgaggccttttcgtgcaactcattgcctttctgggcgtgaaggtggaggctggtcctccacctgcgtgttctccatctgggggactgtggtcccggaggagacctggagtccggctccccgctccgtccgaggaggagctgagcggcgtgagcagtgcccgccctggtcactctgccttgctttcctcctctctgtttctggttgtgcctccttccttccctcctgctctctttgccgtggactgcagccccctcgccagatgtgttcctcacatgagtcaacccgtccttggcctgcgtcctccactgctcgtggcagctacactctcccggaggtggccgggaagggcccagggccttgagaagatgtctttgcagcacgtccccggccctcggcctccacctccatggcacccaccatcccacgggggcacgtggacctctgtgggatatagcctgacctctgacccaggggtcaaataactcaggtctgtttaccaagtcaccaaaataacctgcccgatagcatctcacccatcacacgggaggccgggctcgtgtgaataattaataggtcactggaatgtgaaacgagaagcctcggcccgttctgaaacagcattttaggtttgcagcttataatattgtcagttaggagaagggccaactgagtctgcaaagaggtgagggcgggtggtctgggatcctgcctcagccgcgcgggtgagaggggcgggcgggtcaggcgaagactcagagtcaggaggccagactggccccagggagggctcctggccataccccaagctcaggacgcagggtggggcgggcccgctggtgcccacagtggccttggtgggcctctccttccattgcccagcttgtaggtcaactttgcctccacagatccgtaacagacgttttttctgtcatgtaagaaacttgacagctgaagaccaaggagtggagcctcccgtgaggcagctcttcttttccggttgttaaaatgcgcgtcgggccagtggttctgactaattctcactttgtgtggtaccttcagctggcaggggctcggggagtgttcagtaccgtgaggagcaggttcctgagagcccgtgaataccgtggacagattaccacagcacgcactgttccacgcagggcctcatccacgctttcttaagtggtttgccacacacaggagctcctggttctccatgtcccctgccaggcagggctgttaaactggaaagccggggagggacgtcgctgggacacattgttatctgatcagagctccgaggccccaccaggagctgtgctattgcagaacctcaaacagcagccgctccggccccgccccaggagccacgcagaggcccacgcacggggaggacgccgtggggtggaaactaaagtgcaggtctgaccacaaaaccacacgccacggcaccgctgctgccaaatgccggaggcctgcaggaggcacggattaattttttatgagtctgccttggaacctagacaacagccctctcctctttcagcacaatttcagggcgaatgaccgtcacttccctggactgctaagcgcataaacgcacagggaatttcctagttccacatacgccgttgttcccgcagcccatgcagctgggagagcacacatggttgccgtcgggctgtgtctgttttcccaggagcaagaactctcagaagtgcagtgttgaagcccgagccttccccgtgtcagcttttatgatgaacgaggattcaccatttatttctcccctaaagcaaagcccacgggctctgttttgagcgatggggacagatgctcggtgctgctgggaaggtgttcacggggcagattcgctgtgtcaggagaccaacgtggaatgaggtcggcccagccagtcactgcttaaaaacagtaatgacaatatttgagaaaatgggtggaattttgtggagatttactggcacggggaaggcgtgtggcctctggcaggtctgcgacactgatttctaactacctgttccacagctccactgcctggaaaaactggcaaaaatgtggcctgggtctcctgacaggcctggccattggagtgggggtgtgcagctgagacaggaaatacgaggcgcatgagtgtccccaagcccagatcctcagcctccaaaatcttctattagtaatttcagagctttggcttcttggtgctttgggaaaatttaagatgacgcgtgggctctggcacggccgttgctagtgacctctcctaatagcgcagaagggcctcccaggaggctttcctaggtagagaggggtctgcacgcccactggaacatgctctatcccagcctcagaaaacccacatttggtgcaggtgggacaggaggagtggacacgtcacctggagaccacatgagaagcggccatctgcagcagcaatcaccccgtggggaggcggcgccctggcagctctcatgtggggcctggtccttcctcgctgcctgagcaatgggccctgcttccccgcagacaccgtggtgcccctgggccacacccagcaggtgtccagtgaccgagggtggtgttggccatggcaggtccctgcccgtttctccgaggacctggggctgtgacccagctgggttctcccgggaaggagcggccactgtctgcactgtccagtgctgagggtggcagccatttctgaagcctcccaggtttgtgccctgctgtgtctgaacagctccggagtgcagggtctctgtgtcagtgccggttctaagaggaacgagatgtggtttcagagacactcctcttctctgaggagctgctgggcgggacggctgcttgctttctttgtctgtgacgttggtggctgttccttgcccaggccctgcccaggccagacgtgggagtggcggctgggagcacccatgggcgtgtgcccgtctgggctgggctcgtgtccgtggacctgcctcaagccacacctccctcctccaggcaggacaccgggccttgtctgtggacagaggcgctttgctgggaacagcacagatggcccctgggccctgcggagccgagacgcaccatcatacacacttggagcacatagactgaccaggtctcaccctgcgaggctccctgaggccatgtcctagggaaatagaaggtttcacccggagattggggagtgcagggctgtggcgctgcagggtgcgggccctgaaggaggggcaggggtgctgctggatggtggctcttccaccccaggattcctcgggcccttcacccctgtgtgtctggactgggtatcgctgtagctgtcgggctctggaggtgcacatggctgctgggcgggcagcgctcctgggcctctctcccccgtgatttcggttttgatgtgtttgagccactgaccagcaggcttaggggccattctggagctgggagggcttgtgggggaggcaggatgaacaggggctgcttgccggtcctcaggccaccctgccagctccttgatgtgtctccctgagatcagccagggcatcccggctgtgggtgggctgtgacctgagcccgtcaggccctgctggggtagactggggagaagtgctgagcggaaaccacctcacttctgacaaatgacaagcgctcctgccgcttggtgtcaggcgacgcgactctcagtggcacggatgtctctagaaggttgccgtttctcccttcgtggccgtgggctgtggattctgtgtgcttctggccctggggtcacggggttgcggcgtttcccacttgcctgtttcaggagttgcattctagatgattctctctccatagaaggtcgaggtttctcagcatggattaattgattagatttaattaaatctaaacgtggtgtttccgggcagaatcttcttcagccaaagtgagcgtggccgtctcttctctgggcgcttccaggtgcgttggggcccctgcaccctccacgtcagtgccctggctccgtggccctgtcggtgctctggtgagtctggggttcgtgccgagcgccattgcctccaggtcgaggtgggaagcgcgctggtggggcaaggtggtccctgcatggcacaggttgggagagcagccgggagggcagcgggccgaggcggtgggggagggcaccagttctccacggcaagcacggcctctggggctgctcttccggagagacgtggagacccgcgtgcacgtgtggagactggcacgtgtgaggggcccacaggtgtggccgggcggcctttctcctccccacctctgtccaccctcgccgaggcgtcggtcctgctgagcagcctctgctgccttcgtgcaggtgacagcgcacgtgccattcacgggcgccatgtctccaagaagaggggctcctgccgcgtgcctgttctggggttgccactcaacatccttccagcaccttctctgggcttccggtttgaatgatctttctccaaagtcggcggaaggggctagaaaagtagggacctgggaagaaagcccagacaccttggagccggggtccgggaaacaggccctggcagctcagcgctgcttctctggagtggggatacaatgttggttcacagacgtgcggtggcggcggcgggtggtggcagcagtgtgcggttgttggcgccacgtgctcacgctgggtccctcctggggagcttctgctccggcgggccacgccttgctgtagcctgcaggtcatctggttggtgtctgggggaggtctggggccccagcccggagctcagctctgagcatcaagaaacccgagtttctccccactcccacccagacagctccccactcccacccggacagctccccactcccacccggacagcagcagctgtgtttggaaggggacacaccagagcttcccttgtagcaagtgaggcacgctcagctggagcctggcagtcctgcagctccgcctgcccccttttgaaaaccaaaaatcccaagagacttatgttgaaacagcccttcccggtcaggactgagcctgtggctgagtgcagtttttcagtcgcggctggaaggtccctgtgcggggcggcgagtccctctagatttgctttacagccacaaattcagttttatctgtggatctgaacacgatctatgaatcactaggaaagcaactgtgttcacgggaaggattctcagaattgagctgacactccgtggtgtgaactcagtattgtcagcttgtgcaccgcgcgtatggacacacacctgcacgcactgtcacacacacttgcctcgggcccccacacacaccgccctgagagctaggaagacgaatcggtcagtcacacggattctgcagacagcttccttcaccaggcatggtagtgagggcagcgcccactactcacccagggcctctcgtgcaggaaactgcatggacacgtcgtcctgttcctgtcatgggaaggggcctggagccgtccctcggggggtggggaggagctagtttcccagtcggcgcccgtgcattcaccggtctgagaatccactcagcaggcttgctatgtaacctccgccgttcaggcctcagcatgcagcaagcccgtggggtcccgtctgcccagcctctgcctcggttcctgccgggcacatggacgcttcccttgaatccttctgccgacggcatctgtgggagggcaggtacgatcgatcctggtcctgtccccctagccctgggcgggtgtcccggcacctccaggcacaaggccccttccccaggctgcccagagaccccagccccgaggtgctggtccgcccaccctctctgggaagggctgtgccacatggcgaaagctgctgtgggtcctggtacctggtgtccctgcctgccagggctcatgatgccaacagtgccaggtttgtgggatttgggggtcaggagggcctggccctgctcctgcaaggccgagatctgttcccttggagggttgagggagtgttggctgtagggttcctggaggcctctctcatgcactctgggtctgtcaggaggctggcaactgtggccaaacaggtagaaataaaacctgaaatgagaaaaaaacttttttctagaacttcccagagagcagtgagctggtgccagtgggtcagaggcttgtcacatgtggtgtgtgtgtgtgcgtgtgtgtgtgcacgctctgggggggtgtgcacatttcccagtgtggctgtgcgtgtgtgtgtgcccacgtgtgttcacagaacaccaggctttgccccgactcctggctcaggcctgagtctccagccatggcgtccccgttcctcccgttccttctctgcactgcacactgggaaccaggacaagaggtgtgcggcgtcaggctgtgtccttcccccacccaccccgagcccacgctgctctggagggagaccccagcttcccccgcctaccccgagccctcgctgctctggagggagaccccaggcccctcaggccctttcccgcatctgaaggggccagggcagggcgtccggcagatgaagctgccccttaaagccaggtctgggccggtttacagggaagcactgctcacgtacaacctggcagaccacaccagcgccgcacacacaggcacccctgtgggcacccacgtgcccgaccccgcagaccacaccggcactgcacacacaggcacccccgtgggcacacacgtgcccgaccccacagaccacaccggcgctgcacacacaggcacccccgtggccacacacatgcctgcacacgcacacttctggtgcacacgcccacactcacggaggcttctgcacaccacacagccagcaggtgaggaagtggacgctgcgtggctgtctcttggtggcttcacctggaatgtcaccgtggaccccagagcccgaagccccggcaagcacagaaatcacaccggcagcctgtcccacttcgggcaggtgaggcctggctgagaaaagggggaaggagagggaggatgcgggggtgtgtcctggtcctccacccgtttcgggtttggggtgctcccttcgactactggctccatttttgatgtcttttacttttgtttcgatttttcctggtatcttgagtaaagtctccctggagcatcaaattggatttttcttacaagtaccgtgtgctgttgactcatctgctttggtgtgccgtgggtcacgtgggcctgggctgtgggtaaggtgggcctcgttcctgcaggaacacctggctctgcagcagtggctgccgtatcatcctggccaggcccctgtaccgagggtggagccacggggtctctgatgccttccttctcgtgctttggtggagaatgtggctggacgtcctcccatgacagatgcactctcctgcctggttccctggccccgggcccagccctgagagacgcaccacggccttcacctggaagtgtcacctctggctgctgttgtgggtgatgaggattccagggctgagaagaggaccctagacgctgttcacacagcgtggcaatctctcaaattaatccagcatggggggaatcggggttgaaaccggtttgtgagccggattttctgtccctgtgtacttccttggggcaatttgaaaaatgcagattttactcgtaggccctaaatggataatttccctttaggctgacggctgctcctgtgccctgcctggagagaagcctgactccaggtcgccttggctccgtttctgtgcagcagctcagactatggggtggagggtgagacattcccacccgtgagctgcctctgtccaccccacacctccctcccctgggtgcacgcagctgagttccacgttgaataaatttggcctcaatcatccactacccaccatgtcaccgtgtaagtgctgaggtcagcacaggagctaaaaacaaacattgtaacgtgtaggagactcagtagctcttatacctcggcagtggaataagaataatacattttgtttagttaaggttgaggcagagggaggtcattgttgtgacagggaattttataaataggattctgacaggttctgtactgtgccagaggcagaaagcccatgcagtggggcccgtgacgtatttaaatgacttttcttaaaatgaacttcatgttttaaataatagatgtttacctcccaggtgaaaccttaaatattcccattttcactgaaatggcatgttttttaaaggatacagtcataccccaaattcacagcattccacacaccatcagagaactgccacagggatcctgggggaattttaaattgtagttttaagaccacgtgaccctggagctgccccggtgcccctcccccaccccccgaggtggttttggtcagcgactcatttacatttttttctatgtaaattaaatttttaggtattaaatctcggaaaatggaatactgcgtggcagaatccgcctcttaatctgcttttctttttacatttcccatcataaagatgtttgagtcccacagagagttaaggtatctcgggaagttcattaacttggcaaacggctggagtctctcttccgaggagctgagggctggacaggcaggtcccagcgtcccccgtcctgactgtttgtgtggagacactcatgtattcatatgggaaggggggctctattggaaagggaagggctttttgttctgcagagttacgtggtcttagcagtaatcactttggagtgggctgctggtggccttgggtgcagagactcctgtgggcatctgcgcacatgggggctgtgtcctcatccctgtctgtggcttccccaccgtgttcccacgtgatgccttcgttcagcctctggctttgtgtttcagaccccaaacgccccttcgatgtctcagctgggacctgggtcccggctcagcctcacgcggcgtcccagtccctgcccatcagtctgggcctcacggtcaggccctcagtgacagcagccgtcgcttcactgtggcctcgtccctggagggctctgagttcagccgtcgcttcactgtggcctcctccctggcggggctctgagttcagccaccggtgagattggtttgttctttactgtggtgaccacacggcggctgaggctaagctggagccacggagcaagggccgcctcttcgcctgcccgggcccctctagccccatcttccctctgcccactgacatctgagaatccgccgtcccctggcccgggctcccccgccttctccctcgcctcgctggccctgagtgggcagcaggcatctgcgtggtcaggggcaggcgtcgcattttcctgtggctggaacgtgcctgcaggagcccaggcctggactctgcacgtggtcatcgtgctgcagttgccgtctgtggtcaaagattttaaagttagtttagtgagaaaatcgactccaaacgtgatcagaggggtcgacgcgtcccaggatgagtggttcccggggctgggcgttgccacgggccttgcatggattttgctgatgaatctcagggctctgaggctggcgctcatcgggccccacttgggggatgcagaagggaaggcactctgaacgaggggccctgtgggaggccccactgcgcaaagggtttgactcctgcggcctccctcaaggcctttgtgcttgctttgagaatcaaacgttcctgttccaaaccaaacttgcctcttgcatatggaatcagactatagtgattgtaaatggtagcgttaaagataaaaacaaacagttctaaaaatgactcactgctgaaggcggaaccacgcgtggtgcagagaaggagggtgagagggaacggcaccacactctgtgtttacctctcaagacgctgatgagcaactcatcccacagaacagctggtcctgaacatgtgtgtgccctgccgtgaggcgcacaccttcccagaggcgtgagtggggcccggccactagtgtcctggcggaagcaccggggctgctccatttgtctggagtcctgtcccagtggtgtgggttttgagtctcacccacacggcgccggccgagaagccatgagcggctctgcagggtggtgcggactatagacacctccatgcatggttgccctaggcagtgtctgccgccagcgtctgcctctggacactagctgctcagccaccaggacggcgttgagcgctcccctgcctctgcaggaggagaggggcagggagccatcaggaagggtgctggggcctggggcccgtcgtgctgtgtgtgtgcaaacgcagtgtggcgtcccctgatcaggagtgggagctgcgcgctgcccggttccaggttaatggaacacaggaaggtgggtcatgtcctgcggggcctcatctggatttattggtgaagcgagccttgcacatggctcagcgagggctccgctttcctgcacacgccccctgccagcttcactgtggcctcagaatgggcacacacagcaagtgtggatgcatacgtgcaaggcccgtttcaaagcctaaaactcagtgcccaggtccattgggataacaaggcattttctaatctgatttacaaagacaccagtatgacatggcagagaaataaaaagggggcagggcagggggacacaggcctcgaacccgccgcaggttttctctgcgttccggtgactcccggcggtctgtgctctgggtgctgagcaggtgttttctgttctctcgccagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtgtaagccgcgggggacctccggcctctggcagggggcggtaggagggggcgtgcctccctcccagtcccggggggtctggccagccccccgcacttccaggctgcgtggccaggacacttttggtttaacagccaataagtaaacttcactcttgcttttgacaatggatttgcttctctctagggtttcagccctgtgtatattgccacttaaaatgtcagatatgcagctataaatacctccctctgcatttagcttctaaacaggacccctatttctttccgaatacagcagtgtaatgagaggatggttaaaacgtgagcatcaaaaaattaaagcagtcagcacatctggatcacgttgacctttaggaggttccgacaacacggataggcctgtgctgatgttctgagtctaatttgacactgtaatttgtttaaaagtgaattttttagtaaggtgaggacgaaacatgtaacttccaaataaggccttactcacttaatcctagcttgtgctgggcacgctggccctaacctgtgaaggcagccgaggaggaggactgctggttcccgagagattgatgtggtactgtggggggaaccgaaaacagacacatctgtgggtgaatgagtgcaggttgagctgggacggctggaacgtgcagaccagcaggatggagccaggccggagggcagggacggcgtcctgcgagggtgacccgcaggctgggagcccgtgtgatggggaagctgtgtgtggggtgccccatccaggtggagccccgggggtgggtgcagaggtcctggggctgcaggagtggggaggagtcccgcacggtgagggagagcgtgtaggagatggcggcggggggccacgttggggattttaataagtgattcaaagcctgtaagtcaaaaagggaaagctttctctccacgttgacttttcaagcactgggaggaatgtacgcacctgggaattcattccaaatccctgagtttgcctcgagagctgtaatccaagtttcccgcagacagggcacagtcaggtgcgttccacagccgtagtaaacgtcctggcttcgctggcggctgcgttcaccccaccatgatgtggggcagaaagggtggccgggagacgcccgcagccaggaccgcgctccagccctgtgctggctgccgcctcgtgggtggtcggggagtctgtgtttattctcattctcttaacttactgaaaaatactgctttttagtgcattgagaatgtatacatggaatgttttactggagtctagttttgaatgaaattgttaagaggttatatgaaaccatagaaaaaatgggttttacacacaaaaaatgagggcttttaaatatagtggaaataatagaataatttattctaattatgatttattatatattttatataattataaatatataatatttaacctaataatatataatatataattattgtaaatgataataataaattgagctttttgggaactactccaagataagtgagaacagcaggtgcctctggcccctcccctgggccgctctctgccgctctggtgacatccccgtatacgtggccagcgtgggccctggaggcagccaggacttgggacagctccgactggacccgcttggtcaggggtggagggtggaggctggaggctggaggaaggtgggaaggggaaggtggaagtggcttttctcggggctgcctctgcttgccccctcgcctgcgccaatgtcagattctctcctgcactaggcaagggcctcacgtcgctggcttcaaggtcttgttttccttggggaaggggagagtggccagctgcctggcacgagctcgtggggctgggatgagggccagagggtctggggggccaggcctttatgctcccgcgtcagccattgaaagaaaagctgtgggcttttgttttgggcagcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctgtaagtggacgtccacgcgcccacaggggaggaaaccgtcccgtcacatgcgcttcactgtctcaccctctctcagcttttcgttcgtgtagacttgggactgaacggttcccaccaaacccaccacagtgtgtggccacgaggggtctgagttgatcatggctgagttattgcctgtggcctcccgggggcccctggcgctggctcctctgatggctgagcatggccagggaaagcggtgtgggccggggcttcccctcacgctgcgctgacctttgcgtatttgtgcgatgactgtgatttgagtgaaattggctgagtcttaggaagatattttgatgacttcttcagaacgaggtggagaccatcaggatgaagtgtgcacggcttctcccctagaagtagtggcatccgcaggggtcggcccgcaggtcgtggcggtgcttgctctgggtgggtcggctcacgtgtgacctgctgggtgccacacgtgtgccccaggccgcccactcaggacaggccctcactgcccctctccttctgatgcagcccagcgctcagctcaggagctgcctctggtggagaagcagagcacggacagctatccggtcgtgggcgggaagaagatggtcctgtctggccacaacttcctgcaggactccaaggtcattttcgtggagaaagccccaggtatgctcttcaccaggggccatctgcggcctgggcttcggcgctggtgggaaccggttcccagtcggtggagcaggacccacctgtgcacggtcaccgggacggggcttatggggtgtggcacggagcagaggctctgcgtggcccgtgtctgcatccggctgtgggtttttgtgtgagccgacagctgtgctgctgaagggaagaggtggatgtttatttctggggccgccggggccactgcactcacatcgctgctgatactcagggagcccacgggctggggacgcagaggagggcaagacgcatttgctggctttgctggggtcctccatctgcagagagtggacgcttcgggggtcagttagcagcagggcaggagggagctcccctccggggccttcccctcccgccagcattcctggggtcggaggcagggatggggtgggtgccgcagacggcgggagctggggtggtctttaatgccacagccgtggtgtgtgtgaggctctcgtgccccaagggcacaggtcacccctgcctccaggtgttgcgctggcccagcctggaggctccggggctgaacttggaagggcagcaggggtgtcctcggagtgatgttcctcctggggccgtcacgcctgtggttctgtgctgcccacgggagactgtcctgcggggattgggctcacagagtggctcccagcccaggtcagttccatgcagacgccgggccccagcactctcatcccagaggggtggcctcgccggctccgagcagagtgtgtgaagacagtgggctgcactgatgggaaactggcattgcagggagagtgggcaccagtgtagctgggcacagggaccctagcccagccctcaagggggttcaggcagagtgggcctggctctccgcaaagcctgccgtgagctccctggttttgggggttcctggtgccttgctgggcctctgcccagggtgcgccaggtgaggggcatgcccccacaaggcctgttttgtgatatttttttccttttgtacacttaccaattggaattcttttgcacttactccaatccctggaaaccgcggaggcattcagccttgataatggggtcttgatttgtacagtttgccggaaacttaagtgcttcaatcaaaatcggctttagaggtctttgactctaacttggcttcctatagaatcagggcttaattggaaaacatgttttaaattacagagaaaaccaactaagggcagtgaccgggaaggcatttgcattgcccgtgccttctcgggaggaggctaattttgaaataattttcccttcagagctttcggtgtgtgtccacgcgttggcggagaaacacttcgcccacagtgtagggcctcgcttgggccaagactggccagaaccgtggctcccagcttctgcttttcaaagcccagacctgagcagcctccttgctttttcttctgcccagagaggcctgggcaccttggcagagcctccccccgaatgcagtccgcagaggtgccccagctcctgccctagccaagttactgtgctgagttggtgccacggcgccatgggtaagggcagccaccagcctgcgagggccaggagccaaggggatgcaggaccagccctggcctcatgcggccgcccctacaggcagcccctcctgccttcatcatcactgtgagctgtggggtcagcaggccggaggggtacctgttctgcccttaagctcggctgccacagccacacttctgggcaatgccagtttgtctgcccatgtcctcctcttgtcccatgaggtcagggtgggtctctgaccctctgccagcaccagccggcgtctggtatacagcaggtgagccataaatgaataggtgctgtgctcgagagcacgtgaagctgtgaatactgcagggatgaagccagaccacgttgataattttattctttatagttgaataagataatttgcatattcatacacacacaagcacattccatgttttcaaaagtggagaacaaatgtccacataattttcttcctccacttccggcttctcaggcgggagccgttgcttacaacacgtgctgatgtgcagtgacaggttggtgcagcagaaagccccacatcctcatcctggcaacgagagaaaccactaaactgaatttaaattaaaaacacagttgccctctcgttttctgatgggatcgtctggtctgtttaaagttctgttttagactgctcttgcagatggaaccagggccgggtgtgagctcaggaggggaggttcctgctgaggaaatccgtcagtagggcagttgaagtggcttctccaggaagggcccctgcgtctctcgactgtcctgctcattccgagggtgcagatggttgtagctgttgggaatgttggctctggacacaggccagggtcggctccaccctgtccttctctggagtacgtaggaagctcattgtccaggccagctcagcctctgcgtatcagccaggccaccttcagctgctatgggttcacagcatctctgagctttgggaagttttagatggagcggctccactgccctggaaggctgggagaagctggtgttggcctcatgaggaagggagtccccgcagcagggctgcattgcggggagccggccgggcaagggcatggctcgccgtagcctgggtgccgggtccctctgggatgctccagcagggcaggaggagggtgggtgtttgagtctcagcctgcgctccacggagcttcctcccaggtgtctcagggcggcgcaaaaggccgggagcggagtcagcctttctctgaggacttagtttacagcttcctcggaaaacgacattttccgatgatgaaaatctgtgaggaatgttcttccaggaggcaggttggctgtggggagccgagggccgggtgttggtttagaagcccctggtagcatcacaagaacccccagtttccaaggctgcaggggttcagctgcaggaagtgggaaccacacccctctcccacccacacccctccccaccttcacacctgcacccctcccgcctgttaaagatcactgtgtctgtgttccgatgtgaggcacctctctgtacacgcgtgaacgttgaagctgctgagggacacactaacgttcaacataaacgaaacgcccgaagaacgcccgcgtgaaacgtgagctcgggctgtgtctagagcctggctgagatgagacagaaggcgcaaggttctgagatgtggatgcatcaaacatgagccagttctcgatgctggagctgaacaacctccttttcttaagtcacgcgtctgttctggtgccgttttttaaaaacatcagcgaagcctgttttggtgtcgctgcgcggaagccacactacgacgccgggggtgaagactcccactccgtttgccagcgatcgcgcagcgggcagggctcagcgggtggggctgcacgggtctcgtcagtggtcgtttctgtggccgccgtgactggcaggccagctggggcctggacggccggcgtctccttctccaggtaatcagggcccctctacgtggcctcccggggcccctctggggaggcagcctggcatctcacaggcggccggggctcccgggaagcagagacgggctgtgccagggctcctaggcccaggcctggacccagtgccgtgccagccaccaccccaggggccctgccctggttcgcagggagacacacagaaatgtgggaggccgggtggcctgcacggtgggagcgagtagacagagcccctcccggaggcccccagcccagcacatccagagccctcccctgagaaaccccagacagccaggttcgccccaaacccaacatggtgggaccccagctcgccccccatctcatggccgccccatcccacggccgccccatcctctggccctggatgttaccacgtggagaagacaggcctgtgggcaggcactagccacactgcaggagacgcaggctaggtttccagatttctccacacagcagcaggcggagggcctgcctcccacctcactgggagggccaggactccaaatctgggccaaatgtatgttgttatttttcaaataaagggaccaaaggcccgggcctttccaaggctgccctgccatgggaccgtgaccggtgtggttcccaggacttccacaagctctgacaggcacctggccgttgttttgggaggctccacccagcagccacagagcttagctggcagctggcaggacacttgcaaggacacggaactgtcacggaaccaccgtggctttgggctgtcacggaaccaccgtggccttggcagctgctggtcctatgccgggacacacacattcaccgcggcgagtgtggggtgcatgtccccaggcagaggccatgtcatccaggtgcaggaagcgccaggcaaggaccctcctgtccgcccagagagccgggtcagaggagtccccaggcctgaagccactccctccgggctcaccttcaggttccttcaaggccagggggaggttcacccaccccagggtgtcgcggaagccccgaggcccctgcaggccccgatttccccagtgaggcatcagtgcccgctggccaccctgcccctctcctcctccagctgcccctgctccttgttttcctagggtctggttctttctcgcgggcggggaggaggtgagggtcagggcccctgtaaggcagactagtggcactgcccctttcggcccttgctgtccctcctctgtcccttgtggaaggtctcggcctggggcagaggagcgggccgaggaggaaggtggagtccaggtgggtggtggggtctgtgttctgttttagtcgtgcgggatgtaggccgagggagatggacccgggggatggctgcctctgtggcatctccgtggtgtgccctctgacggggctgggtgagcaaggaggacacagctgggaattcccagctccagcgtccgcggcacgggcagcctccctgtgtggagcagctcagctgtcacctcctgaagatgttggatgctggccccgaaggcagcatcgcaatgacaacaccttcagaggtgtccatcccaacagtttaaaggccaaatgcagatctttcagatttgtgttttcagggagaaggtgacattgctgggcgcctgtgagtgtggacagacatcactgtcgccgtgtgctccgagagaggagagttggggctgctttgtcaccacatggcgtctttgggagcaggacaggtggccgggctgaacccccaggcttctctgtttgctcccagagaccacacagggaaggcaaggagggcagcgcccggggaagagacacctgcccgtgtcttcctcatgccctgaggatggctcagtggcccagatggtccaggacccctagaattgagtgatgaccccacagttctcatcaagccgcattctggatagcgctaggggcgactctcagactccccctgcctgggccccgctggtgtggggaggccacgcgtcacgtcagtccccactgcaggaggaggggccgggcttctggctcccctccctcctctcccttctcaggccttttgggatcatacacgacaaagtcacccatggtcatgttggctagtttcttttttatatcagctttatcgaaatatgatctatacaccatttaattcactcaaagtgtataattcggtgggttttggtggcttcacataattatgcggccaccaccaatttcagaacattttcttgtccccagaaagaaacccttgcccatgagtggccacccctgctctcccttcccccaccccggctccgacaaccccaatgccccctcgccgtggcctcgcctggtctggctgctccctgctggcctgctggggaaccccatcctgccggctgtggtgcctggcagcttctgtggagcgtggcatcctccatgttccctcgttggtgtgggtcagggcgtagggtcctcaggtcccctcgttggcacaggtcgggacgtggggtctttctgtggctgagggaagcccaccgtgtggctgcccacacctgtctgtcgatggcactaggccacgtccaccctgtggagatgatcgtggaaaagccgccatgaacctcagtgcgtgagtcctgtgtggacgcctgcctgtctcctgagcacatgcctcggtgtgaaagggctgtgggtcacagggtggctccgtgtgaggccctgcaggcagatgtgcagcagggctgggtggctgtttcccctccagaatctcctctgggagccaggctgggacagactcctgggggagagccggggatggatgagacgccccagggacgctcgcttctgggcatgaggatgctgtggggtgcacggcacgaggacgccgcggggagcagggcacgaggatgctttggggagcagggcaggagacgccgtggggagcagggctcgagggcaccgtgggacccagggacgctgctgcttccaccagcggccctcgtggctttctttgtggaaacagtggctcagcatcagcaccggcgtgggggtggcccggctccgggcggcgggtcctggccggtctgggaggctcctgggcccgcaggcctgcctgtgtggaaacctcgcgggtgtggcagggaagcctcccgatgactcagactgcagggaattccctaatgatctggaatatttttactcctgcactcgggcagtttcctactaaggactcggagctctgataaggctgaacacaaaggccctttcaggaccggctgccttccttcctgccaggggctgagttttgaacagcacgggggccggcgctgcccgtccgggcctccacggagctgggagccgccatggcgatgctcttgccggcgggacgcggccctgcgtctcctttcctgagatgcgaggttatttccatctttcagcagtctcggcgctttgtcttgttctggaagcaattgctagatagacatttctggccgtgaatactattgcttttgaaagacaattactttatgatccttaagcagaaacagaaagcctgccctcaccctcaccctggtcgacctgaaacggccacagacgtcggacaccacggggagaggccccacctccaagagggaaggccacaggcgctggctcagccggggtctttgaggaaggcagggatgtttgtcggttccccgcacttttaggggaagtctaagcgtatctgctcccacctgcgcaggaattgcagggtgcgggtgctcccaggtgtgcggtggaggctgctccatggcagctgctgagctgggcctggctggccacgcagacgtggctccccttggggccgctccggcaaggatggttccccacaggcccacgaggcacgggtgggaaaagacgcctccatgccgtcgttccatttgcttttcatggactcaccgctgcggggcagccacctggaggaggccgcgggggagacggctggagtccctcttgcttctcgggacataaagagaggagcaggctgtgttggcctcggctgcaaaaatggcgtcccctcggggtgtcattaaacgcgacatcctggccccgtgtgcgcctcagtgtccctcctgctcagcacagtcactgaacctccctccccttgccagtgccaaaggcctccacagcgtcagggaagttcctagggaagctgaagttgtgactctgagcttcctgggctgggcgggaagcaaactatagcctgttgcgcccgggagcttcagaggaccacagccttttgtggggtgtggacggggcctcaccccaaagatggactttgtcataagaaaagttcaaaagtcattttcaaaaggtgccaaacaaccagaagacttagttacacacagagtgatttggatttttatgaagtgggggtggaggggcttctgagtggtgcatctgggctgggggcttctgggaatcctgtggcatcagcacctgtgctggagtgaaaacgcctctttcttcccagctcctgagctttccagggcctggaggacttgctgcttcatgaaactcagatggcttcaagcgcaactgagtgtactttttagtttcctgtaatttttttcctagaggagagagggatgccaggctctatcgagtgggttcatctggtgggtaatttgcgtggggacctcgggcctcccgggctggcatggccagggcttggctgggcggctctggggtcctgtgtgactcacatttcctctccaccctccacccaggcagcagcccggcactgtaacagagaaaaaggagattttgtctgatttatcagtaattgagggtttgtaacagacacacattttcttctttggagacagagcataaggataaacttaagtgtgtatacctgtaactgttcattttgggaacagactttattttggagaagataaaaggcaggaagagactctgtaggagattgacatctgttaatttgagataattgccccaaactcagcccatctgaggggccaggccgtgcacacacccaggctgtggtggggccgccttgtccgtgtgcgcctggagcccccactctgccaggcctggagcagagagcacaacgcgtcctttcactacacctctgggagcctttttattttttaaaaacatgcaaatggccactggggaaatgccaaaaatacctcgtgttttgcatttctgtctcctgatgggcaagaagttgtcagaggaaggctcttctcatttacccagtggttcctttgcacacaggcagggccagcggccaggccctcatccaccagagtagaccccagcacgagcaggcgtcgcaccctggcgtggagcccccggccccccgtcactactctcacacctcctgcatccctgggaggctgggctgggaactgcagagccgggtcccaggtccacgcacagacgccctgcacacgctctgctgatggggtacctgctccccctcacacctgctctccctggagaggacgagggcatagagaccctcccgtgacctgtcctgaggctgtgagaggccagcagatgcagggccaggacggattcctgaggatgcccctgccctgtagtccctcctacgccgggctggggtcagaacaagccctgagccgcgtgtcctcagcttctccaggctcccagggcaactttggtgtcgagctcggggccctgccagggcacgtggctcctgaggtgctgccctcgacaaagccctgggatgggcctacgtgggtctcctgggacaaggcgccctcctggctcagggccctgggtctggatcacgtgggggtgtctggggagggggctccccaccacacagagtcacagacgtttcctgctcctttcttccagatggccaccatgtctgggagatggaagcgaaaactgaccgggacctgtgcaagccggtgagtgcctttggcgcagctggagctactgtgggtccccagggcttgggaggctggggtctgctggagccactgcgggtccccaggccttgggaggctggggttcctgtttcttagaatgaaacaaataaaaatagtgcatagagtaacagaaccagtaacaaacaggatcaccaagtactcgccaaagcaccatgtgctgtcacccaacgtgtcaggtcacgtcagagccctggcggccggggacggtgctggacaggctgagggccacctcacacaccctggcgctgagacagcccagggaaggtcgtctcacacggaccctcccgccctttgctgtccccttgctgtcaccatcacctggcacagagcaggctcctgggagtcagtgctgtgctgagttcccggggggtggtcagcacctgcccagacccgctcacagcaccgagggcagggctctgcggcatccccagtggggactcctcaccccgtcctccgaggccactgattgcgccgacctcccctgtgatggtgtcccaagcacaagagcctgggcgtggctcctggactcgcgattggccacagcctgttagcgggcggtgcatgtgtgcggggtcgtggcagacgcgtggctgggtcacacttctgctgtcaccgggccgtttccaactcccccagtcacctgccacagcttccctggcaccgcgtgcatacagccggtgcctgaggataatgaccgtcctcggattggagatgaccttttgtgtggatggctgtagctgctcccacatctcctgcacggcaccggttgctgcgtgcatctctcccatccctgcgcttctgatccatgtgctcatgtttaaagtggtttcttggaggcaacgtcttcttgggtggtgtcttggatcctctctgacgctgtcttgtaattggcacatggagaccattgatgtttaggtctttagttttgtttgtttttgtttttttgaaacagagtttcgttcttgttgcccaggctggagtgcagtggcgtgatctcggctcactgcaacctccacctcccgagtagctgggattacaggcatgcaccaccacgcccggctaattttgtaattttagtagagatggggttttgccatgttggccaagcaggtctggaactcccaacctcaggtgatccgcccgcctcggcctcccaaagtgctgggattacaggcatgagccaccgtgcccggcctgatgttcacttattattgatacagttggattgatccctacgttggattttttgagtgttctgtttagtcctataaaagcagtagaaatctctaggccaacataagatgccacatggctcacaagggagttttgaagacatgaacatgcttctgagctcagcagtgtgtgtccctgcgggtcagggaagtcttgtgcacccactcagtgtgtgtccctgcgggtcggggagtcttgtgcacccactcagtgtgtgcagttggaagctggtcccttcagaaacctcagggaagagcccatctcgggcggctggaggcaggtggacaggacaccggggaggagtcttgaggtcgtctcctgttggtgggacgatcggtggcctccatggagagcggtgctggcaccttcactccctgtcccaagaggtggctctgtcagaaagcagcgtcttccaccctgcgacttcagcgcccttcccccaaggacccatccccttcccagaaccttttccaagtggttatcagatggaaaaggttcctccctggccctgggtgaagtgagctcacctgcaccttcagtggtgctcaggcctcccctgaagctcctggcactcacagggttccagttcaatgctgtcgcttttcttgccttcacctgagaagccccttgaggaaagctggaggccccagggcaggccagtgttcagaggaaggagtcccggcctacacggcccgttgtccgcagagccagtgagtcagggtgctcagaagggtcctgggaacggccagccacaggcaaaggcagctggagctgctgtaccggcctctcctccccgcagcctgttcccgtgtccataccggcctctcctccccacagcccgttcccgtgtccataccggcctctcttccccacggccatttcctgtgcccataaggtctgtggctccccgctggccgggcgtttgcaactgcccagggggctggcagccttcgtccatggggtcattgccaggcctccccacctactgggtgtctgattcgttcctccccactgggctgcccttgctctgctgtgcgtctgtgctgggtacactgacatctggctctccgtccctctgcctgcaggcagtgtaccctggtgcctggcctcgtgctgcctaccctccctagccctggctccgtcggggtctccacaggcttcgccagccccgcacatgcacgcgggttgcgggatgcaggatgccggagctgggctgcccagccgctggcctgccctgtccccctaggcagggagagcagccaggaggagccgtgagcctttctgcactgaaaacaatcccagccaagctgacatccacattctctgtgattttctgttttacttttgacactggcatatttcgagggaagcttaacagctgtatgttttaaaagaaacttaagagcacatgtgaaaaattgtgtacttcaagtttactggttgttttttgtttgttttttgtttttttgagacagtctcgctctgtcacccagattggagtgcagtggctcgatctcagctcattgcagcctccgcctcccaggttcaagcgattctcatgcctcagtctcccgagtatctaggactacaggcgccggccactatgcctggctaatgtttttgtattttttttagtagagacgggatttcaccatgttgtccaggctggtcttgaactcctgacctcaggtgatccgcccaccgtggcctcccaaagtgctgggattacaggcgtgagccaccgcgcccggcctgctgtttcatttttaatctcttaaatggagtttgctttaatatatatattttctcatcataaaggaacttcatactcatcgtggacatttggacaatataaaaaaggaaataaaacctagtgtagtctcaccaactgagacataaccactgctggcattgggcatgcgtcctgctccatttgctgctgtgtgtggatgttcacgcagacacacacacacacacagagtacattatattgtggatatatgtgtttgtgtgtgtgtgtgtgtgtgtgtatatgtatgtgtatatatatatatttatttatttatttatttttttttttttgagacagggtcttgctgtgtcatccaggctggagtccagtggcttgatcatggctcactgcagccttgacctcccaggctgaagcagttctcatgcctcagcctcgccagtagctggggacacaagtgtgccctattctgcccagctaatttttaaatttttgtagagatggggcctcgcggtgttgcccaggctggtcctgaactcctgggctcaagcaatcctcccacctgggcctcccaaagtgctgggatgacaggtgtgagccaccgtgcccgcctgtgcatattttgtgaacaaaatgggatgtgctgtgtctacggtttttgtactttctataagtaagtgtatgagcttcatctcaacagtggagtttaaagcaggttgcgtaggtgctggtgccatttggaacccgtattttttccggtacagacgagtttccctctcccttcctgttcttccgtgtttcttctttatcgcttccttctgtgtgtatttaagtggcagtgctcccacggagatagtatttttgtcatataatttgtctatttagagagttgaagtgggttggcctgtgcccacatcaacataggcccttccagtcaggtaggacttaggaaaactggcatgcaccgtccagcatgccccacagggtcccacctccacccatccagcctgcctcacggggtccccgcctccacccagtctggcccacaaggtcccgcctccgcccagccagcctggcccacggaatctccgcctctgcccagccagcctggcccatgtggtccccgcctccacccatccagcctgtcccacagggtccccgcctccaccccagcctgtcccgtggggtccccgcctccccactcctcgctgctgcctgtgagtgcctcccggcccgttactatttcagtctcggcttccatgagacgtttccttcttgtctcttccctcagctgcttctgctctaaagacccacctggtgtagctgctgactccatcgcagctgccctgagcactgctgaattcagaaaacagccttggaggaagcgtctctttatcccccgtacaaatgccgagacaggctccgggtggccagagcttcccgggtcagcccaggagatggcccagacccacagtgctctgggggcagcccaggccccgcccactgacagcactcatggcccctccggcggcagcttcagctcccctggggcagctctgatgcggggcaaaggcaggaagacgcccatgtgccatggcttctgcttcttcccaatgaactgcagttaattaaacaacacagacctgctgccaggagaaagtgtggcccctgggcacagggcccagtggggtggggagcaggggtgcggggagggcatggcccctctgcatgggtgtctgggcctcagctgtttcattatttgtaaatgaaagagcctggacctcaagttgtcttcagttttctgtctttaacactcttaagatttcattgttaatgtgattcaatcaatttggctaagttaggtgctgagctataattaattattttaacaaaagaagtaatacaatggatttttctcctgcttgttaaactaagtcatatgattataaaaatgaaactttatagatgcgactcccgccaaccctctccccagataccaagtgccgccctcggcagggatgcctgcatcaccccagtcatttagggtcatcaggggcccgagtaacgctggggcctgagcacgcggttggggtctccgtgtcccagccccccacccagccccgacctctgcgaacagcgccacacgtcccatggcttgtgtttcatgtgtatacttgaaggagcatgagtttcgtaaacatgctgctggctgttacattaaaaacatgagaaggtaacggcagcctccacacgccgccctctgctgtctgtgcctccgtgcccttggctgttcccaccccggggtctgcgggggtcagggcctgcctcctcttcctcagttggagtgaatttggggtctgactgagggcctcggccatcgtcaaatgtgacaaacacaggccctccccagagaccgcgtctccaggaagcacctgctcctctgggtttcgctgcagtcacctgagcaggtgctgggccaccgagcacttccatcacacagtggctggcggcggagccttgggtcgttttctgaaggtcaccaaccctttggcatcagagcaggcagagccttttgcatccccgccagtccccttgcccaggtggccccgggcaacctccaccctcaggcacccggtcccagttctgtttacagcttctcttttcctggcttctttccccatattgacaagatttcagtcttaggttggtcttgtctgctgtgctgctctgaggaagcctctcggctcctgggtgtgcaagaagccaagggcagccccttccctgtgagcgtgcgtgtccacacgcgtgtgcaggtggcacagagcatccagggctgtcatcagctgcttctggaccgcccaggtggctgcttgggagtttaccgtcacggcagtcctgtgctgccgtggaaacgcggggttgccgtgtggccgccgtggaaacgcggggttgccgtgtggccgccgtggaaacgcggggttgccgtgtggccgccgtggcgcggcagccatcgcctgcccggtgctgattgtgcctcctgtgtgcccttctcctgtagaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgcttttaagcctgtagtcctgatgtggtctttaaggatggtgaatgagctttgtgctgggcggacgtccccgagacacttctccaggggtaacttcatctcctgggaccacgggcatccaggctggggcaccttctcctcaacctgcctgcccctcacccgccgtgggaatggctccttttcactcatacaaaaaaaaaaaaaaatcatcttacctttttaacctttagggtgttttcttaaagaaaataccatccagtttgtttcttcagtccctgaaccagtagaagagaaaggcgtcccccacgccatccccggcttcctttgtgggtacaggccactccccccagctcggagaggacagaattagcagtcatcctgaattttactgtattttgtgggtacaggccactccccacagctcggaggggacagttagcggtcatcctgaattttactgtattttgggtaagcttagctaacatcaataatctttttatattgctttttttctaaaaactgcagagattcctgtcatctgagagggaaattacacactgggcgctaattgcaaaagcagctgcgttctcttagtaaaatcagggtgttttggaaggtttccattttctctgaatgtaaacagcatttgtaatagaccagatcctaaggaagcccttgaatccccacgttcacaccaaactgttgggactccttgtttttatcaggcaagctctggaaaggcctctcaagatgtggaaaatggggttttgctgtaaagtcgctgtaccctaagagtgtctgtgagacagagctgcaggggtgatgtgcagcccccagcccagccctcgcggggaagagcctcacgctctgtgacccccaggattgtggggagggcctcatgctctgggacccccgggattgtggggaagagcctcatgctctgggacccccgggattgtggggaagggcctcacgctctgggacccccaggattgtggggaagagcctcacgctctgggacccccgggattgtggggaagagcctcacgctctgggacccccgggattgtggggaagggcctcacgctctggacccccctggggtttacgtggtctgtgccgcccacacttagtgagtccagcccattcttggaacaaagtacaatatatcttacagaagaaaatattttatctttttctgaaaatataatgattgagtcctaattaaacttcaagcatggttgaccagaaattgaatgttttaaagaaaacctaggccttatagagaaggattgctttccagagcagtgcattaatttttttcttatttgctcagcatgcggcagtccccaccgtgggtttgagcagcactgactttagcacagatcacgtatctcagaggcagaaggggcgtgcggggagcgtgcctgcccttcacaggtgggaggtggcggcccccaggaccgtggccacagcatgaagccggtggggctgagccgctcctgctacctccagtccacaccccacctggcagccggccgtcctgtcctaccagccacactcctgcctcgattggccccggctcccctctcagcattgtgcccagcgtggacatctctcctgcaccccctgcccagtgtctcggctgcaccctccaccccccatctgctccagcatggctcaacgcaggccaggttccccaggctcaccctgggcaccagccttcgcccgttctccctctctttgcctccgtcgtctcttctctcctggacgtagcaccatagtccctgggtgaccatcccaggtccccacaagcacactgaccagccccaccagcccccaggggctccccggctccctgtcaccccacctggtcctgggggctgcgaccgcaacctgcaccagactgtgagcccctcaggcagagcccccaggctgccgcagggcgagatccccagtgttgacgctgggcctacctcgaggccactgtcagtgtggttgttaaataaataatgaatagaaaccagcacccaggtatccgtgttccgtcccgcgtgcccgctgcacttcctgcctctgcaaccccggctgggtctgaggacgccgaggccgctccaggacctgcgtcctccgtgctgtgcatctgtgtcttggggtccagctcagatggcttctgccacgtggtccgagagatagttgccagctctgcttctgccgaccctggaggtggaggcaggacgggtgggtgtgggtggaagacagctgcttagcaagcaccgccctgactcaaagctgctcttggctttttcccttttctacaccgtcatcatggggtcgttagcagtctaggtttccgctgtgccgatgagcttcgggtctgcatgcccgggggtcacggcagtgaggggcggactcctagggttgtgaaatgtgccgttgaaatgcacaaggtgacaacagtgaacccacttacactccagctgtggaattcatttcacgtacatgtttgtaaagtcaagtctcattgtaggttttccttcaaaattgccatccccacaggcagcacagggaggcccctccgagagctccaagcatttggaatccaggtgcccgaggtgtccggtgcttgtggggggcgggctggggacacgccttggccaccagccgcccgcactcctcgtctcagtgccaaaggcatcctccgatgactcggccgaagatgagctcagtccgcagcccctgtcccggccccgcctcccgtcttcagggggcctcacgtctccttttgagtcagaaggtcgcagtggtcggcctccgggaatcaggcatctgagtgcagggggcccccgggctcaggtggggctgacacctctggctgatggtctgtgatggggcccagagggagagttcccttcaccctccctggggcggggggcaggcattaaatggggagaagttcccagcagaatgtatgagccccatgaacggagtgggcatagccctcggggagtcctgccggccgcccctcctgacatcccggggtgctgcccggtgaggaaagtgaaaatgttgtctgcagttagaggctggaacacacatgcccacagagaggcttcctgagcggcttgtctgtcactgtttttgtgtaactgcgcctgaatttaatctcccggaaggcgcgttaggagggctgagggatgatctggtgccaggaaggttggcagttccgagaggttattccagcacgtcagcattaaaggagagaggcgaacctggaacgtgggaaccctgcccaggtctggttagaaaggcggcgtccgcgtggcctggggcttgtgtgaggggtgcacttgtgcccccagatacaagcaggcagggccgggaatctgtctcgtggggggctgcgggcactttggagaaagaaaaccaagttacaaactcaaaattacctaccaaagtcagtatttttttaaacgagaaaataaaacatgacaaatgccaggtctttttgtctgaagtcgttttagtcggttacctggaaacgctcccagggcccctgagctggggacacggagctcttcccccatcagtgcccaggagaagctgctcccggccctaggtccctgtgggaacacacagccagccctgcctctgtgggggtccctttcgtggccagagcccccttcctcaggggacacgcggtccagctgagggtcatcccgtgacaaggagtggctgctgtgatgacccaggcacagaaacagctttgaccacagaacgtgacatccagggtgtgaaggtgtcggaacagatctgcctcgggatctgggggtccttcaccaggggtgggcgtgggccccgagcccagacaggagccagctggagactcaaacgtcacgaagaagggaagacgcgcttccctcccccggtactaaccagcccttctgctggccctgcaacgatgacctaggcttgagaatctgtttctgcctcaaggggtagaaaggggaatagattccattacttccctgtttgcaatggattattaaatccagcaataactgtggcatcggagaggtgttggtacagagggagccggggtcctgtggccttgggtccaccccagcgatcatcacgggagagagctgcttagggtgtgagccgtgggggggcggggggcggctgtgaaactgaggtccccgtgcacagatcccaccacccagggtcgacagctgggggctttctctgctggcacttcccaggcagcagaaccggcccctctaggaagccccctccaggtggcgtggcccaggccctcagtaagctcagctggggctgtgtgagctgaggggctcagagcaccccacaagggatccgcctgattgcagacaagcagttctgggccgccgcccgacctccatgcccttctgctcagcccggcagcctctccttcccaggggtttcccattctgccttttccctggactttccaactcactttgtccaagtccactgcatgtaaagcttgatcctgaaacagtgaagttcttgaggtctctgcagatgctcagcggccccaaatcaccctttcgctgccattggccaaaagcacagcctgggtgggccttgaacacctgtggcctcttcccctccccctcccctcaccccacacacttggagacaccctggggctgggcctgagctcggctctcactgcagagtaaacctgcccacctcagacacccaggcatggctcccgccttccctcatctgatcctgccaccgtggcggctgcctccaagctcctgacaacgtcaggtcagccctggcctcgcggcgctctgggtttcagccttaagagactttccatgtgtcggctgtgggcgccttgacgcaccagggcctggtcacaggttctcaaagcagagattctcctggcacccctcgtgcgccctccaagggcctaaaacgcagacgacccacactccatgccatgtcctgcacaggaaccagggtggcctcccctttctgcagcttgtgggggtcaagccgggacccctacactgatgtttcagcccagctctgccgcagcttagaagtcctacctgatttcagacagagcggatgatgctgacatttccagcccacagcgtggcctgcgccacgctccaggtcgccacaggggtgagaattctgggagcccagctgccgagtgcttctggggttggagctgggctggccccacctgtgaacagcggcctgtgggcccctcatccctgttctactgaaggccccacaaccacctgagggagacagcttttattaaatttcagtttttgtcggttgcctcgctcttcagacggcaagtgagagaagcgtgttctcacgcttactgtcaacgttgcgagggaagcgtgttctcatgctcactgtcaacattgtaaacctgagggaagcgtgttctcagctcattgtcgacgtaaaccccagggaagcgtgttctcacgctcactatcgacgtaaacctgagggaagcgtgttctcgcgctcactgtcgacgtaaacctgagggaagcgtgttctcgcgctcactgtcgacgttgtaaacctgagggaagcgtgttctcacactcactgttgacgttgcaagggaagcgtgttctcgcgctcactgtcgacgttgtaaacctgagggaagcgtgttctcacactcactgtcgacgttgcaagggaagcgtgttctcacactcactgtcgacgttgtgagggaagtgtattctcacgctgtcgacataaacctgagggaagcgtgttctcacgctcactgttgacgtaaacctgagggaagtgtgttctcacactcactgtcaacgttgtaaacctgagggaagcgtgttctcacactcactgtcgacgttgtgagggaagcgtgttctcacgctcactgtcgacattgtaaacctgagggaagcgtgttctcgcgctcactgtcgacgttgcgagggaagcgttttcacactcactgtcgacgtaaacctgagggaagcgtgttctcacgctcgctgtcaacgtaaacctgagggaagcgtgttctcacgctcactgtcgacgttgtaaacctgagggaagcgtgttctcacgctcgctgtcgacgttgtaaacctgagggaagcgtgttctcacgctcgctgtcgacgtaaacctgagggaagcgtgttctcatgctcactgtcgacgttgtaaacctgagggaagcgtgttctcgcgctcactgtcgacgtaaacctgagggaagcgtgttctcacgctcactgtcgacattgtaaacctgagggaagcgtgttctcgcgctcactgtcgacgttgtaaacctgagggaagcgtgttctcacgctcaccgtcgacgtaaacctgagggaagcgtgttctctcactgtcaactttgcaagggaagcgtgttctcgcgctcactgtcgacgttgtaaacctgagggaagcgtgttctcacactcactgtcgacgttgcaagggaagcgtgttctcacactcactgtcgacattgtgagggaagtgtattctcacgctgtcgacataaacctgagggaagcgtgttctcacgctcactgttgacgtaaacctgagggaagtgtgttctcacactcactgtcaacgttgtaaacctgagggaagcgtgttctcacactcactgtcgacgttgtgagggaagcgtgttctcacgctcactgtcgacattgtaaacctgagggaagcgtgttctcacgctcactgtcgacgttgcgagggaagcgttttcacactgtcgacgtaaacctgagggaagcgtgttctcacgctcgctgtcaacgtaaacctgagggaagcgtgttctcacgctcactgtcgacgttgtaaacctgagggaagcgtgttctcacgctcgctgtcaacgtaaacctgagggaagcgtgttctcacgctcactgtcgacgtaaacctgagggaagcgtgttctcacgctcgctgtcgacgtaaacctgagggaagcgtgttctcacgctcactgtcgacgttgtaaacctgagggaagtgtgttctcacactcactcgacgtgagggaagcgtgttctcacgctcactgtcgacattgtaaacctgagggaagcatgttctcacactcactgtcgacgttgtaaacctgagggaagcgtgttctcacgctcaccgtcgacgttgtaaacctgagggaagtgtgttctcacgctcaccgtcgacgttgtaaacctgagggaagcgtgttctcacgctcactgtcaacgttgtaaacctgagggaagcgtgttctcacgttcactgtcaacgttgtgagggaagggtgttttcacgctcactgtcgacgttgcgagggaagcgtgttctcacgctcaccgtcgacgttgtaaacccgagggaagcgtgttctcacgctcactgtcaacgttgtgagggaagggtgttttcacgctcactgtcgacgttgcgatggaagcgtgttctcatgctcaccgtcgacactgtaaacctgagtgaagtgtgttctcacgctcactgtcgacgttgcgagggaagcgtgttctcatgctcactgtcgacgttgtgagggaagcgtgttctcacgctcactgtcaacgttgtaaacctgagggaaaggaattctctctcacatgctgtggggtgctggccccaccaggcctcccaggagacctccccaaaagtcagaagaagggctccaattgaaagggaggtccgagatgtgctcgccaaaaccacccccagcaagacgccaggcatcctagccacccgacgctcaggccgtgcgtgtcctcagagcgtgttttaaagcaggagggatttggggtggaagattgctcctgcagaaatcagagatgaggggagtaaattagggaaccagcgtcaggatccagacttctgtgaaagagccacagggctcagcatccgacgggcgcacctggggctgggcgagtctggctccagaaggggggtggggccgggagcctgagatgggatgagagggcgggaaggggcttgttgagaaatctaagggccacgggccaccaaaaacaaaccaggaggtgtgagtcagtggggaggctgggtgccaggaagcctgcgctctgggacatgcgtggggcaagaggggcgccctgagcttggcgacgccagccgcgcgcctgggagggatccgcctgtccacgtgcagccgcctccgggcggcgtcggccatgctgctgccccaccgtggctctgtggctccagccggaatggcaaagcctggctccacagctgcctgggagcgtgagtcacgcgccccacagaacacggcgggcagcgcgggcgaggattggcgaaagccgaccgatgtgttttggcttgtgtggtctgtgggagcgtcctttgtcatcagcctaattgggcaacagatcccacctcactgtgccctggagcagcacggggccaccacacagcctgaagccccacttgcgcttcccctcgctgccgtgctgtcctggccccgtcgctgccacctgaggcccccatcaagtacctgagctctgcgtctgttttcacgcttctgtatgtgtaggaagccccccaccgatgttgctcggggtcgacgtgataaacctgagggaaagggaattctctcaccccgaccgacacacaggatgggtgtgggggcaaagtgagatcatgaacaaaagcatctgggcccgtcctggacacatggccagggttagccacggttgtcagcctccacggagctgcagtttcagcctggaggtctgtggcgtgcatggttggaatactcaccagactcacgtggtcgtgactccggaagatcatgccttcctggaaaccttggaacgcgcttcagcagaaactccagtgaagagtcggtgagagagcacaaattcccaaaggcggatggagttcggaaggacccttctctgtctcccacatcaggcggtgcctggttggtgcagatttaccccatggtgggccgtggatccctcacctgctctggaaactgatcttggctctgaacaaggagaaatgatgcctctcagcctcgagggatgggtgataaggcagcttcatccgctgttttctttcattgtttgagaaaagtcatgccccggaggtgtcattcctggttgtttatgttgatggcaaaacttggactttcttgtcatacagcaaacagaagacaatctgatctttgttttccaggggtttagactttgaacaaaacctcttttgtccagtactgtagtgcatccctggtagagtaattcaagctgaacacaaggttgcataaaaatgtgggcatgggggagcagggaactgtcttgggatcattctttgctgtgcacagcagctgcagcctgcaggcagctcagcgttagatctccccacccccaatgccacctggggaccagatgttactgttggcggaagaagggggtccggggcactgtctcagtctttggggcttccatggtggagcactaccggccgtactgttggtggaagaagggagtccggggcactgtctcagtcttcggggcttccatagtggagcaccaccggccgtactgttggcagaagaagggggtccggggcactgtctcagtctttggggcttccatagtggagcaccaccggctgggcaccttgtaaacaacagacattgatttctcacagctctgggggctggaagtccgaggttgggactggtacggtcgggttctggtgaggaccattccaagttgcagacagccaaaatcctgccatatcctcacatggcaggacaggcgatttgtctctccctccctgtgggacggcagtcccgttggatcagggccccaccctgatgacattgtttaacccccagttacctcctgcaaacaccactctcaagtagagtcacgcggacgggggttagggcttcaacatgaggttgaggggacacgagtccgtccatagcagtgaccccacttgtctaaagccacagggctgagcctgccccctgcccccctgcctgcccatccccaggcccccgttcttgcccccaggcccccccccgcccacccccaggtgctccctgtgctgcagacagagcccccgaggagccaggagctgccgggcaccaaccacacaggaagccaacaggtggggcaggcttgtgcctgccaccgtgttgctcatgccgatttttattctcagatcttgtcacctctgtcttgtagcagaagggggccctgatctgggagccgtgaagaccccagctgtcccccgggagccaggccacaccaaggcagccaaggggactacgttgggaggaggatgtggtccgggccattaagagctgtgatgagcccccaggtctgccctgggtgaggggctctgcctgccctggggctgcatagacccggctggggctttagaacaggaaccgttcgaggggctgcggtgggtgaagcccactcatgtcctggctcctgttaccgggtagggatggcagcccattttccaggcttgggggttctttaagaggccaggattgtgccgaatgctctttggctgacgatggccgtggcgggggctttgggaggggaggtcctggaggagaggcttgcccagctcactgcctgcgtctgtggccagaattggcacctgcatggggcctggaaacgtcgtgctcacctggggcggaagcccccctccaggactcagctcccaacgtcactgctaccgaggcagagactctgcagcggcatcagagagaagctgggccccagaacagcaccaggcatgggacgggccctccgtgccttccacggaggatgcaagcgtgaggcctgggtctgcggggacggtttacctgtcagctctgcacgccgctgaccactgcgcgccgcctccacagacagtccccatggacgctggggctgccgtggacgatggggcagccatcatggacaacgggactgccatggacaccgcagccagcctgctctgtgggaatatgctttgtaaagccagccggccctgaggccagcactcgccttccacactctgctctttgtaacgagtttcataaactcaccctcaggtgattggtgtttctgttgcaccgttgcttagcctgaaaatgagctgccctttttctgagcccatcctttcgccacctctaccccagcccctcatggctgatatcaggaggtagccagaggccgcctggtgcagggtgagcccggaacacgggcaacagcttgaactgggcctgtgcggccccctccacgggcgacagcgtgaactgggcctgtgcggcccccctccacgggtgagactcccaggcgctcttgcagacgctcactcactttctcactgataggatgcgtcttacgaggctctgatttacagagcaggcatccatcttctctgaaacccacacaaaaagcacagtttaggccaagcccaggtgcagtatgttcgtgtgtttaagcttcttagatgctggggtgtggaagcagccgtgtggctttcctttgcttgtgaaggtgagtttgcactttccagcttctctctgtattgggaaggctgcagctctccaggacatgacttagcagagaacatcccgctgcatcctcataggccagcgggtcaggcggggccattctgaaacgtcccctgtgggtgccgggtgcctcgcgcatccctgccgtccaccgccctttgtccctggctgtgcttcgcggcagtgccccttagggcaaggacagggagatggggcagtcgcctggggaaggcccggtcccagtgggaggcagcctcagagcagctgggatggcacaagacgccgctgccagggctgagaaaccatccggccaaccccagacttgagccagacttcatgggcaaggctgggagaagccgcgtggagaccccagcccagggaggggcactgtggcaggaacagggcccgcacctgcagggtcagcccaggccaccttccaagcacggtgaccacgtcgcagctcatgctgccagctccgggccaagggacctggactggctctccagactcacaagatgccgtcgtgggtggggcacgtgcggtgatcccaggtttcaagtagctgcccccagctccctgcaaatagctctgggcggaagagaagcagtgggcaggcacacgagtttattcctgagaggagcgtgttgccacagcctctgtggactggagccccaggcttcagaaagagagggagcgcctgcctgtgggtggggggacaggagctgccaacctggcggggtcccagcgaagcgtccactgggccttctgcttgcccctgggggtggtggatgcatcagtgctgggcctgctccgaacccgcagggcaagcagcccgtgcgtcccgatgccactgccggccgccagcatcctggggaggtgggtcgcgtgtcccagagccctgtgcccctcgccaccaccatcctaggtcaggacttccccaggaagaatccaagtggctggagagatgcgggggttaatgccggtaccaccgcggttttaaacggggccgtgtctgagccgtgttcttgacgttctccagccagcagcagcagacgccacccggttgccccagccccagcggctctcgggcatagccggccttggcccgtggggcggctgatttacaggacagctgtgcacggggcctctagtgtccgccagagctggtgggtgagagtttttaaagcgctcgggacacttcacagaagaggcgcactggcccccatgcctggccatgtttctgggccctggctgaaaatcccgagcagcggagagaggatcccaacagggtattaatttaaccttccagccatgtgcttttgcttaagatctaaactctgaaaattaccagcctaatttagaatggaggcttggccattcgggacaccagcatcttctgagcgggagagatgtgggtgcccaccggcgtctcactcccacatctgggcctgtttccagtgacccctgcacctctcaaaggcgcaggcctgagttcacagagagcacttggccaagccctgcctctggggctccccatcgtctggctttgtcgtggactcatcatttctggatttaccacatgcttcaagctggaacagcaggaaggggcagttcctgaggcccagctgcgtccgcagagctgggggcgccatggcctaaggcaagacgcgtgccctggatgaaaatgactccagctctgtagtctccagacagcggttagagccccaccctccacggacaccgcctcctgccaccccttcaaaaaagtgttgcagcccagggcccagatattcaattttctaatgtaaaacgaggcgggtagggtttcccaatcaacatgagggcgccgtgtcctctgcagccccctgacttgcacaggcagtcctggggctctgccccatctgtgaaccctcagctgaagagggcagccccagaggcagccacattcaggtggctgaaggcagagtcctcctcccaggaaccgcctcggcgctgccaaggcctgtgcaccttcttcagcccgaactaaggagaatgtgcgggactgagagccatagaccctcgtgagccaggcttgagcgttgtcttcagatggggcccagtgggcctcactgttgtgacgactgaatgtgacgtctggggtgtaattccagcgtgacctggtcctggggtgtcactccagcgtgacctggttcctgaggtgtaattccagcgtgacctggttcctggggtataattccagcgcgaccttgttcctggggtgtcattccagcgtgacctggtcctggggtgtcattccagtgtgacgtggtcctggggtgtcactccagcatgacctggttcctggggtgtcattccagcgtgacctggtcctggggtgtcattccagtgtgacctggttcctggggtgtcattccagcgtgagctgtttcctggggtgtcattccagcatgacctggttcctgaggtgtaattccagcgtgacctggtcctggggtgtcactccagcatgacctcgttcctggggtgtaattccagcgtgacctggtcctggggtgtaattccagcatgacctggttcctggggtgtaattccagcgtgacctgctcctgaggtgtcactccagcgtgacctcgttcctggggtgtaattccagtgtgacctggttcctggggtgtaattccagcgtgacctggttcctggggtgtcattccagcgtgacctggtcctggggtgtcattccagtgtgacgtggtcctggggtgtcactccagcatgacctggttcctggggtgtcattccagcgtgacctggtcctggggtgtcattccagcgtgacctggttcctggggtgtcattccagcatgagctgtttcctggggtgtcattccagcgtgacctggtcctggggtgtcactccagcgtgacctggttcctgaggtgtaattccagcgtgacctggtcctggggtgtcattccagcatgacctggttcctggggtgtaattccagcgtgacctcgttcctggggtgtaattccagcgtgacctggtcctggggtgtaattccagcatgacctggttcctggggtgtaattccagcgtgacctgctcctgaggtgtcactccagcgtgacctcgttcctggggtgtaattccagcgtgacctggtcctggggtgtcacttcagcgtgacctggtccgggggtgtaattccagcgtgacctggtcctggggtgtaattccagcgtgacctggttcctggggtctcattccagcgtgacctggtcctggggtgtcactccagcgtgacctcgttcctggggtgtaattccagcgtgacctggttcctggggtgtaattctagcgtgacctggtcctggggtgtcactccagtgtgacctggttcctgggtaattccagcgtgacctggtcctggggtgtcactccagcgtgacctggtactggggtgtaattccagcgtgacctggttcctggggtgtaattccagcgtgacctggttcctggggtgtaattccagcgtgacctggttcctggggtgtaattccagcgtgacctggttcctggggtgtcactccagcgtgacctggtcctggggtgtcactccagcgtgacctggtcctggggtgtcactccggcgtgacctggttcctggggtgtcactccggcgtgacctcgttcctggggcgtcactctggcgtgacctggtcctggggtgtaattccagcgtgaccttgtcctggggtgtcactccagcgtgaccttgttcctggggtgtaattccagcgtgacctggtcctggggtgtcactccagcgtgacctcgttcctgaggtgtcactccagtgtgacctcgttcctgaggtgtcactccagcgtgacctggtcctggggtgtcattccagcgtgacgtggttcctggggtgtcactccagcgtgacgtggttcctggggtgtcactccagcgtgacctggttcctggggtgtcactccagcgtgacctggttcctggggtgtcactccagggtgacctggtcctgaggtgtcactccagcgtgacctggtcctggggtgtcactccaacgtgacctggttcctggggtgtcattccagggtgacctggtcctggggtgtcattccagtgtgacctcggcggcacttgcagggtggggtggctgacgaggcggggggagcacacccgttctccctcccctgccctgggcaccactgcagaggcagcccctggcctcatcctccaagcttcacagcttgggctgcactccccgagttcactgtggctggacttgccccaggccaaaggctgggaatgcctgggctgcagagccccaggaaggcctggcacgaccctcagcagagtgtggctttatgggccctggtcagtgagctgcaggctgcgtcctgggaaggccttggaatcacaatggccccgtgattttcttcctgcctcctggacgtccccacctcctggtcacccaccccctctaaaaccttagcctccctactctgtgtagggcggacgctttaaacctcgatgtttctactcagtgtgcagggcggacgctttaaacctcgatctccccactcagtgtgcagggcggacgctttaaacctcgatctttctactcagagggtggatgatagaaagatttgaatgagtgaatgaaagtagagacttgaaaagtcagcacaaaagcaacaaaatgcagcaactccactcggaatccctgggtggaaagctctggttgacttcctgcggactcaggctggtgagatcctacagctgggaacggcccatatgggtcagtccctgtgatgcctccagtgtggcgggaaggtggcttggccaccatggatgactcgcgcctgccttcacgaccgccgggacctgtgcggggggggaagagggcggctgcaggggaggccgcacgtggcacaggtgctccggcgtctcgagctgcaggaaaacgccgtctccatcgttcgcagctgctggtggactcctcggcacccagccgtggcggggaacagctgcatggactcacgggctcaagcccggggctaaatattttctctcgaattgtggaaatgcttttgtttactgcaggaggctgccaggctctctgtggtggcgactgtttgcaccgggagcctgtgtactggctttgggggccacacataggcccccaggtggtgacaggaggggagtttccctccctgtggccgaccctgctgccaaaaacccaccagtgtgcagcccacggggaggagaaaacaggctgaggagactcactcacagcttgctgtctgcgtagcattcgctcagagtggcaccacgcgtctgttaggaatgtatgtgcgccattgtgagagctttagagccactgagccgtctgatgtctcctctaagtagcacgagaggcctgagaccaacaggaaaacagcaaccgcaggaatgccggctgggatccgcctcgccgctcctgctgactgcacaccctgcctgtttgcttcccaacacccccacagaagccggcacaaaggctggggtgggcgtgggctgggagccggtgtcggctctggcccgggcctggcggagcagccttggggacccagcacccgccctgtgggctcttccccaaagccccggacttttagggagggctgggtgggagaaagctctagaaactcgggagccccctgttccatccaaggctgcccggtcacagcctccacacagcctgtccctttagaaggggactcaggagcaccgtggaggcagtccagcctccatgacagtgtttttctttcgcagtgacggacggcttctctcctggagcagtcgttcacctttgcagttggatttttactgactcctgaaagccgtcttgttctgtgttcgagtttaccaaatgtgcagacatttatcaaaccgagtgtcgggagcagaaatgcagtcgtgcatccacgttgaaactttcgctttgattcctgcaaacccacaggcccctgggtccaggactcccactgcagtttgcaagtggacttttatagcacgttagtgctgcaggaggttccaaggaaaacagtcctcgccagtattagaaccagctgctactctctcggccgatgactcacgccttttttttttaatggggtgggagaaccaggcaggagacagagggacccagtcagggccctgttggttttgcggagggtgccccagccacaagcctgcctgatcacactcattcgcaacttgtgtttatttaattttttttttccttctcacagttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgcccggtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacggtgagtgcccgcagccatgcaggtgtgtgccccgcctggcaccatggcgtgagctcatggaggggccgtgtgcgtgctgcgtgtgtggcacgtgtggaagtgcaccgaggcaccgggcagggtgtggggtgcgtcctcctgatataaagtgcccgtgcggtgccacggcgtcagcgccacctggggcgctcgccgtgagatctgctccggtggtcgcagtgtggggcccttggcgggtcctgggctgcagatcctcctgcgagacctgtcccggggtctaaggctcacattggtgtccaggtttgcttctgcagctgaatatggagccgcacggctcaggctcaaagccctgacttggagagggaccggcctctgcagtcggggcatcgtgggtgccgcctgagtcccgtgaatggtttgtagacaacagcttagccgaggtgacgagcacgttaccccgtgcggctctgtaaacacatctaaatgcagtggcggccttgccaggagctcgcagggtggccgtgacaccgggggccctagactgtgccttcaggccccaggtgcagggtcttccccatctagcccctgggctcgcacagcgcggagatgcacccaacaccgcacacctggggttgttagggaaggaagtggcctcacgtctgtagccaggcgggtggtgtggggcgtctgagcactcaggcctttctgtgacgagtggtgaccgaaggcgccgtggcgttcttctcgactgtttacactttaaggcgcagcccgacttgcttgcagtcgcgctgtgatcggggcgtgcccgtggccctggtgaccacgcgttagagggtgattccgctcgtgttttctggccctgcggtttgtgtgcgcgttgtgatcggggcgtgcccgcggccctggtgaccacgcgttagagggcgattccgctcgtgttttctgctcgaatggtttgtgtgggaattggcttcatttcctcggaggcacagtgagtcctcccaagtgtatgacgtttcccaggcccgggttccagcagacacacctggagccactgcccactccctgctcagtggcctggggtccaggcgagcctcggccttctggggagggggcggcattagcccctcctgacccagggggggcagggactcccgggcgtcaggagctcagtttcccatctgctgggaagggagtgaggccaaacgccttcctgctgtttcctgactgaaggctacaagctttttaaggaggatgcatgcaaatattttaacccccaaaatattaagctcttgagcccacagccctggtgtgtgtgtgtttgcggtagtgtgtcccatggagcccgcagccctggttgtgtgtgtgtgtgtgtgtgtgtgaacttgaggtagtgtgtcccatgaagcccgcagccctcatcgtctgtttttgcaggagtgtgtcccgtcagcccaggaggctgctgcctccccagggctgtccctcagagccacacactggaggcccgtggctgccccctggccactctctggaggttcatgatgactgtggggcggggccaggacagtgttccgtgtcctgtgcagatgtcgtcctgaagttcttactgtctgacctgcctgctgtcctccttgtccacccgcgaggccagccggagctccgcatggggcccatgtccctgctctgcagcctcctgagcacagatggactctgccttcctccccagcccctgcgcgaggtggacgctgacatccatgcctccagtccctcacccctgctttgtctcacgcggtaccaggtggtcccaaggcggctgggagatgctgagaaattctctttccacctgccatgccttgtcccagttgtgacccaccagctctgggctcccacaattgggtagtgccctgcaggcccaggtgggaagcaggtcccggtcatgtttctgctgccctgtggcccacgtgtggctttatggcgagggtagagttcggggtgggacttggggtgggtgagcagcggcagtgctgggggctgggacgtgttctgcgtcaacacagcaggcaggggactgttgacccgcacggtgctcaggtgagatcatccctttacccagcccgttactgccaaagcctcaccaggtggcccgggcccctctggccttggtcctagaggtcaaagctaagtgagccaggccttgccttggggcctggtgggccacagagggtgggctgttgtgtcgctgagtgcacaggctggggatgttggagctgcatgggtgtgggtgtgaccccgccctggcctgcctgactgtgcgtggacatggaggggatgggtcttggggaggggagtgcacagacgactccctgacacatggaagggctgaggccagagtgcatctgccatggggctgggcctggcctgcagctcctctgaggatgcccaatgccacgttcccattggggcctctcctgacagccagtgggaccctggagcccaggattcgccagctgtaaagcagtcgctcacaccccttttaagaaagtttgtttcccggcgtgctgccgtcgggacacttgaggacaacctctccccgcagagtgagctcagttcccagcgggcctctctccccattttcctcactcagttgccgtggtgatcctccccaaactcggatcgaatgggtcacgtcctgttcaaaagacccaggggtttctgtgttgtcagagcagaccacatcccagcccaccgaccacagtcatctcgtccacgtacgcttcgtcaggcccagggccggtcctgggaccttgagcacagaccccgagcgccagccctgcacactgttctggtcacagtttatgggtcctgtgtgcttccgcctccataacctgggagcagccacacacaagctttcggggttagcgtacggcgctaggcggtgccgctttgggggtcggggttgggatggaggttgagatacctgtgcagacacctccctatgacatggcaagtgtgtgcaggtaatgtggtgatgtccgtttcatctccacctgtgaggtccctcgatgctcagccaggaccacagcagttagggcttcaggcagctggaagcagtgtcagctgtggcctgatctcccccccgcccccgccccgccgtgggcagacagcccctctcggtccttcacaggcaggcaggcggggcgcatggcagaggaagttctgctcgtggtgtgtgtgaaggggaggggagagtcctgggggctgaggtggtgcaggtggggtagtgtctggtgcaggcccggctctgggttagggtggggtggtccctggtgcaggccccgctctgggttaggacagggtggtccctggtgcaggctcaggctctcggtcatggtggggtggtctctggtgcaggcccaggctctgggtcaggatgggggtgttccctggtgcaggcccggctctgggttagggcagggtggtccctggtgcaggctcaggctctcagtcatggtggggtagtccctgatacaggcctgacattgccgccaccctgggagacaggcaccaggccatggactccaggttcctcctgagcacctgggggcaggtccacccactctagacacctgttcctccctgtgagaaaagcagattcaaatgtttattgctctgtcggagccaagtggatggagccttcactgagaatgacacgggccgagccgtttcccgcgtcctgggtggatggagccgtagatgggtcgctgcctgtccttgtgagaagatggctggagcatccaccaacatggccgggaagggtcccgggtcagggttgagtctgggtcggcccctcccctgcagatgacctctggcttgccctgggtccctggaacctggaacccacaccccaggctcacaaacgccgtgacataaacgaggtcagggcctgggttatgtcgggaaagcctcacgcaggctgaagacctgaattgtgaggtggaactctgagtccccgagactccagctccatggaaatgcgggggtgtacctggggaccgtctcgatggggacagcgggagagggagcccagaccccaacaagctccacggaaatgcgaggagccatcttgatggggacagcgggagagggaaggcaggctagggtgaatgtgggtagtccttgtttagtattaatatatattttgtctaatttcacaacccctaagagaatcgggcacctcagcagccaccctggggctcagtcgctggcttagaaagcaggcaagcgtgacctggagttggggggcggagaagaataggaagcacagggcgccccaacaagggacgatcccagcacctggagaaggagcagagacgagagacagaaacaacacgaaccccaggtcaagtcggtgccgtgcgtgccaagtgtcctcagcgggtggaaagtgtcgctgtgtctttgatagtttacacaacagggagagagcgaaaagctggggttggaggaaacaggagagaagtaaggctgtgtggcggggacaagactcagacacacccctgactatctgtaaatgggccgatcggacacaaggccagggacctgctggccagccccgagccccgtgaggtgcctgtggcaggacgtgggtatggcaggtgacagaaaccctgccgggtccactttccagcctccccggcttcccttctgcgttccgctggcctggccgccacctccagggacaacaagcctggcatggggtgcagatttagtctccagccctctgcgaaccaagcagtggtggatcgcagagctgcgtgcggggagagggggagacaggccagcgtctgggatgtcctcgtggggccggggactcagccccggcccctgggcgcccagccatgtttgagaggcttccctccgcctgaccagaatcagagctgtgggtccatgaattgagtcacttcaaggtcttgctgcttcacatgaacagctgtgcagaggcagccagagacagcccggggctcctcacgcccagtgatgctgacgacggcctgcccgtgaggacatagaactttttctgtgcgtagtggtttttcatttgttttgattttgttttccaggaatgtggagttaaaaggcaataagagtatatgtgtccagctccaccccctcggtagggggtccacagtgtccgtgtttgcatccctgaggggtctgaggagggcagttcacgctggagcctcctctgtggcagcctctgctcagccgcaggaacctaaaggtcacgcacagcccacatcctgtgcgtctcaaagaagtcaagcctcaaaatgaaaaatgaggctgggcacggtggctcactttgggaggcctaggtgggtggatcacctgaggtcaggagttcaagaccagcctggtcaacatggtagaaccccatctctactaaaaatacaaaaattagctgggcgtggggctgggtgcagtggctcaggcctgtaatccctgtactttggaaggctgaggcgggtggatcacgaggccagaagatcgaaaccatcctgactaacatggtgaaaccccatctctactaaaaatacaaaaaattagccgggagtggtggcgggcgcctgtagtcccagccactcgggaggctgagacaggagaatggcgtgaacctgggaggcggagcttgcagagagctgagatcgcgccactgcactccagcctgggtgacagagcgagactccatctcaaaaaaaaaaaaaagattagctgggcgtggtggtgcatgcctataatcccagctacttggaaggctgaggcaggagaatcactcgaacctgggagatggaggttgcagtgagctgagacctcgccactgcactccagcctgggtgacaaagcgagactccatctcaaaaaaaaaaaagaaaaatgaatccagctttttttttttttttttttttttttaggatttctttgctttccagtcctttctactcccaagttttgtttcagaagtgcttgacccataaataaattccaacaatgaggtcgtctttgtttctcctgaatattgggctttcccctcagacttctcgagcatggccgagccacagaggttcagtttttaaacagtggttttctgtatcttgcattattttaaatgtagatttgaaaaaatgccacagagctccgtgtggctccttttctaatgtgatctccacgcattccgcatcgtggagaagggccgtgaggaggctccgctgggggcggactcgcggtggattacgcgtcagcgagggccgccccgtgccacgcgctcgcgcgctgagagcgtttgtggggcctgtgtcttccgaaacggaggcgctcggggcctgctgcggtgcccgcgggtctgtgccgctgaagtgggcacccctcctccagcctcgtgaggacagcggccgtccctcggcgcggggctggtctgccacgggcgcctccccgtgtcccctgggccgccgcacggcctctgccacggtcggccctttcagtccctcagaagcacttgggtttaaagtctccatgtcattaaaacaacgagcaggtagacgaggcggccggagcgtgtccgccgcagtctgggctgtgaacgggcccctcgcccgcccctcctgagccggagctgctccggaggacgagaagctctcctcgtggaaagtcttactaacctggcccggcgcccaggtctgaggccttccccccggctgaggatgattgaaagagcctgtgtgccgccatccaacgtcgttaccgtcgcagacggcggctaccgcgtgatggatggagcagcggactcagccgtgcaaatcattcatcggggtcagtgcctggtgccgtgggaccgcggcgtgggggtttcaaggcgtaaaaatcgcaccgcacgccacccggagacggagcctgctgtcggcagggcgggccgggctgcggggccgggtgctccggaggccgctgaagaggcagctccccaacgccaagagcccgtccagccccaggcccggagctgcttcctcagggagcccaccctgtgacgtgcccgaggtgaggcggccaccagaggccgcgtccaaacctgtgcgccaggcagcgtgtggctgaggctcagacgtcgactcacgcgtttcagttcctctcgagaaaactcgctgccacctggtctcagccagcgaccgcgagggacagtgagaaaggcgagagcgggcacacgccccccatcaacctggtgtggccgggggaaggcgagagcgggcacacgccccccatgaacctggtaccgccgggggaaggcgagagcgggcacacgccccccatgaacctggtacggccgggggaaggcgagagcgggcacacgccccccatcgacctggtaccgccgggggaaggcgagagcgggcacacgccccccatcaacctggtaccgccgggggaaggcgagagcgggcacacgccccccatcgacctggtaccgccgggggaaggcgagagcgggcacatgccccccatcgacctggtaccgccgggggaaggcgagagcgggcacacgccccccatgaacctggtgcggccgggggaaggcgagagcgggcacacgccccccatgaacctggtaccgccgggggaaagcgagagcgggcacacgccccccatcaacctggtacggccgggggaaggcgagagcgggcacacgccccccatcaacctggtgcggccgggtgagcatggagcccatggctggagaaccctggggcagctgcagtggcaagtctgccccttgaggaaatgggggcaaggatggcactgagacgggtgctgaacaaggctctctaaaaataggggctgcatgggctgtgcacatcccgtgtgggtgctgttgcaggtctcccgccgtggcgtgcaggctgtgaggccacagtgcctccgtccttccctgaggtgggcacgggagaaaggagaggtgcccgctcctgtgagctgcccacgggctgctccttggggcctgtgaggttctgggcacttttttaaattgcctgaagatattcactgtggacacagaatattttgaattctatgctgtttctagttgaaatatcagtctacagtccaattttgtgtacttggaagggaaatttgggggtatcattttcagctattcatcttctgcctttgactccttaaaagtgggtcttagcttgtttcggcgttaagtggagagctgtctaaaattagtaactggagagagagacatagggacgaggtggaaggaagcaagagggaagagctggagagatttcacagagcttgggcaatgagcactgtttagatctattttgtgccgaagaaaattcacggccagtggcagcaaagagagaccaagccctgatgttcagccgcgactgcgcgtctgggcagtgtggggcgtgtgtgcgatgcctttgtcatcttgtgtaggcaagccgtgaacagtggtaaggcgttcgcgagtcattgtaacgtaggcaggccgtgaacagtactaaggcgttcatgggtgtgtcactgtaacacaggcaagctgtgaaccgtagtaaggtgtccgcaagtgtcactgtaacacaggcaagccgtgaacagtagtaaggcgcccgcgggtgtgtcgctgtgacgcgggcaagccgtgaaccgtagtaaggcgtccgcaagtgtcactgtaacgcaggcaagccgtgaacagtagtaaggcgtccgcgggtgtgtcgctgtgacgcgggtaagccgtgaacagtagtaaggtattcgcaagtgtgtcattgtaacgctgtgtttttctggtgtagatgcactctgttttcctcctacagatgatttcaaactttacagaaacattttaagtggcattgtctccatttcaaatcaagttgcctagcttcctcctaccgccatacgttttctcttcctaatgtgtagacatttcaaagagcttccttatttgagaacgagtgttctttacagacacgcttagatctgtgagccagcatgtcgcactgatgtgctggggtaccggagcgtgaagccatgagcgaggtatttaaaaagcataacagccacattcagcgcccagaggccgatcgcccgtcagagggagagaggtggccggggcagtggagggctctgcccatgtctgtcagacagccatgttcttgccagggcagccagggccgggccactcaagctgggtgcttggctctccctgagctcgagcacgggcacgttcaggtgatcttcctgatagcaaagtgcgtttctgcgcatggactcctgaggagcagcgaggagctgactcacacattctgccaagcccaggctagaaagaggggacagtcggaaccgtagtgttttcttcctgtcaatgctgagagactcactcctgaggtcgcacatccttgccagcaaacggaagacccagatcacagtcctaggctcgtcctggacgtgtagcctttgtacgttccatagtgaccttttgtacattttctcctgtgcgtgttcagccttagaatggcactgtgggcaggcagaactgccggtgctcaccacccccctttcccggggggaaactgaggctcagagagatgccgctggacttgctccaagtcagtcaatgaggcagaaccaggagcgccccaaccccagcgccaaggcccgcatgctctcgcgggtcccagctctaccgttgagtattttcttcccactagagagatgtgatgagcaaagatttccgctcagaactcctaacatccaagtatgagttggctttgcaagccgaaggggagcatggtgtctgtttttcttcagagaatttctgactgtttgctaaggcacgtttccataagaaggactggagagaagcaggccttctaaactgctggagagcatcttgaatcagctctcccccaaagcaacaaaaatacagcatcactgtcaaatcaaccaccaaatctggcagtcagccaagaggacagaacaaacacagatgcattcactcaaggaagagcggccccagggggaagaacaggatggcagcgtcttcacttggggccgctccagccccgaggcgcacagccgtggaaagccagtgacagcacagaccgtggaggagctgggctctgttgaaaaccccatcccaggatgcagtccgcatttggactggtcatggagctcctggaaaaggcccgttccgaggcacaatcaccgttggctgcagtcgtgatcatgggagctgccccaaggctgcgatcgacattggagcaaacaagagcctggccagaccaggtgaccccggggactttgaaaaaccttggagattcccgggcacatacgaaaatggatgtgtgaaggcttcggtacagagagggccccagccactcttctctggctgacctcaaaaccccaccaagcagaagtgagaggtaaagctgcctgtggctgggaggcaggtcctgacacacaggttttgtgattagagggaggagactggcttcgtggctcaaggatttaaggaaacttcctgtctggtaacagcagaccattaaactctgctaaccagagggtgatccctaggcagcctggcttaaagacagaaacaagatttaaaaacagagagaacagaaaactcagtgtccacattctgcaaggaatacagcatctagataattagtccaggaaagtcatgagtcacataagcaacaaccaaggagaggggaagccgagaaacaacaagtcctatttggagggggatggggggggggaatctcatttcagagtcgctacaatgcattagttgtcatctccagttgtaaaccaaaaaattatagtacatgcaagaaaacatgaaaatatgtcccatccacaggaagaaaaatctgtagcccctgagagggctcaggtattagaccagcaaaggctttaaatcagctgcaataaatatgctcaaagaactgaaagaaattgtatttaaaaaattacaggggagtgtggcaaatatatcttaccagatagagaatatccataatgagatttttaaaaaaaaaaaaaaagaagccaaatagaaattacacagttgaaaagtaaatgaaaaatgcattagagaggctgaacaacagatttgagctggcagagaaaaagaatcaaacgtaaaaatcaacagattatttagactgaggaacagaaagaagaaagaatcaataaaaatgaacaaagcctcagagcatgtgagatgctgtaaacacatatacacatgcataatgagttatagaaagagatgattagaagaaatacgtgaagaaataatggccccaaacttcctaaatttgatggaaaacattattcagtgcatccaaatggttcacaaaattcaaatgggataaattaaaagcagctcacacacagacataaaccaaactgttgaaagtcaaagggagagacaatcccgaaagcagtgagaggaaaacagcttctcagtacgtgggatgctcagcaggattaacagccagctgcttattgtgaatcgtggatgtcggaggacagtgggacggcgcattcaaaatgctgaaagaaaaccactgtcaaccaagaattctatatctagtaaaactcatctttagagatgaagaaacaaagctgtgctcagataaacaagacacacagaatttgttgccaacagacctgacctacaggacatattaaagggagtccttcaggctgaggtaagaagcactggtgagagtaattacataggtgaattaaaaagacagcacaaacatgttttaaacttttcttctctgaactgatgtaaaaggaaactgcataagacacgattgcaaacctgtgctgataacaatgtgcttataacaatttgtgtgacagtagcacaaaggaaggggtggggaaggaagttacagcaaagcaaagtctttacatattattagaactcagtattcatctgaaatagactgttttgactaagatgcttgttgtaatctccagaggaaccactaagaaaatatatatgtgtgtgagtgtgtcacacacacacataaaatgtcaaaaaatgcacttaaatgatacactagaaaatatgtgtgtaacacaaaataagccagtaatgaaggaacatagaaacaatgacaacagcaaaagttacacaagacatgtagagaacaaatagcaaaatggaaaacataatcctaccgtatcaataatcacattaaatgtcagtggaataaacaccccaataaaaaggtagatgttgtcagactggatgttaaagacagaatgaaacagggtacaaccatatgctgtctaaaaaatacatattttagatttaaagacacaaataggttgaaagtaaaatgataaagagatactgtgcaatagtaatcaaaagagatatggagataatggaaaaaatacatacttcagatttaaagacacaaataggttgaaagtgaaaggatgaaaaagataggcagagttaatgtagaaatttggagtagctacactaatatcagacaaattaaactctaagataaaaatattactagaaacaatgaactgtcagtagtcatgttctctttgatcttaaacctgatacattgaacaggaagatataaacacatttgcacataacagagccccataatacatgaaacaagaactgacagaattaaagggagaaatacatagttgaaaaataatagctggagaccagtatatcactcttaatggatagaacaactagacagaaaatcaaaaggatataaaacacttaagactatcaaccaactttacaagacatctgtaggacactctacagagtgcacataggatagacttcctactatgccataaaacaagccttaataaatttcaaaatattctgattgcaatggatatcaattgaaaatcaacaacagatatttccacaaatatttggaaactaaacaacacatttctaaataattaatgagtgaagttagaaagtataagggaaattggaaaatattttgaactaaatgcaaatgaaaacacaacatatcaaaatttgtgggatgcaggtaaggcagtgcttagagggaaatttatagctttaaatgcctatatgaggaataagatggatttcaaatcaataatctaagctttttccttaaaaatgttgaaaaaggagagaaaaaacccaaggcaagtggaaaaaaggaaatgctgaggatgagaagaaaaagcaatgaaatagaaacatgagaaaaatcaataaaaccaaagttagttatttgaaaaaacaacaaaattgacaaaactttaatgagtttttctaacaagaaaaattaggaatgaaagaggggacattgctactgaccctgcaaaaatcaaaaggttataagggaatactataaccttatgccaacagattaaacaacctggatgaaatggaaacattcttagacacgaattacctaaactgactcaggaagaaacagaaaagtataatagacctatagcagggaaataaaagaaattaataatttaacatattctcacaaagaaaagcccagacccagagagctttactggttaattttattaaacattacaagaataataccagtgccaatactccacaaactcttcagaaaatgaagaaggaacacttctaatactgaagccagtatagccctaataccaaaatcaaaagtatcgtaagaaaaactatagaaaaatattctttatgaacacaggagcaaaaatccacaacaaaatattatcaaactgaatccaacaacataaaaaaaagattttacaccatgaccaagtgggatttatcccagtaatgcaaggttggtttagcatcagaaaatgaagtcatgtgatgtaccatattaatagaaaaaggacagaaaccacgtgatcatttcaataaatgcaagaaaaaaagcatttaacaaaatccaacaccaacttatgataaaatctcttgacaaacttagaacacaagggaacttcttaacctgatcaaagtcatacacagaaaaaaaaacagtgatcatcacactgaatcgtccaagacggaggaccttcttttcccctaggatgaggaaggatgcagaggtggccactttcactgctgctactcagccttgtactggaggttctagccagtgtagccaggtaagaaacagaaataaaaggcaaccggaatggacaggaaaaagtaaaattgtctttattggaagaaaacgtgattctatatgtagaaaatcctgagaaatctgcctacaccccaccccccctccccccgccaaaaaggtaaaggaaaacccactgttaaaactaccaaacaagtgcagcaaggtcatcagatgtgagaccagggtacaaataaattatgtctatatgcaaggaataatccaaaaatgaaatcaaggaaaaattcctatctacgatatagcattaaaaagaataaaatatgaataactttaaagaagttaaggacttatactctgaaaatgacagaacgttgctgagggaaagttaagatctaaataaatgggagaacattgcatgttaatggaacagaagaatcaatattgtgaagatggcagctttctccagattgatctggagaatcagtgcaatctccatcaaaactccagcaattttttcttctaaaattcacaaaatgatcctaaaatctacatggagtttcaaagacccagaatagccaaaacaattttgaaatcagagaacaaagttggaggagttacacttcgcaatttcagaactttctgtgaagctataataatcaagacagtgtggtattggcataggacacatagatcagtggcgcagaattaaaagccccaaaataattcttatgtctgcggtaaattgattttttgacaaaggcacaaagcccatttaattggagtaaatgacagcctttttaacaagtggtgctgggacatttgccacatgcaaaaaaacacacaccacgcaccgaaaatgaacttgatcttggactagtaggagccaaaatagtcaaacgtttttggagatagcacatgaggaactctttcaagactttggattaggcagaggtttcttagatatgacatcaaaagcacagctcataaaataaaaacttgataaatggaacctcaccaaaatttaaaatttttatgcttcaaaagtactattaagaaaatgaaaagataagcaatagactagaggaatgtgtttgcaaaacaactatctgataaagggcttatatccagaatatacaaagaacacttacagctcaataataagacagaaagcctaatcaaaaactgggcaaaggatttgaatagacatttctccagacaagacataggaatggataataaacacatgaaaaaatactccacatcactagttattagggaatgcacattgtaaatttcaataagataccattttatatccattcaagtggctttaggagataagatagacaacagccaattttagagacgaggagaaattgggcccctgaagccttgctggcaggagtgtaacatggcattacattccggccacttaggcagtttcttaaagaaatttcttagaagaaacttgccatgtgactcagcagttccactcctaggtatgtattcaaggaaacagatgcacacatccacacaaaggcttgtacatgactgtccttcacagcgttctttagccaaacatctgaaacaaccacaatgcccagcatgtggggaagagagaggaaaggtggggtttatcctcacccgagtgttatccatccccaaaaggaatgagtactgagcacgccaggactcaggtgaacctggaaaccctcatgctctgggaaaaatccacacacgagaccacagactcagtggctcccttgcatgcacacctcagagacgtcgcaggttcagcctcagaccactgggatacagccagtatggcaaaagaaagccgctggagtgtgtggcttccagggcatataaaagtgacgctcacactgtactgagtctgttaagtgtgcaccagcaatgtgtctaaaaaaacagtgtttgtacctgcgtggggtgaccaggtgcattgtccgtgagcagtaatattattaaagggctctttttatgagcagttaagtctcaatggtgggcttaaaaccttcggtaaaccatgctgtgaacagaggtgccgtcatccgggctttgtcgctccatgggtggcgcacaggcagaggagattccgcgtcattcttaggggccttgggattttcggggtggcagatggacactggattcaacttaaagtcaccagctgcattagcccctaccaagggggtcagcctgtccttggaagctttgcagccagacactgagtcctctccagctatgggagtcccagacggcatctccaatagaaggctgttttgtctgcacagaaaatctgttgtttagtgtggccaccttcaccaatggtctcagccagatctcctggagaacttgctgcagcttccccatcagcacttgctgcttcatctttgcttttatggtatggagatggcttctttccttcaacctcatgaactagcctctgctggcttcaaacttttttttctgcagcttcctcatctctcagccttcgtaggacagagagagcgagggtcttggtctggattaggctttggcttaagggagtgttgtggctggttcaatcttctgtccagatcactcggactttctctgtatcagcaataaggctgttccgccctcttatcatcggtgttgttcactagggcagcggttttcacttctgtctgtctagagttttccgctgcattcacagttggactggcgcgggaggctgagctgtcagcctgtctcggctttcgacgggtgttcctcaccaaatttaatcattcctagttttgaagtgagagacgtgtgacctttccttgcccttgaacttttacttgaaaacttggaggctgtcgtagggttcttaattggcctaatgtcagtatggttgtgtctcagggaatagggaggcctgagcccagggagagagatagagaatggctggtcagtggagcagtcaggacgcacccagctcttatccattcacttcatcttagatgggcacagttcgtggcaccccaaaacaatgacaacagtaaccccaaagatcacagatctccgcagcagatatgatagcaatgagaaagcttggaacatcatgagcattattgaaacgtgacacagagatatgaagtgggcacctgctgttggaaacgtggtgcccacagacatgcctggtgcagggttgccaaagacctcccgtttgtgaaaagcagtgtctgaagcacagtgaagtgaggcttgcctgcaagacatccacaaaaggcgcagctctggagacaggagactgctgcgtgggaggaggtggtgctggaggcccttgggtgagggaagaggcaggagactgctgtgtgggaggaggtggtgctggaggcccttgggtgagggaagaggcaggagactgctgcgtgggaggaggtggtgctggaggcccttgggtgagggaagaggcaggagactgctgtgtgggaggaggtggtggatgagacccttgggtgatggaagaggcaggagactgctgcgtgggaggaggtggtgctggaggcccttgggtgagggaagaggcaggagactgctgcgtgggaggaggtgatgctggaggcccttgggtgagggaagaggcaggagactgctgtgtgggaggaggtggtgctggagacccttgggtgatggaagaggcaggagactgctgcgtgggaggaggtggtgctggaggcccttgggtgagggaagaggcaggagactgctgcgtgggaggaggtgatgctggaggcccttgggtgatggaagaggcaggagactgctgcgtgggaggaggtggtgctggaggcccttgggtgagagaagaggcaggagactgctgcgtgggaggaggtgatgctggaggcccttgggtgatggaagaggcaggagactgctgtgtgggaggaggtggtgctggaggcccttgggtgagggaagaggcaggagactgctgtgtgggaggaggtggtgatgagacccttgggtgatggaagaggcaggagactgctgcgtgggaggaggtggtggatgagacccttgggtgagggaagaggcaggagactgctgtgtgggaggaggtggtgctggaggcccttgggtgagggaagaggcaggagactgctgtgtgggaggaggtggtggatgagacccttgggtgagggaagaggcaggagactgctgtgtgggaggaggtggtgctggaggcccttgggtgagggaagaggcaggagactgctgcgtgggaggaggtggtgctggaggcccttgggtgagggaagaggcaggagaccgctttgtgggaagaggtggtggacgagccccttgggtgatggaagtgttctgacacctgcagtgatggtggcacaactgggcacctttaccaaaaatcactgaattttgtgcccttctcaagggtgcattacctgtgtgaaacgtgcctccgtagaatgctgtgtgtttagggaggggctgggagaccctagcaatgccacgtgctttttacttttcttcaactgagttttgagcattttgttaatgcaagaaaaaggactccttataaagagcggttcgccgtggggtctgagcctgtggcgtggtttcagttgcctcctcagccgcagtgtggagaggaacagtggtctcggccgagcagcggctgtgggcacctgcgtgtcagcccctccctccgtggacagatgctcctgagcttccccagcaaagacactgggactgtgcgccttgtccccccatcttcccacctccggtgaccaggcctctcccagggaccctctgtgctggcccggcacctgctctgatatgccctccccaggggtgtgggtccgtctgccctccacacagcccttggagcctctcttcacagggcctgagagctgagtgtggtttcataacatggttcattggcctctgaagatgctcagtgctgggggaattgggcttgaagccatcacgtccaacacacggtccctggaccatgtcctgtagggagtgttaggaggagtctagctctatttttaaatgacagtgttcatgacagaatttctcgtagggaataaaaatgtgtgtgcttcccagttacttattgtgttgcttaattaagaaatctctttagaaacacagacaggagcatgaacttctcagccacttcctgcctggcttctgggtggttctgtgttgcattactggaggtctgggtgtggaattttgagaatctcttgatccttttcagtttaattctgaaacagggttcttccttccttccagattacagtgtggacactcacacacagtaagggacaaagaaagtgtatccccttccaaagatccgcccaccaggccccggacccgtaatcaaagcctgatactgggacaatggacccagcggccgggccagccctcccctagttatcaccccagagctgtggctgggctctctttgttccgaaacggagctgatggagcaggacgctgtcgccaggcactgcggggagggggttatcagcccctggcccgcgtcccaccccagaggtgaagtcttcgccccagacaggccctatcaggccctcccagctgctgttattttagatatggcaggaagtagggcctggaaaccgcacggctcccagcccttggcagcagctcagttcccgaggctgcactcagagctggtggcagggagggagaaggcacagcagcctggactgcgggttagagggctgtgccggggccggtggagccatgcgagcggccgcgtaaatcaggcaggcgtggccggcaggctgtggctccccacagacatggggctgacggtgtgcagcgctggctggcgcagcctctgccaagggagcccctgccctccggggcagcaccatgaagacctcacccctcaagtggatgggtttgcagttcagcccagtgtctgttcagctggcaccgatgggcccagatgtcctccctggcagtgtctcagcaggcgcacagacgagccctgggccaggggacaaatgtgtgggttcctgacgcacgtcccccggagccctagaaaggacaccggggttctgcacccccacccgtgatgtgttgcaagaagcctcacgagtcagtaaagaaaaaccttctccctcgccctctgaaatagtaaacgttagtgagcgcattcgcatccgcagtgcttttacgtgagaagttaggttttgggagctttcggaggagctggctgtggagggaaacacgtccgtcacgtggccaccgtcccgcgggaagctgggggccgtcgctctggccgggctccccgcagccgcagtcgccgcgtcaggcggaggatccctgttatgtactttcccttttccacagtagctgctgccagcgggctgtaaactaccgtatatcactcagatttaagaacccaaactttaaaacaaattaaactcttgttgacattgtaataaaaatcagaatggaactgaacagctcagtaaaagtgaacttcaattatttttgtggatttcagattgttttctgggattcccagactcccagtgcagctgagttatttcctcttggcagaaggctggagaaaaaaggtggagggagggagggacggacggacggagggcgcctggtgggaggaagcctggtcacctggctggagggagggatggacggacagagggtgccgggcaggaggaagcgtcgtcacctggcagttcgctcggcctgaccagcagccacagggcagcggcgtgcgtgtgagggttgggtgagggggcgcatgggcaggtgttttttatgtgttttaatttaagaaaagagctcagaaatgtttgtcagagcctatctgttaattaggtgtttatgctggattaaaagaaaaatggaaagcactagtctgactgcccctcaaaaatgtgctcgaaggctcataaacgcacggagggtctgaactccctcccctctctctcggtctttctctgtatctctatccctctctctgtctctgtctctcggtctgtctctttctcagtctgtctctctgtctcccttcctccctgtctctgcccctttgtctccctccgtctctgaatctctgtccctctctccatccatctctctccgtctccctcccttcctcgctctgtttctctgtccctctctccatctctccgtccatctctctctctctccatctccctccgtgtgtctctgtctctcttatctctctccctctgtctctgcctctctgtctctctctccgtccctccctccctccctttctctctcatggcggccttttcttttgttgctgtgttcactgtgatgtctggttcttttcagctccttttctctgctggagtggacagggttgtcggtctccactgccgtgccaggtgtctgtgcttcttgcagtgtcctgtacggagaaagcggagaactagagcattggagagacccgcatggaaggaaacgccattgctgggcagtgttgcagcctccgcagaggtgtgtgggctccggggagagggacgtgctggcccctgtgcagtggcgtggcccgtgtcctttccccgccgtccacttcctgttccccttttctgcacctgtctctagctgccttcaaggcggagctttggcacccacatatgcagatgtccaccgcgcctgccggacgccagctctccaccagccggaactcaccgccacccaccctgggctgccagctcagctggggcccagccactcccccaggtcccccttcactgtaggaggagctgggcctgggatgtggacagtgggcggcgagggggttggccatgcagagggcgtgggaggagaggagagcacgcagatgccggcccggtgatgtttcctcagacgcccgcgcagtgccatgccgtgggcctcacatgcaatgctcccctgcctagaggggcacccctgctcccaggagggtctcaaagagacctgggtttcttttaagcagttttgaccactttgattaggtcagtgatctccattagatctggacctgctaaagttacagaaggttctggaaggtgccggcacagtctgagctgaacacccatgacacctgagcaggaggctgtgacaactgtcagctcacggaccagggagggaacgcgaagctggggagctctgagctccaatcccagcttctgctcctgctcagaaagccctcccactttctctgggctgacctcacctcggtgtttggaaatggaccaagacttatcggaaagtgtcctcggcgccaggtaccacactgagctcacaggctgcttccatttaaagttaaccactcttggtgcagccataaagcctcgttgatctttggtcctttattgtgaacagacatctcgaaagagcctgtgtctccacggtcaatctttcttctgaagacatattttaaggcttcttcagaaaccaaatttaggaaaacagaagaaattagtgcttagttttccagataactcatagccccccccaaggaggaaattcagacaggacagcgagcaggttcccgggccgtcacttcagggtcacctgatgggagccgcagccgtggtgaggttcgctgggtcatgcccccgtgcggaaactcagggatgggacggattccactttcaaaagatgacatagaatgagtgagtatttaggaattactttagggctaaaaaaaaaccacatatggggatcagatccctgagccctcagaaaatcggagtagggagagggagaacagttgaagcgagaagttaaataattcacgtttaaatcacaattccaggtgagatgaatgcggccctacctgatggcacctgcgtggttgccacaggcgtggtggagggctcttgcgtttggatttgaggggcttagaggtcaaaaaacttttcggaggaacagggatgggcctgtctctcttttatttcagcggtcttttctgtttatgtgggaaacgcagtgtcatgaggtttgaaaccctgaggatgagatgcattcccagttgccaggctcggtttccaagtctgctgggtttgggagcggttggttgatagaatttcttctagaagacagggtgtgggggcacccaggtccttcctgcggaggcgtccctgccctgtgtggccctgggcacagaccccggcatcccctccacggggctcctctgccggggcatcctctgccggggcatcctctgccggggcatcctctgccggggcatcttccgccggggcatcctccgccgggacatcctccaccgggggctcctccgccggggcatcctgctccggggcatcgttcgccggtcttgtcgctgcggtggaagtgtcgtgttcccagccaggctgggagtggtcgctggcgaggcctggcgtgggcccgcggtgtctgtcagggtgccctgggccagccccgctgattcgatttagagctaacgagagtccaccaacggcaattacaggaacctaatggccttcctgccgcaccgctccgtggcacccggctcgctgtgatgaattgctcattatgtgcagtgttggaatagcctccacaagattaataattggataatcaatacagaaattcaatcttggggtgtttttttcactccggggtcaatatgtcctgaagattacaaggcccgactctgcctcccccctccccgctgcttccgcgttgggagtttggccagcacctcgccacacgatgggtcatggtgcgttgtctccgtacctccgtgacttttctattctttgcaaacagcaggttctgccgggggtcagtgctgctaacacagacagcagtgactccacggtggcttccgttaagccaggggagggcggcacaggtaatggctgtgagggcaccagggccatggcacagtggcggccgtggagggaagcctcgccgtgcccaggatgtacgtagcctgagctgtggaggggtggagggcaggttcaagaggggctgtgcctcccgccaggacacgtctgcgcccctgagctcctgaggcagtcagggcctggatttccctcccagaggtgctcccctggctgcagcatggggagctgcctgcgtggtttcgaggctctcagtggggggccagccggtgaggcactgagctggcccgaggagagctgctgaagctcaggacgtgcagtggagctgggagatgtggatggacttgctgcgggtccgggacctgcctagggagttggcaggattcggggcttctgggggaggccaggaacagagggcggcacgggcctggggagagcaggaagctgtgtgctggctctcaggagcccagtggatgggacgcagctgagacgtccgcagccatcccaggatgcgcaggtggcgggagcacgcggggcacaggagcctgtcccggcaatggctccttgtctccggcccaagcgacccctggcatggcggacagagaggcccaggaggagccggcctcagggaggatggcttgaggagacaagccccaggacgcagcctgaccccaggacacggcctcgccccaggacacggcctcaccccaggacacggcctcgccccaggacactggcgagtgtttggactttgttgaaactgcgccacaggcactgccctgggaggtaaataaacggaaaagcgtctgactgcagcaaaatcctggcaccacctggcactaggacctctcccaccacgtggagtttagactaaggcttagggattttatgagaacggcagccactccgccacacccacacaccccgaacttttgctttgccttgaatttttctagacagcctcccaaggaggagaagcaaccctggctaggaaccggagccggagcagcatctgtggctccacgaggtcagagccttggcagttgtgcggctgtggactcacacatgtggcaggaggagatgcctgcagtcggcgggccccttgtgcttcccgtttgctgagctgcggtctctccagtcggtgggccccgtgtgcctcccccgtttgctgagccgtggtctgtccacctggatgcggcacctgtgccctctgctgcgctctgggctgtggctgccgtttgaacagtggagcctgcacacgtgagccacgtctcatcccactcgagctctcagcccctgtatgtgtcagggaggtcctgagggcgccttctccacgtgctgcggggaggcgcgctgacggccaccaagtccactggaagaaatagccttcccgtgtgaatgtggggtgctgcctgcagggacgtcctgaccgtaggtccgcaccccacccacaccaaatcgccttccgtacccacctggctcatgtgcctataagatgggagagggcctggcagagaatttcgctagagacgcagggagttgtatctgccatgtttttaaagagcgctttaaaaacggtatcactttcgaacgctcggctctcaataaaaaggagcactgccagtattttaattcctctctcgatacccagaaccaccaccaggctgtgtcaactcccgtcggcgtagagcagctgatgcccgcgggtggactccgggttcagggcactgggaccgctgcagagacgccgtccccggcccccacctgtagggtctgcagggagatgacctgcttcccgtggcggagggcaccttggcctccgcggccagggtgtgaggctcccgggtcagcacacggctttctcaaggaccaggcttgaggatctttcccttttctgctcttccacccgcctcccacccaccttcccagatacccgcgtcatcccccgaggcttctgaggactctgggctgtccccaaacctcaaacaaaatgtcactttaaaaactggtacaaaagcacctcttaaagattcaaacgataattcgaaaacatcgtggtggtgagggacacgtgctttcccgccggcgggggcgtggacgtcgtctttcgtgggcagccctagagaagtactcttcaaggcgagtgtgcctggggcatgggggccgtttcccttgcagctagctcccggtctcctccctctgacccagggctccccagacattactggggctgcatctgccgggggtgtgtggcctgtgtgctgccgagctccaggtgacacccacggtggttcgtggacactcaccatgaggggaggtgcgtggcgtggtgaagcctgagggtacactggctgtgccatgtgcatgcccacgtccaggacgggccactgtggagcccatggatcctttgtctccctgtgtgctagcctctgtcccttctcggggacgtgtccccacctgagctggccgctcactgtgcttcaggctcctgtgaaggccgtgctgatctccacggtgagcgtggacgtgcgtggggcagagtgagcggagtggcaggttcctccaggcgctgcccaggttcagctgtgagccggtccaggtgtggccgcagggattggcgttcccatctagttgtcattgctgagatgtttaaaaatcacaccctcagccagcacagtggctcacacctgtgatccaagcactttgggaggccaaggcaggaggattggtgagccaggagttggagaccaccctggggcaacatagcaagaccccatctctacaaaaattttagaaattagccaggtgtggtggtgcacacctgtggtcccagctacttgagaggctgacgtgggaagatcacatgagcccaggagttccagaccagcttgggcaacatggtgaaatcccacctctaccaaaaatacaaaaattagccaggtgtgttggcgctcaggagctgctcaggaggcagaggagaaaggatcgcataagcctgggagatcaaggctgcagtgagctgtgatcgaaccactgcatctccagccagtgacagaatgagaccctgcctcaaaaaaaaaaaaaaaaaaaaaaaaaaaccaatctcactccccacccccaccaccctggcatgcctccgaagcaggtgtcttttttaaatggccgttttcttacatagccacagtgcaactttcacacctaacaaaatggcagattctctggtaagaggaagatttagttgaaagtcacattttagtaaggcaggtttggggctgggtacagtggctcacacctataatcctagcatgttgggaggctgaggcaagaggatcacttgagcccaggagttggagaccagcctgggcaacatagcaagaccctgtctctatacaatttaaaaattagccaggcatggtagcatgcacctgtggtcccacctacttgagagtctgaggagggagtattgcttgaacctgggaggtcgaggctgcagtgagctgagatcattccactgcacaccagcctgggcaacagacagagcaagacgctgattctaaaaataaaatgcaggccaggcacagtggctcacacctgtaatcccagcactttgggaggcaacggcgggcagatcactgtagctcgggagtttgagaccagcgtggccaacatggcgaaaccccatctctactaaaaatacaaaaattagctgggtgtggtggcaggttcctgtaatcccagctactcaggaggctgaggcaggagaatcgcttgaacctggaaggttgcagtgagcagagatcgcgccactgcactcctgcctgggtgacagagcaagactccatctcaaaaaaaaaaaaaaaaaaaagaaggaaggcaagtttcccatcccacaggagtggtggtctccagccacctcctttgggagtccctggcccacaggatacctgcagtggtggtggtgggtgggtggtggtggtggatgggggctcggagggggctcggctcacacccctgcagcctggccggggaccaggggcgtattggcttctgagttgccaatggagcttttgacctcctgctgctacacacttcacatggtgacattctatcctgaccctctctgccaccctacaaagaaggaggccgcctgatcagtgccagttcacaccaagtgcccgtctccccctggaacaggcagaggaagaatcgtgtttctgtagcagagggacaggaggaagcgggacctaccgagacccaacccggtcactctcctcggggtccattcactttatcttcattaaaaggagctttaacatttttattttttaaattctgttaattctgtttgaaatggaatttcataatttgggggcatatacttcctagtagaacaaagaaagccctggaaaactgcaagtggtggtttaatgatcccagtgagtgactggaatggcagtttggtgcagataagacggactagatccgtggaaacacgcgcccgcatgccgtctcggtggggggcggaaggacagcctgtcggaatctcccaggcacgtggtcctgtaccctgaaccctggcagtttccacacggcgtttgcattctgtgcaacattcaggctaaataaggaagcaggcagttaaggtaggaaaattattctgtcttaatggctgacgtcccgagtggcggtcccgctccccaccaccagctgcgtccagatgaggggcttgttttatgaaaactgtgacttgtcaggccgtccctccgttgtcccgtcctctccttccaaaaatagcaggccctgtggcggtggcttattgcgatgaaaaagataaaaataagtgaaggctgaaataggtcctggacttgagaacttactttttaatgaaacttgagaagctgttattttccactgctttacaaagcatctttgaaaaatgcagaatcgtaaagaagggttctagagacgctgcgaccctgcgttttcagaatgtggtggctcctcgactgtggagtggcagaaccgcccttgttcttaccccgtttctcagccgagcgccgggcgcccagcagtgtcggacagtttagggtggaccgaggaggccgtggtggaggcttcatgtaggaggttatggaaaatccagatatttgcttgtgaaggaggaaacatttatggtagactttctaagaggttgcttcttctcaaaaaattaaaaaacccacatgagaggcggcctcttcagttaccttggcgcacacaccgaagccacctctgcatcagacacgatatacgtacagtggaacaaaagcgttttcctcttcgcttcctattttctgatctctaatttgtggctttaaccatatttttatgtacttagctcatatctactgtaataccttaaatgagagccatacaagtctaaatgtgtatgtcagatggaaaaattgaaagctgtgtattcagcaattcaatgaaaccataaaacagtcagtaaacacatctatcatgcccctttgtaatgaacgccacagccatgaaaatccatatgttcattaaggttttcaaccaccatcaaatggcgttcttactccaagaattattagatattgtcaaagctgagtacagcaaatgtcattgggagacatcttagaagttagttatttaagaataggatttggcctgagatatttctggttctatctgtgtcctacccaaattattaccctcttaggttacaagactaactttagctaaaggtgtattttctgggaaggttagcaaatactttttataattatctcttagttataggaatggaggagaatgtctttcctgttttgttttgctctttttaaaaagttatttttgatgacttgtcctctgaagaatatgcacttttctgtccctcagaggatggtggagtaagctggggacaattgcgttcctgctgcaggtttaattacgctgtgtccagtgggacggtgggccttagaagggagcctgctggacggaaagtgaggcggatggggacgctgcgacaggaagaggcaataggaacatgcccccgtaggccgtgggtggcatcacgacggccttttttgtttcctgtattgctttagtgtaaaggaaaatgacaactctaaagaaggagcagtcctgcaggacgttctgatgtctgataattctgaggcctgtgtccttgccaaactgtctggtttgtttagcggtcatagataaatactcttagacttgaataatcatagcacaattggttgttgattggaactaacataaccattgaaaaagagggaagatgcttttaaatgtgttttgtgcaattaagttagtggtacctatatgaacaaatatgctttttaaaaattgacacaaaaatcgtttatgcaagttatagtcttcatctgtgctacttaaactttttaactgcaaggattaaacagtgtatttgggttagcgtggctgaaccacattgtttattctttaagcccaaatccagttcctaaaaacaattctagcgctgcctctcccggctcttcactgcacgcagcctgagggcgtcgttgtctgtgctgcaccctggtgctcagtgggtctccagctggcacagtcaccaccactcccagatgggctctgccagggacagggatggagcagactgcatgggcctggcgtgcaggtgaccaggtagaggcagctcagctgtgtctgaacagcttttcccatcgctttcccggtcgacattcatggcagccgctgcgtccaatgacaggcacagtcaattctttgagacagaaagggaaggacaacactaatgtccccatgaaccccagaaacatgaaggaggggcacacgcccacagtagaacatgtggaagctgagtgtggcagtgtaaagggcgatggagcccccgggcccagcatgtttcgcgctgcctgcttgtgttctgatgggcggtaactgaaggtccaccaggaagtgcctggcaccccccctctcgctcgtgaaagatgcagatcagagcacctgagagggtgtccttgacaagtgttttgtcacatcgttcagccatatagaaaacagacttggaaaaatctgagatcccccaaggagccaccgctcattgcccagggcgtggcccacagcaaggctgctcctgcccccgctactcaccgcagtgtgaggatgggctgacctgaccgcccagtcctgtcttcaaaacgagactaagggtagcacccagctccaaggagagctgtgccgggtgctctggaggggtgttaggacccctggcacccggtgtccctcagtggacggccgttgattctgtaacaaggcggccagtgcccacggtgcaggcaggaggcaccttatccctgacttgggctccgatccaggaggaagttgtttctccgtgtgagatgctgaagagtccgcccattcacagagcagaacggggtctcagtcaaacctcttcccacagattagcccccaggatgtgtcctgagccctgcaggactgggcagaaggtgaggatgggcccttccaggctcccttttgctaaaccttgttctaccagagcgttcaggtgcaaagacctcgcctcagaaaggcttcagagcctccggcggctggcaggctgctcacagatctccgaaccatggtttgaacaaggcagcaggaaagtgggagaattttagtctgagaagatttggaaaatccttaggaattgctgacttccaagttgtttcactaccatctgaaaaacccttacaaggctcgggctttcctggaaaacaggagatcaggctatttattttttatttttttattttttttcctgagacagggtcttgctctgtcacccaggctggaatgcagtggtacaatctcagctcactgcagcctcaacctcctgggctcaagccatcctcccacctcagcctcccaagtagctgggaccacaggtgcacaccaccatgtctggctaatttttacatttgtttgtagagatggggggtggtctcactacattgcccaggctggtcttgaacttttggcctcaagtgatcctcccgccttggcttcccaaagtgctgggattacaggtgtgagccaccatgcctggtcttaggtcagtttttaaaacaacagcaagattttttttatgttgtttctgccatgttttaggaattgcttttcctcccggggcttgcatgtttaaatttttattctcagaacgttgaagggacgcactgcatttcaggatcctgggtctccgtccgtgaaggactttccttctgtgggtctttcctcttgcagcttaaagtgggattattttcactttattcagaggccctgttagtcacagccaagcacagacgtgctcgctgtcgctcctttgctggagtcggaagtaggacagttggtgataaagtcctggacgggcgagataagtggcattggcagagctctgttgtccagacagcaagaaaccggctgcccccaggaagcggggatggagggcacacaccaggagagggggcgttttgaccgtcggcaggggtgccacttggaagtcagatttaaaatggaatcaaaactggtagaatgagggtctgcagggggaaacttgacggagcccatcaggcgacagccttctcgaagcccctccgggcccctcacgggaggggatcccccgctgcgctgccgggaggtccggacgaaatgttggagctggagagtcggcagccctcgcgtggcgttgctgcctctgcagatgcctccggagggactcggtgtgtctcggtgttgatttcagaacaggggagatgctgacgtgtcccggtggctctcacagcacagtggaaggcgagtggcagctccgacatcctgctccgctggcgcctctggccacctgcctcccccacccccacataaaaaaagtttaaggcacatttaagctagtaccggagaaatgactgaaaaataagtatagccaagcagcagaagactctgtgtgtgggggggggagggtgcatccaccactaatgtgtgtccgtgtgtgtgggggcatccgctgatgtgtgtgtctgtgtgtgtgtggggggggcatccactgatgtgtgtgtctgtgtgtcggggggggcatccactgatgtgtgtgtctgtgtgtggttggggggcatccactgatatgtgtgtgtggggggggggcatccactgatgtgtgtgtctgtgtgtgtaggaggggagcatccactgatgtgtgtgtgtgtgggggggcatccactgatgtgtgtgtctgtgtgtgggggggggcatccactgatgtgtgtgtctgtgtatgtgtggggggggcatccactggtgtgtgtgtctgtgtgtgtgtaggaggggagcatccactggtgtgtgtgtgggagggagcatccactgatgtgtgtgtctgtgtgtgggggggcatccgctgatgtgtgtgtctgtgtgtgtgggggggggcatccactgatatgtgtgtctgtgtatgggggtgggagcatccactgatgtgtgtccatgtgtgtgtgggggcatccgctgatgtgtgtgtctgtgtgtgtgtggggggcgtctgctgatgtgtgtgtctgtgtgtgtgtgtagggggggagcatccactgatgtgtgtccatgtgtgtgtgggggcatcagctgatatgtgtgtctgtgtgtggggggtggagcatccactgatgtgtgtccatgtgtgtgtgggggcatccgctgatgtgtgtgtctgtgtgtgtgggggggggcgtctcctgatgtgtgtgtctgtgtgtgtgtgtgtagggggggagcatccactgatgtgtgtgtgtgtggggagcatccactgatgtgtgtgtctgtgtgtgtgtggggggcatccactgatgtgtgtgtctgtgtgtgtgtggggagcatccactgatgtgtatgtgtgtgtgtggggggcatccactgatgtgtgtgtctgtgtgtgtgtggggagcatccactgatgtgtatgtgtgtgtgggggggcatccactgatgtgtgtgtctgtgtgtgtggggggagcatccgctgatgtgtatgtctgtgtgtgtgggggggggggcatccgctgatgtgtgtgtctgtgtgtgtgggggggggggcgtctgctgatgtgtgtgtgtgtgtgtggggagcatccactgatgtgtgtgtctgtgtgtgtgtggggtgcatccacagatgtgtgtgtctgtgtgtgtgtggggagcatccactgatgtgtatgtgtgtggggggggcatccactgatgtgtgtgtctgtgtgtgtggggggagcatccgctgatgtgtatgtctgtgtgtgggggggggggggcatccgctgatgtgtgtgtctgtgtgtgtgggggggggggcgtctgctgatgtgtgtgtctgtgtgtgtggggggggcatccactgatgtgtatgtctgtgtgtgtgggggcgtctgctgatgtgtgtgttttgtgtgtgggaggttgtctgctgtgtgtggggagggggcatctgctgatatgtgtgtctgtgcatgtgtgggggggcgtctgctgatgtgtgtgttttgtgtgtggggagggggcgtccactgatgtgtgtgtctgttggggggggccgtctgctgatgtgtgttttgttttgtgtatggggagggggtgtccactgatgtttgtgtctgtgtgtgtgtgggggggtatctgctgatgcgttttgtgtgtgtgggggggggtgtccactgatgtgtgtgtctgggtgtagggggggtggcatctgctgatgtgtgtgttttgtgtgtagaggggtgcgtctactgatgtctgggtgtaggggctggcgcctgctgatgtgtgtgttttgtgtgtggtggggggtgtccactgatgtttgtgtctctgtgtgtgtgggggggggtgcgtccacggattgtgtctgggtggggggacgtctgctggtgtgtgtgttttgtgtgtgtgttgggggggtgcgtctactgatgtctgtgtgtggagggtatctgctgatgtgttttgtgtggggggggtgcgtccactgatgtgtgtgtctgtggggggtgtctgctgatgtgtgtgttttgcttgtgttaaaaggcgcacaccgcaggaaaggaaagtggcagtaaacacccccgcccccagccttccctcacctcagatacgccaagttccgggcactgagcaccctgcaggtgaaacagggaggaccagagagggaagggacgggggccagatttggaggagagaggacggactcctggggccaggagctggctgggcagggtgggaaccctcctgtcccagggtctgagtcgtcccccaggcaccagccagtaggcccatccagctttccatgactttcctagtaagtactgaaagaaaaaacacacatctaacactgtggcttgcccagcggggccccaggccgccatctgggaggatctgggggcaggtggctgttcagggcccagcagagccggctgagctcagaccccagtaagggtcagtcctgccctgtcagctctggggtccctggcagccattcccactctccgagccctccgtggtccctgtgaacagactgggtgactacagtacctgcctttgccgctcccggggctgttgcaaggagcaagcaggtgcacaaagggccaggcagggctgcataactgctggggaaatggtagtttgttcattccttaaaatgtaagatccttaattgctttcagaaaccgggcattcagaaatgcagaaaaatgttgcttccaagccaggcagcaagggggcaaaatatatcaaacagcgttcaggccctggcagctccgttctggccctcatcattcccagcatagagaaacaaaactcctgcgtgaaacttaagaggtgaactttgggtagctcactacagggtgaagtttaaatgtcaactttctttcaaaatgatgatcaaaaagaagaaactggttatgtgaaggtacgaatacttgactgagaaaggcgtctcgcctacggcttgtttacgcacagctagtgagagcttgcgtggccccagcaagggcacagataagattcacaggtgaggcagtgaaagccatgcctgcccttgtacttggtagtttttatatttaaaaatgtactgatttcctccttcactcaattccagatgtgtatagagaggtgggtatgagtgtgggtgtgtggatgtggcctcgagggaggctctcagcctgcagccaggattcaaaacgccacagtcgagttttaggaaaaaacaatagtttccacctgaggagtattttagagaaaaatctaatataagggaaaaaaaagccctccttattaaattaaattgtggtataacagctcaccacatcctgttgcggggacatctgacgttaggcaaagtaagtttcctctttcaggtctcccacacgccgtgagggtcacatgctacctgcaattcaaaatatgctaggaagggaaaaaaccctttgtgtctgtggaaaagctgaataagaagatggaaattatcagcagagagagctggtatgggaaaccgtaggtgtcatcggcaaccataccctacccaaggaagccgcccccggaatagcaagggcagggccgggcagctgtggctgacctcatgggtcagaagtgctcgtggcgggaaggagttggggggtgggggggcggtcctgtctttcagcccagcgccagcgagccacatggcctcagaccaaccccaggatgggcccgttgtccacctgtgaaaggggaagccgtggctttcctctcagggctacggcacaggccgtgtctgcggggcgagcacggctccacgtacggctctcgtccgcggtgtggatgggtgggcggtacagcctcctctgcggttcggttgctgtgctgtcctctgctgagtggtgtcagggttgtccatcccgctctctgtcagctgctgccatggggcagcgggaaggccctggagggtgcctgggctgtgtctggtcccggccacgcgtccctgcagcgtctgagaccttgtggaacacacttgacccggcgctgggacggggtcggcccacacgcaccgccagcccgcaggagtgaggtgcaggctgccgctggctccttaggcctcgacagctctcttgaggtcggccctcctcccctcccgagagctcagcagccgcagacccaggcagagagagcaaaggaggctgtggtggcccccgacgggaacctgggtggccgggggacacaccgaggaactttccgccccccgacgggctctcccaccgaggctcaggtgctcgtgggcagcaaggggaagccccatggccatgccgcttccctttcaccctcagcgacgcgccctcctgtgcccgcggggaacaagacggctctcggcggccatgcaggcggcctgtcccacgaacacgatggagacctcagacgccgtccccaccctgtcactgtcaccatcacccatcctgtcccctcacgcctccccacatcccatcattactacccctcaggcctccccacgtcccaccgtcgttacccctcagtcctccccacgtcccaccgtcgttacccctcaggcctccccacgtcccaccgtcgttacccctcagtcctccccacgtcccaccgtcgttacccctcagtcctccccacgtcccaccgtcgttacccctcagtcctccccacgtcccaccgtcgttacccctcagtcctccccacgtcccaccgttgttacccctcaggcctccccacgtcccaccgtcgttacccctcagtcctccccacgtcccaccgtcgttacctctcaggcctccctcctgtccctgtcgctgttacccttcagggtccactcatggcttcattatttctttgtagtgtccccacctttcccctgtgttgatcatttaggcctctttcgtccccacaatcactattctgactggagtcctttcttttggagctccgctggccagggttggatgaggacctgagcccagtctcttcatgcattgggcagcctcccttcccccacaggtggggcctgttctgagctacctgaacccccaccgtgtcttcctcctgggcaggtggctcctcctgcctctttgcagacgtcttttgtagcaaggctgaaccagcgcagtgggaaaggagttaactggtctcgaattctggggcatccctgtctcgtgccacagatgccaagcacagcagggcacggagctcctgggggccgctgcactcagcagcacagtgggcgggaggccgctgagcaaccagcagcctagggcatttgggtggggacgtgcgacccccacacagaacagagccgtctttctctctgcgttgtgccgaggccccgcagcgccgcccgagtgtcacggaaagtgcctctggtgaggagctgccgtgcgcactctgggacaagtcaggtcctgcgtgccagtccgggagcagcctgcgagcacctgggccctgtcgttatcctccttagtgtttgtgaagagtcacacggaggggcgggagcccgggctccttctggtgccttccacactgggggcggagccctctgcagagagcctggctctgcgtcctgtggctgagtgccaggtcccgtcttgggcagggcccaggatcagcgtggctctgagcagggcctgcggggagcccacgcgtgcctgtgtctttacagaggctgagctcccacacgggacagagtcgggaccttctgtgggcgccatgtcaggaggtgctgctggcggggccgggcatgtggggcacctttgcttgcctgggtctctggccccgcagagccttgggcgagccagcctcgggtgtgtgtttgcagccagggttcctcctggagctcagtgccagtgtgtcctgttatcagttcccatgacacaattcctggttctccatctgtgttttattattgttattcttaaaaatagtcgggggttgttgaaagggaatttggggaagggagtggggtgatgaaatgcacactactaattgctccaggaagccgccctgagacaggccggggcctttgcagaaacacgtggggcttatctgggctctgggcgctccagcccatggcagagggaagcccgggcagttccgtgacgtcagcgcacgccccaccagaacctgggagggagatgggacgtggcgacagtgctggtggcacatcccctatctcagcgcccatcagggcggccacagcaggaggtgggtggggcggggatgcatgcagctcacaaaggccctaacagtgccgctcgtttcctctgcgtctgccagaagtcacaggtgacggggaacgtcactggcctgtgggggactcagggactctgccatccaaagggaaataaaaatcaggaagagcctgagagggaggctcaggcgacactggtgctgacaccacagaagtgctggtgtggacctgtgggtcgcttggttcgtggagagacagccacagcatcttcccagcatcgcggccggcacctggcacctgcactttggccgtcagagacgtgctggtaccgtgctacggacgagggcggtcactctggcgaccccagctctctgccgaggcagccaggcactggctcacgacactcatggaccagggtgggaccgaggaggaaatgtgggttcctggggagatgccttgtcacaggcgtgagcgtcactgatggagaagcagggctgggggcgttgctttgatgtttatggtatttctctaatactttctcaatttttcttttcttacagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcgcagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggacaggcgtagtctgcgagtggttcatgatacgcgtggaagatgccgctttgttctcagagtgtgttttcagtggcgtgtacttggatcgtctgtgaaatgaacctcgtgttgggaaggctgtgtagacgcggccattcgccgttggaagggcatcttgccagtagagctgttccctttcttctatgtttaggtaaaaacctgccgtagaaatttgcgagacgccggatagttcccaggccctgtaactgaagcagctcagaaatgttcatccgggcgaggtggagaaggaactcctgctagtgccaaatgtttttgctcagaggaatatcctgggtgaggctctggccacacacacagtcacacgccatttgacaatcatctggcgaggaaacgtgtggaaacccacaggttctcaccgtctctccccgcttcttaaagctgctcttccccttttccccaccaaagctccctacttcacgtttgggtgggaaaatattacctggccatgagttaaaatatgaaacttggaacttctacagtaattattgttctcatctttcaggaacatttttcatttaggactttataaaatgcaagaattctgatttcttttgctcagaggtgtacag

SEQ ID NO: 12566 - DNA, 37966 bp, Human
  misc_feature (1)...(37966): n = A,T,C or G
ttaccaatgacggaaaacaaagtcctaattgcggcttcgacgatctcgagacgctgatagtaatgtagtgggctgttcttccgcgtgtggctaaagtacttcagcgggtacttcactgaccaacacagcccaatgatcaggaagaaactccctggaagcgcgtggcccttgaaatttgccatcaggacacctaaaaaattaggggaaggctgttaggtggctaatgaagcaagcaaacaaatgtatattttggcaggaaacacaatacgtgcctgagattgcaaatcataagccacgttaagaaggatcaacacattctcataaaacaagccttatgttacgtcactgaagtctcatctgtaaagtgagttgcataaccaactggactccactgtctgtaatgctttaaacatgtgggtaaaataaaaggatgagggtggggaaagaggaggataggtaatatttattgatctcagatagagaaaacttccaagccataaacataaaggggggaactagaaaagaaaaacgttcagctatataagcatcttttaatatcaagaacatcaaaaggtaaacaacaaatcagaaacatgcttgtagcagttggctattacattagagtctttacaaattgataagaaaaagaccgtagaagaataggcagaagacatgaacggatgattcacaaaataatacaaacaaattataaatctcccggaaattagagatgggcaaacgaaagcacaacatcatttttcacccaactggaaaataattttataaagttttggtgtggtggtctagtacaaatgaacctggtcaatatgattcacagtttgtaaaaatcagcataacgatgtaaacatcaccttattccaaaaattttcaggcatgatttgctgttatcccatttgcagtagcatgaaactatagctaggatttattcagaagtagattgattattttccccactggcctgggtggttacctaaagaatatgtagggtgggagaaaaataccagttgttggtgattgctgtggtttgaatgtgtcccctccaaaatccaggtgttgccaaggtgatagcattaagagaaggggacttttttttttttttttttttttgaggcagagtttcactctgtcacccaggctggagtgcagtggcacgatcttggctcactacaacctctgcctcccaggttcaagcgattctcctgcctcagcctcccgagtagctggaattacaggcacccgccaccacgcctggctaatttttatatttttagtagagacggggtttcaccatgttggccaggcttttctcgaactcctgaccttaggtgatctgcccacctcggcctcccaaagtgctgggattacaggtgtgagccaccacacccggccgagaagaggacttttaagaagggactaggccatgagggcccctccctcctgaactaggagcagatgccctccctcatacaggggttggctggagggagctggtcccctgtttgtcctcctgcatgtgaggatgcagccctcagcagacaccagatgctgctgccttgatcttggacttcccagctttcagaacagtgagaaataaattgttgttctttataaattacccagtctgcgtattgtgtgatatcagcacaacagggactaagacagaaattggtaccagaggagtttataacatttataaccaggggttataacaaatatgtaaaaatgtgggggtggctttggaactggataatgaatacaagctggaacagctttgaagtgagtgctgaaaaaagcctggattgccatgaacggagcactaaggatgattctggtgagggctcagaagaagaggagagctgtagatgtgggatatgagctgtggggaaagcctcgttcttagagattgcctaagtggtcatgaacagaatgttgatagagataccgatggtgaaggcaattctgatgaggtctcagacagaaataaagaacaaggtattggaaactagaagaaaggttatccttgttagaaagtggtaaagaacttacctgaattatgtcgtttcctaggacttcatggagggcagaacttaagaatgatgacctaggatatttggcagaagagatagaaagcaaagtgttcaggatgctgtgtggcttctcttaactgcttatagaaaaacatgagaggccaggtgcggtggctcacgcctgtaatcccagcactttgggagggcgaggcaggcagatcacctgaggtcaggagttcgagataagcctgacaaacatggtgaaaccctgtctctactaaacataaaaaaattagccgggcgcggtggcaggagcctgtagtcccagctactcgggagactgaggcaggagaatcgcttgaacccgggagagggaggttgcagtgagccgagatcgcgccattgcactccagcctgggtgacaaaagcaaaactccatctcaaaaacaacaacaacatcaacaaaaaaaaaaacgtgagaaaagagaaataatttgaaggcagaatttaccatcaaaaggaaagctaaaggtcaatatctgaaaaattctcagcctagccatgaaaaagagaaaaacgtgtgtgtaggagagaaaaccacgggtatggccacaggaccgataagcaggttagtatgtgtagaaggaagccaggtgctagttatcaagagaacgggaaaatgaccccaaaggcatttcggaaaatgactccaaagccatttcggagaatgaccccaaaggcatttggggctgccttgctcattagaggcccagagggttagagccttgcggcagaacagtttcaggggaagggcccaggcgcctgcggggtctcagagatcactgcctagggccacctcaggtctctgctccccacatttccagcagagcattcctccgtcaccctagctgtggctcaagcaggaccaggtgcaggttgggccactgctccagagggcgcaagttataaatcttggtggcatccatgtggtgctgactctgtaggtatgcatactgtatgagctgtgggagcacggccgcctccacctcgatggaaaggatttctttgacctcagggcccgagcagagatttgtcaccggggtggagccactgcagagagcccccagtaggccaatacttagggaagccttggaggtggtatcacctggagccttgggggcccaacacccaccccagtgtgttcagaaggtgagatatggagtcagataatattattctcaagcctaagatctaatgttgagttttggactcacttgagacctgttgttactcctttcttccttcctgtttctcccttttggactagaaacatctgtcctgtgcctgtcacgccattgtatttgaatcaaagtacgcaactcatttgaattcacaggctcacagctggagagaaatttgcctcaggatgaaatttatctcaaagtgaatgagtctctctcacacctgacttagataagattctggacttagattttaaagttcatgttggaatgatttaaggcttttgagggcaattgtggtggaatgaatgtattttgtttgtgagaagtacgtgaattctggggggccaggattggaatgctatggtgtgaatgggtcccctccaaaattcaggtgttgccggtgtgatagtattagatgtggggcctttaagagctgattaagccatgaaggttcctcccttgtggatgggattaagcacccttataaagggctgaatggagggagttgcttcccttttttgccctttctgccatgtgaggctacagccttcaacagacaccacataccagtgccttgatattggacctccaaaccttcagaactgtgagaaataaatttgttctttataagttacccagtctgtggtattttgttgtagcagcacaagcagactgagacagtgatctagaaaagaccaccccggaatgtaaagcattcctggtctgcacagcatattccaaccctggacacaggcccgtccctctagcaccagctacattgtcagggctgtttcacatcttacacattgacagatgagggtcccacccatcatcaagaacttcataagccctctccctctccctctctttccacggtctccctttcatgccgagccgaagctggactgtgctgctgccatctcggctcactgcaacctccctgcctgattctcctgcctcagcctgccgagtgcctgcgattgcaggcccgcgccgccacgcctgacgggttttcgtatttttttggtggagacggggtttcgctgtgttggccgggctggtctccagctcctgaccgcgagtgatccgccagccttggcctcccgaggtgccgggattgcagacggagtctcgttcactcagtgctcaatggtgcccaggccggagtgcagtggcgtgatctcggctacaacctccacctcccagctgcctgccttggcctcccaaagtgccgagattgcagcctctgcccagccgctaccccgtctgggaagtgaggagtgtctctgcctggccgcccatcgtctgggatgtgaggagcccctctgcctggctgcccagtctggaaagtgaggagcttctctgcccggccgccatcccatctaggaagtgaggagcgtctctgcccggccgcccctactgggaagtgaggagcccctctgcccggccaccaccaccccatctgggaggtgtacccaacagctcattgagaacgggccatgatgacaatggcggttttgtggaatagaaaagggggaaaggtggggaaaagattgagaaatcggatggttgctgtgtctgtgtagaaagaagtagacatgggagacttttcattttgttctgtactaagaaaaattgtgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacacacactctgcctaggaaaaccagagacctttgttcacttgtttatctgctgaccttccctccactattgtcctgtgaccctgccaaatccccctctgcgagaaacacccaagaatgatcaataaaaaaaaataaaaaaaaataacttcataagcttttaaaaaaatgcttacagttttcagaaaatcaactcgtatgaaagacttatagtgaaaagcaacagcctcatgttctgtccctcctcacccccagcaaagccactttcaaccctttcagctgtttcctccggtatttacctccaccattgtagttaatgggtgggtgcaaacgtaatggcaaaaaccacaattacttttgcaccaacctaatgctttgtgcatgtggtcatttgttaatccatcattgtcaggcatcacctaccaacttcctggagctctctcacagcctctccctcttccccaccctgctattttcatagcagttgcattatactcgtttgttgaaatcattagtttcattatcatggctctgtaaatccaaagtccttaccagggccaataaggccatatacgatcctgagccatctctttgatttctcccagcactcatcccctgccacactggatcccttccattcccttaaatggctgagaacactccattcctgcttcaggacattgcactgtctgtggcttctagaacagtgttcccacaggcagccaacagttgtctccttcactttactcaggtctctgttcaaatgccactttattccgtgactcctgcatgtacaatagaggcctgccccacttttcaatctatgtagacttgtaacttttctgtaaagtatgaatcaccatctgatattgcagactgatttttttttaagcatctgtcatcatccactaaaatgtgggcctctggaaagcagagatttgatctatttgcttattgtggttagtccacagcttaccgcagggccagacacagagtgagcactcagtaaatacttgtggaatgaatgaatgcagatccaagtagtgtattatgggttatgttttctctaacacttttttttttttttgagaaagagtcttgctctgtcgcccaggctggagtgcagtggcatgatctctgctcactgcaacttccacctatgtgttcaagcgattctcctgcctcagcctcctgagtagctggaatgaaggatggtgccaccacgcctggctaatttttgtatttttagtagagacagggtttcaccatgttgaccaggctggtcttgaattcttgacctcaggtgatccacctgccttgacctcccaacatgctgggattacaggcgtgagccaccgcacctggcctaacacttttgttttattctggggttaataattgcattgtttttttacttgtttatcttcccaaatactgatcactatgtttttcctccaaagggctaaaagatctgtcaaatgttgaccaaattaaattctagacattttaacctcagataacttatttctgttttattcctagagacctgttttgagaatattctctttaaaattgaactggctgtctgtcctcctggggcattctgcaccatcttacaaattccctttgcctttttcttgttttccacccaccctaccttttgctgcagcttccagaagaggcttttccttgttttggatcccctgtttcttggatgccatttatttttctttcttggcttatttccattaatataagtctagcattcccaaaactatgcataaaagggaaattccttgagaatttgcatagttgacaatctctgcctttttattgggacggtttatttagtccattcatattaatgtaattattggtgtggttatatttatagttgtcattttgctatttgttttctgtcactcatgcatttttttgttcctccgtgcctcatttcctgctgtcatttatgtctaacaagtaattttagtataccattttaattacttttttcatattttaagctatatatatttttttcctactgcatgctctagtctagggattatagtatgcatcttgaagttaccatggtctattttaatagtaacttaattctgataaaatatagtgactttgttccaatatataatagctctatttcctaccccttccttcatgcatacacacacacacacacacacacacacacacatctataatagctctatttcctaccccttccttcatgcatacacacacacacacacacacacacacatacacacacacaaaataagccattaatatatatgaatggactaaataagccactctaataaacaggcagagacgtgtgcgtgtgtgtgtacacatatatgtacatatcatatttatgtttgggcttgttataaagtttttaagatttaagaatatataaagtctaggttataaactaatggtgtggcaattatttcttgaagcaattttacatttttcaaagcatgaatatatatatattctttgatatttaatcacatatttaccatttccagcgttcttcatttctttctgtccattttaataactctaaaacctcattttctttcgacctgaaggatgtcctttaatattttttcagctttattgcggtataattgacaaataaaaattgtatatactcagggtatataacatgatgatttgatatatgtatacattgtgaaatgattggtatgatcaagctaattaacagagttatcaccttacctggtaccctttcctttcctttgtaatgagaatccttaagatctactctcttagcaaatgtcaaatataaggtttattattattactattatttttagagacagggtctcgccctatcaccgagggtggagtgcagtggcataatcatagttcactgcagccctgaacttcttgggctcaagtgatcctccgcctcagcctcataagtagttaggactacaggtgcaggccaccacgcctggccaatttaaaaaattttttgtagagacaacgtctcgctatgttgcccaggctggtcttgaatgtttgggttcaggctattctctcgcctcaaactcccaaggtgctgcgattacagacataagccactgtgcctggccagtatattattattaatgatagtcaccctcctgtacattaggtctccaaaatttactcataactgcaagtttgtaccctttgaccaatatctccccatttcccccactgctccagaaccctggtaacaggtattctattctgtttatatccagtttgattattttagattccacatataagtgagatcacacagcattttttctgtgtctggcttatttcccttagtataaggtcttcaaggttcatccatgttgttgcaaatagcaggatttccttcttttttaaggctgaataatatcccattctatatatatatacaccacattttttttgtccattcatcaatcagtgaacacttagattgtttccatatcttggctattgcaaacaaagctgcagtgaccatgggagggcagatatcttttcaagatagggagtttatttgctttcgatatatacacagaagtgaaattgctggatcatagggtagctctatttttaattttttgagaaacctccacactgttttccataatagatgtaccaattcacattcccaccaacagtatgtaaaggttccctttatccacatccacaccaatcttgttttgttttttgttttgattttttggcaacagccatcccaacaggtataaggtaatatcttattgtgactttgatttacatttccctgacgattagtgatgttgagcatcttttcataaaccacttggccattgtatgtcttctttagagaaatgtctatgcaggtcctttgcccacttttttttttttttctcaaagcagaaaatttattgcctacattctttgactacaatgctataacaacagaaatattttcttttacaaaaatctcaatcaccttaaacattttttaagtcactaaataactttgggtcaaagaagaaatcaaaactgcaaatacataaaagcaaacatcaattggcattgtatacattagaacatatgaaatagattatagtaaacaattattaaaacacaaagaatccaggatgcggaaagctgggatgagtattacaccctaacagcaacgatagcagataaactacaaaatcataacttttcctaaactcatttgagaactgagatcatagggcaatcaaaaagtctaaaataggctgggcacagtggctcatgcctgtaatcccagcactttgggaggctgactgaggcaggcggatcacctgaggtgaggaattcaagaccagcctggccaacatggcaaaactccatctctaccaaaaatacaaaaaattagccagccgtggtggcgcatgcctgtagttccagccactcgggaggctgaggcagaagaatcgcttgaacctgagaggcggaggttacagtgagccgagattgcaccactgcactcagcctgttgcctactttttaatagggttatttgttttttactattgagtagtaagagtttcttgtatattttggatttagctccttattgcatatatggtttgcaaatattttctcccattctatgggtatctttactctcttcatggttttctttgctatgcaaaagctttttactttgatgcaatcctactcctttacttttgcttttgttgcctgtgcttttgttgtcatatcaaaaaagaaatcaacgctagcaccaatgtcatgtatctttccctgcatattttcttctaggagttttaccattttaggtcttacatttaaatctttcatccacctttagttgatttttgtatatggtggaagataaagatccaatttccttatttttttttgcatgtggatatccagtttttccagcaccatttattgaagatactattctttcctcattcttgttcttgacaccttgtagaagattagttaaccttatatgagtgggtttatttctgtgctttcaattctgttccattgctctatgtgtgtttttatgccagtactatattgttttgattgctatagctttataatataatttgaacacaggaagtgtgatgcttctggctttgtccttcctgtgtggttctctttgtgttttttaaattcagtgttggttgagttttaaaaaaaatctgcaattcaatatctttcatcaaacctgggaagctttcagctattacttctttatttttttctctctccctttctgcggcttccattacacgtatgtggggacattgagcatcatcccatgtgtgtctgaaggtctgttcatttgtcttcatttttctttctgtttttcgaattggatcatttctattggtctattttcatgttcactagttcttccactatctcaaaatctgctattgagcccatctagtgaattcgaaattgtaccttccaactccagaatttccatttaattctttttacagtttgtatttctctatttagattccctatttgtcgagtcatttaaatcatattttcttttaattccttgaacagttttctttaattctctgaggccgggcgcagtggctcatgcctgtaatcccagcactttgggaggccgaggcgggtggatcacttgaggtcaggagttcaagactagcctggcaaacatggcgaaaccccatctctactaaaaatacaaaaaattagccgggcgtggtagtgggtgcctgtaatctcagcaacttgggaggctgaggcaggagaatcacttgaacccaggaggtagaagttgcagtgagctgagatcacgtcactgcactccagcctgggcgggcgacagagtgagactcttgtctccaaaaaaaaaaaaaaaacaaaaaaacaaaagaaaacttcaagcccattacacttccaacccctgtcagtccctctgtgtgggggttggagaaggccagttttcaagtcccttatctcccttgctgggctctctcaggtcttctccatatatgcatagttttttcagtcagccagggatgcgtgaagagctcacttcaatacttctctgattctcatttccagaatccccctgttaaattcctggttggcctgctgcttgccccaagtggggctgcaacctcaagctagcgaagctgtggatttgtcctgctcatttccaagtgttcattcccatgttaagccagcaaagccaaggattttcaaccccccagccactgctctgaattgaatctgtttgtgtggcagttttcatggccagccccatcttacttaaaagtcattggctgagctggggggtgatgggagcagccacaggcaaaaaaagccaccatctcctacttgcctgaagatctagtagtttttcaagaataaatgctgctcaattttttgcctgcattttgtcaatttccagttccctgaaatgcttggttttgataaacaattttgtctagttttatatattttttggttgtttgttgcttttttttttttttttttttttttacagaaagaaattgcctgcctctttgtgctgccataactggaaggccttctcctcgttattattttttgagatggagtttcgctcttgttgcccaggctggagtgcaatggtgcaatcttggctcactgcaacctctgcctccaagcgattctcctgcctcagtctcccaagtagctgggattacaggcgtgcaccaccacgcccagctaatttttttgtatttttagtagagacagggtttcaccatgttggtcaggctgatatagaactcctgacctcaagtgatccacctgcctcagcctcccaaaatgctgggattacagacgtgagccactgtgcccagcccgctttctttttaaaccctcctttgaacataaaaaatttacatgtttgtttaatgtttaacacaggtccctttcaatatcaagcttattatacttcattttcctaggcaaaggtgcagaaaaaccagctttgcaaatgtaggtcaaaactgcacagtgactaaccggcttccctcctccctgcacttcctcatttttctcagaagcagtacctgaaataaaggcagagtccttgtctgcctctatgtacttgataccagcttgtcaagacccacccttcccttttacctcgtctaaaattcacaccagtggacagcagggcctgcagcatgtctgtagaaatttatttaaacttatgtatgattcatagaagactgagtactttgatttgatggggatgggctatatttcttccaataacaaattaatggattagttcattagattagctacattatggaacacgtggaggagatggaggatgagttagttttagttacaggaggaataaggtaataaataacttcaagtagaacaataaaaatttggacttctaaataatttggataacccattttccaaatataggctaagcccctgctgtggtttagcattaaaaacatttaaataaaatacatgttaaataaaaaagtacttaaggaatgtgtttcctaatatacacaactggtgtgggcaatatacaacaaaacctttcaatctaaggacaaacttacaaataggaaaacaaatatcagatagtgcttttaggtcaggtgcagtggctcacacctgtaatcccagcactttggaagcctgaggcgggaagattgcttgagcccaggtgttcaagatcagcctgggcaacagagtgagacccgtctctactaaaaataaattacctgggcatggaagggcacgcctgtagtccaagctactcgggaggctgagatgggaggattgcttgagcctgtgaggttgaggctgcagtgagccgtgattgcaccgctgacactccgtgtcactccaccgctgggtgacacagtgagaccctgtctccaaaggaaaaaaataagtgctttcacaaaggcaaattccccaactttcttatttcaatatatttccttttttttaaatttcacatgagatagaatgggagtgtgaggggaggattgaatgttttggacaggtagtaactttgcctttcactttctgctgggctgtctcaggtcttccctatagatgcatagcttttccactcggccagggatgtgtgaagacctcatctcaacacttccatgactctcatttctagaatctccctattaaatccccggctgatctgctgctatggcctagtattaaaaatagcaaccaagctggcaaccaagaagactggaggtttgggcaactgttcctttttatttcatatctagggagatcattggatccttccctccctccctctctccttccttctctctctctctctctcatttgagataagtgaaatagaagataagatagaaggagtcagaaagagaaaatggaggcaagagtaagggagaatgaggagcaaggaaaccagagggaagcagagtcacagaagagagaggaaatggtgccaaggaaaggagaaattatggttgatgccatttggctgtagttaaaagtaaaacttgatatggtgctttaaaaaaataaagcaggaattttcccttattttagagggggaaagcaggaatggtgaaggaagagatgtccacatgaatggaagaatcagaaaaagggggaaagtgaattttgtttttctcctcaagtgcctaggcttggcaaccagcactctctaacattacgttgctcccagaggtggagagttaaagcaaatgtctcccagtgtgtggtggcagacacaaaataatagatccccaaatatcccagagagcttgggcctctactcagttccaaccacgtgtttgactgaataaattatattttatctttactatgagatattatataaccgttaaaaagaatgaattggaggtatgccagctgtcctagaaggtttttcatgagatgttggctgagacaagcaagaagagcgacaagagcgaaactccgtctcacaaaaaaattaagataaaataaaattagcataattaaaattctttgtatcattaaaattcaggcaacttgggctctgtcatagtacaaggttaagccattaggtcattctcgagtccagtggctcacaacggggactggtggtggcgccctggcttctctgggtggagaccggggacactgccaaacatcctccaaagcacaggatggccccacaaccaagcctcttgtggcccggagtatcagcaatgtcgaggctgtgagatcctgctctcacccaggcctgcttcccagagtcctttaagtcctaaagggagaagacagcaggctgccctctttctgttatttaaatcccacttaactccctcttagagcatgttcttctccctttaagactagcctgggggctgcacgcggtggctcacgcctgtaatcccagcactttgggaggctgaggtgggtggatcacctgagatcaggaatttgagaccaggctggccaacatggtgaaatcccatctatactaaaaatgcaaaaattagctgggcatggtggcgggcacctgtagtcccagctaatcgggaggctgaggcatgagaatagcttgaacccaggaggcagaggttacagtgagctgagattgagccactgcactgcagcctgggcgataaagcaagacttagtctcaaaaaaaaaaaaaaaaaaaaaagaaactagcctgggtaacatggtgaaactccatttctaccaaaaagaaaagaaaaaaaaaattagctgggtgtggtggtgcgtgcctgtagtcccagctacttgggaggttgaggctgcagtgagccatgattatgtcactgcactccagcctgggcaacagaggagaccctgtcttcaaaaaaaaaaaaaaaaaaaaaaaaaaaaaaaaaaaggcccagtgcagtggctcatgcctgtaattccagcactttgggaggccgaggcgggcagattgcctgaggtcaagagttcaagaccagcctggccaacatagtgaaaccctgtctcttactaaaaatacaaaaattagccgggcatggtcgtgggcacctgtaatcccagctactcaggaggctgaggcaggagaatctcttgaacccgggaggcagaggttgcagtgagctgagatggcgccactgcacttcagcctgagagacagagcaagactccgtctcaaaacaaaaaaaagaaaaaaaagaaacccctcactctcaccagtcttctccttccccagccctatctacacgtggtagagaccagcccgggctggtcttaaagggagaagagcatgctgtaagagggagtaagtgggatttcaataacaaagaaagaaggcagcctgttctcttctcccttcaggactaaagggctttgggaagcaggcctgggcgagagcaggatctcacagcctcggcattgctgagactctgggccacaggggtcttggttgtggggccgtcctgcacattgcggggtgtccagcaggcagccaccagtcgattttatatttctacaggtttgcctttcaattcataaattgaattatataatatgtggccttttgtgactggccctttctgttggcacgatgtttcccaggtttctccatgttgtaagcatgaatcaccactgagtccttttgatggctgaatggtatttcattgtgtgggtagaccacatacactggttgctagggctggtaagacagtaccacacactgggcagattaaacaatcatttacattctcagttctggaggcctctcttcttggcttggagatggccatcttctctcagtgtcctcacatagtcatcctcttgtgtgtgtctgtgttcttatgaggacattactcatactgcatttgggccccaccctaatgatctcattttaatttaattacttctttaaagatcttatctcaaaagagtcacatcctgaggtactgggagataagacttcaacatttgaatttggagagagcacactcagcccataacaccctgtcctctgctccctgaaaatccatatccttctcatatgcaaaatacacttatccccatccctacagtgccaaaagtcttaacccagatcagcatcaactgttaagtcccaaatctcatgtaagtatcgtctaaaccaggtatgggtgagatttgaggtatggttcatcctgaggcaaaattctccagctgtgaacctttacgaccagacaagaaattatctgcttcccaaacaggacaggcagagcatagacatttctagtttaaaagtgggacattggaaagaagaaagtggtcatggatctcctgtcctggaacctggtagggcaaattccgttcaatttttttttttttaatttgaaatggagtttcacccttgtcgcccaggctggagtgcaatggcgcggttttggctcactccaccctctgcctcctggcttcaagtgattctcctgcctcagtctcccaagtagctaggattacaggcatgagccaccatgcaaggctattttttgtatttttagtagagacgggatttcaccatgttgcccaggctggtctccaactcctgatctcaggtcatccacctgcctcagcttcccaaagtgttgggattacaggcgtgagccactgcgcccagcccaatgccaaggcttgagaataatcctctttggctcagtgttctgttgtctgggtccacagggtggccctgccttccagggccatcaccctgattcctctaccctaaatgctggccccaccccttggtcctgggctggggcatcctggcctgctgaaaccaaggaagtggcaccagacctgcccctgaatctgtgtgcctgggcccaaggtggcagtagcagcctggcagatctctgaactggcttcagagtcattcttccctttcctttaaggataactcatgatcacagccatatcgctgtactggctggtcctgcagaattccagaaatctgacaatcttccttcatttcttcctatttctgtctcctttggtccaaactggcaatgtctgctggtataaattctcaaaaaccttggcctcctatgcaatccacagggggtgaggccatttgacaagagggccctccacagatgttcctgggaaaaccacatctctgttcccgacttgctgagttggttgactgtatccatgcatcacattggccatcttttcagacaggggttcagccacacccttggtcttttctccagaatgtgctttcacactttttgtagaatggatagatggagaattttccaaatcttcaagttttggttcctttttttctaaaaattccttttttagcttgtctctctcctctcatattttactatgagcagcaagaagaaatcaggccaccttcagtactttgcttagaaatctcctcagctaaatatccaagttcatcatttataagttctgctttccatgaaacatgagaatccaattcaacaaatttctttgccactttataacaaggtctatctttcttctagtttctaatatcatgttcctcatttctgtccaagatctcaccagaagtacgtttaacattcatatttcagccaacatgctgttcctgatgatacatgtattctctaagatgacagatgtttctctctcttttttttttttttttgtggagatggagtctctctctgtcacccaggctggagtgcagtggcatgatcttggctcactgcaacctctgcctcccaggctcaagcaattatcctgcctcagctccccgagtagccgggactacaggtgcatgccaccacacctggctaatttttgtatttttagtagagatggggtttcaccatgttggccaggctggtctcaaactcctgacctcaggtgatccacatgtcttggcctcccaaactgctgggactaccggcgtgagccatggtgcccagctgatagatgctttctctacagctctgttttttctttctcagtcctcactggaatcaccttcaatgtccacatttctgttgctgtttttttttttcctttgagactgagtctcgctctattgccgaggctggagtgcagtggcgtgatctcagctcactgcaatttctgcctttcaggttcaggcaattcttctgcctcagcctcctgagtatctgggattacaggcgcacgccaccacgcctggataatttttgtatttttagtagagatggggtttcaccatgttggccaggctggtctcgaactcctgacctcaagtgatccgcctgcctcagcctcccaaagtgctgggattacaggcgtgagccaccgcgcccggctaatgtccacatttctatcaacagtctctttaaggcaatttaggccttttccaacatgcacctccaaactcttccagcccttactcactgtttagttccaaagccacgtctgctcaacagcacgctatttcttggtacccaaatctgtactggttgccagggctgctgtaacaaagtcccacagactaggggacttaaaccacagccatttatcttctaacagttctggaagctagaagtctgagaccaatgcattggcagaatgggtttcttctgaggtgtctctcctgggcttgcagatgaccgcctttgccctatttcttcaaatggtcttctttcggtgtgtgtctgtgtctaaagttccttttttatttcagacacaggtttgctcttgttgcccaggctggagtgcagtggcacaatctcggctcactgcaacctccgccttctgggttcaagtgattctcctgcctcagcctcctgagtagctgggattacaggtgtccgccaccatgcctggctaatttttgtatttttagtagagacgaggtttcaccatgttggccaggctggtctggaactcctgagctcaggtgatccacccgcctcagcctcccaaagtgctgggattacgggtgtgagtcactgcgcctggccctaaagttcctcttataaggataccagtcatattggattactgtcctaatgacctcattttaacttgattacttctttaaagatcctgtctccaaacacaggcatattctgaggcactggaggtgaggacttcaacatatacacttggaggtggggggacaaaattctgcccataacgccatatgttatttatccattcatcaattcacacttacatttcctttttttttttttatttttctgtttattttttgagacagagtctccctctgtcgcccaggctggggtgcagtggcacaacctcaactcactgcagcctccacctctcgggttcaagcaactctccagcctcagcctcccaagtagctgggactacaggtgcgccaccacaaccgggtaatttttgcatttttagtagagatggggtttcaccatgttggccaggctggtctcgaactcctgacctcaggtgatccgcctgcctcggcctcccaaagtgctgggattacaggtgtgagccaccaggcccggccaattaacacttacatttcctttcatagatttaattactaaatcaatacgaaaaataactctcaggtgtataacaagctacaaagatttcaaccttactaagtttttttactttttatttctgtgacagtttttcctgatggctctgaaagtcaccctaagatggttctctgtactttcttgccattactcttctacttaaaaagaaacccactcctaatgacatataatttacgtaccgtaaaatttacccttttaaggtgtttaatttggtattttttggtttactaacagctgtgcaaccattattgctatctaattttataaaaaaattacaactattcaattttaaaatgcttttaccaaccccccacgaaatcccatacaaattgatggtcattcccgtttcccgccagccccccaacccctggcaatcaccaatatgctttccgtctctgtggatttgcctaatttagacagtttatgtaaattaaatcatacaagaggcagcctctttccctcagcataatgttttcaagattcatccatggtatagcatgtatcagcacttcattcctttatttatttatttgagacacagtctcagtctgtcgcccaggctggagtgcagtggtgcgatctcggctcactgcaagctccgcctcctgggttcacaccattctcctgcctcagcctcccgagtagctgggactccaggagcctgccaccatgcccggctaattttctgtatttttagtagaaacggggtttcaccgtgttagctaggatggtcttgatatcctgacctcatgatccacctgcctcagcatcccaaagtgctgggattacaggcgtgagccactgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaaagctctttaaaaagaaggaaatggaatgcttggctcctgtaatatcagaacaaataatgcacagccagaggtcatgcctcaccttctgcttatctcagtcacctccacttgtaaaatcagtgggccatattcaataaaaccttcatatcagttccatatcttttcccagaaaccccaggaacagagggagccaatatccttattaaaccaagaagctcactgtcacaaagagctaagtctgacgcccctgggcccctacctaaccacgtgtcctgattctttccataacttcccactgcacaacatccaggttatactgaagatattacacatctggttaaaaacagtacacgtctctcatgaacaataagccatcctttctattaaaatgagtgtaaaattgcaggtaaaatgctgtaggcaggcctgtttggaaggctatgcgaccctaggagacaaaaaggtgcaggaggaggaaaagggcagacaccgcagaaagcggtcgaagagaacgtgaaagaagtggccatttctagctgggcgcggtggttcacgcctgtaatcccagcactttgggaggctgaggcgggtggatcatgaggtcaggagatcgagaccatcctggctaacacggtgaaaccccgtctctaccaaaaaaaaaaaaaatacaaaaaattagccgggcgtggtggcgggcgccagtagtcctagctactcgggaggctgaggcaggagaatggtgtgaacccgggaggtggagcttgcagtgatccgagattgcgccactgcactccagcctgggcgacagagcgagactccgtctcaaaaaaaaaaaaaaaaaaaaaaagaagtggccatttctgcaacttttaggagagctacctgccctcaaattttgaaagggtttctatttcttaaagtgctacgtttccctggctgaaactcacatctttcttccctctagggctggatcaaagcttcagaggttgtttctctggccctagacagggccacccccgcaaatttctcccccactgcgcctgacatccgcttccatccatggctccattaacggaagctaagcactggctcgggggactttatccaccgcccggtgttattagattccaggcttcctggcctcaggaaaggatctggctcgtgtatttgtgtatcgcagctaacaaggaaaggcagtcggtaccagtgcccagagctatgtgagctgtgactggtcacagcccaggagccagatggcatccccgggggcgcgcgtccccggactcaccgggcagacggaggcccggggcttcacaccttcccctcaccgggcaacgcggcagacctgactcgcgggggactgagcaatattcgttccagggccgcggcagccggacagaggcactcgggggcggtgggagtagtgtgcgcaccggttccgcagcccggagggggccccagctgggcttccgcgacaccagggccctccatcccctcccgtcctcccctagcgcagccttcacccctgtcccagagcccctccctgtccgcgtcccctcccccgcaggtcccctgcgagtcggaacctcctctccatcacagccccgctccttggcggggccccctctcccttcgagccctcctccaggttcgagccccctgcgggtacggacgtctgacctgtgcccagcgcctcgcagccgtctgcagcccgcgccgcgcgccaagtgcgtccgcccagaagcaggtgcagctccaggcccgccccgccccgctgcgccccgccccgctccactccgccaggcctggcagccgccagcccctttccacccttgaccgcccttcccggtcccggccagcgtgcggggcatctgtcgtcaggtccgcacttcctccaggcctttgactttcccgtggagatgtctctggcctcaggaactccctaagctgtgtgcttcaggagaggctggttcctgagtcacccaagaggactgcaaccaacctggacctcctgagatgcaaagagatcgcagggcctgggaggcggcgaggaccctgagaacaggctgtggctccgaagagtgtttgttaccaagccaggcaaccactgcgaacacaccgcagaaacagccacggatcaccgtccagcaaaggaagaaggtgccaacggtccatcagggaccacaacccagtttttttagtttaagtttggtggctaagtttgagtgtcacatagttcattcattccttcattcattcaacaaatctgccatgttcccatctgataacagatctgacaggtgggcactgttctaggtgctggcgatagagctaagaaggaaacaaagttcctgtcccggagaagggggctacctgctgaggagagcatgactttctttgtggtattgtgctgtggcagcagggtcctcttctgtaagctactgagaggtgaaacccgctgggcttctgggtcggatggggacttggagaacttttctgtctagctaaaggattgtaaaagcatcaatctgcactctgtgtctagctaaaggtttgtaaacacaccaatcagcactctgtaaaaatgcaccaatcagtgctctgtgtccagctaattggtggggacttggagaacttttctctctagccaaaggattgtaaatgcaccaatcaatgctctatgtctagctaaaggtttgtaaacacatcaatcagcactctgtaaaaacggaccaatcagcactctgtaaaatggaccaatcagcactctgtaaaatggaccaatcagcgctctgtaaaatggaccaatcaggaggatgtgggcaggaccaatcaggaggatgtgggcggggccaatgagggaataaaagctggccatccgagccagcggcagctgcgtttgggtccccttcgatggtgttggggttttgttgtttcgctctttgcaataaattttgctgttgctcaccttttaggtccacactacctttatgagctttaacactcacagtgaaggtctgcaggttcactcctgtaaaccagcgagaccaggaagccaccacaagaaacaactctggagccgccacctttaagagccataacactcactgtgaaggtctgtggcttcactcctgaagtcagcgacaccacgaacccacagggaggagcaaacaactccagacgcaccacttttaagaggtgtaacactccctgcgaaggtctgtggcttcactcctgaggtcggcgaaactacgaacccgctgggaggaaggaacaacgcggatgcgccacctttaagagctgtaacactccctgcgaaggtccgcggcctcactcatcaagtcgtgcatagaccacgaactctctagaaagaaaaaacttcggacacacctgaacatttgaaggaacaaactccggacacaccatgtttaagaactataatgccgtgaaggtccgcggcaggaccgggaccaggaactcttcagagggaaccaattccggatacacagcttcgtggaatggttctgcactgtgtgtgtgtgtgtttcccgtcaaccctgtgcacactattagaagaacacaagcgttaaggctccctctcagtcctgccggtaagaatccagggctgatgcacctattaaaagcttctcaggaggcctggggaagtgggggttgagaaccacgggtctagatctctaagatgcctggcagcttattccactgttgagggcactggcaatcaggaagggcttcatggaagagatgtttgcatttgggttttaaagcagggccacagctagatattagcagtgcagaaggacacgggatccgacgggcagcctgttgaccaaatggctccgtttttataaagtcaaagaacatcactgtgaaggataaggcattaactggagcagacctttccctggtaaaacagagcgaatgggatctggtgggaggtggtaatggccaagaggtagtgccgtcagtgaaaagcgtcatggagtcgtgcaccttacagggaggatgggccgcagccaggagctgagagggcatcttttaaatttgccgtcagctcaggaacttaatcacacatctcatcctagcccttgctcacacccattgttttagaaatcgttgatagagtggagtcctggatgcctgttactctgggagaggctgtcctctgtcaccagatcccttttatggacaggcattttctttagtaatatttaccttgtctacgatgatgaaacaaaggtgtgacctcttaattgtatagttaatggtgagtagagatgctttttttttttttactttttatttttgagacagttttgctcttgttgcccaggctggagtgcaatggcgcgatctcggctcaccacaaccttggcctcctgggttcaagtgactctcgtgtctcactctcctgagtagctgggatcacaggcatgcgccgccatgcccagctaattttgtgtttttagtagagtcggggtttctccatgtttgtcagactgttcttgaactcccgacctcaggtgatctgcccacctcagcctcctaaagtgctgggattagaggtgtgagccacctcgcccgacggagatgcttcttaatattaaaaaatctaaacaaaataatttctgcttcaaattataataaccaggtaccaggacaaaaccaattttttgttgtgtgtgtgtgtgtgtgtttgagacgggctcactttgttgcccaggatgaagttcagtggtgcaatcatagctcactgtagcctcgacctccaacgctcaagagatactcttgccacagcttcctaagtagctgggactacaggtgtgcatcaacacgcatggctaatgtttacatttttaaaaattgcaatagtttttggggaacaggtcatttttttgttacatggataagttatttagtggtgatttctgagatttttgtgtactcatcacctgagcagtgtacactgtacccaatgtatagtcttttatccctcaccctcctcccactttcccttgagtccccaaagtccattatatatatatatatatatatatatatatatatatatgtatgtatgtatgtattttttttttttttttgagacagtcttgctctgtcgccctggctagagtgcagtggcgcaatctcagctcactgcaacctctgcctcccaagttcaagcgattctcctgcctcagacctctgagtagctgggactacaggcgcgtgcccacgacgaactaattttttgtatttttagtagagacagggtttcaccatgttagccaggatggtctcaatctcctgacttcatgatccgcctgccttggcctcccaaagtgctgggattacagttgtgagccactgcacccggcccattatatcattcttatgcctttgcatcctcatagttcagcaaacccttataagtgagaacataacgatatttggtttcccattcctgagttacttcacttggaatagtggtctccaactcccgtacaaattgctgcaaatgccattacttcattcctttttatggctgagtagtagtccatggtgtaaatatatcacattttctttatccacttgtcagtcgaggggcatttaggctggttccatatttttgcaattgtgtattttgctcctataaacatgcagatgcaagtggctttttcatataatgacttcttttcttctggatatatactcaatagtgggactgctggatcaaatggtagttttacttttagttctttaaggaatctccataaagttttccacagtggatgtactagtttatattcccaccatcagtgtaaaagtgcccttttcatcacatctatgcaaacatctactattttttgactttgtaaattatggccagtcttgcagaagtaaggtggtatttcattgtggttttaatctgcatttccctgataattagtgatgttgagcattctttttcatgtgttagtcatttgtgtatcttcttttgagaactgtctattcatgttctttgcccactttttgatgggattatttctttttttcttactgatttgagttccttgtagattctgcatattagtcctttgtaggacgcatagttgaatattttctcccattcagtgaggtgtctgtttacactgctgattattttgctgtgccgaagtgttttcattaggtaatatctatttatttttgtttttgttagatttgctttggggtttttggtcttaaaatctttgcctaagccaatgtctagaagagtttttccagcgttattttctaaagtttttatggtttcaggtcttacatttaagtgtttgatccatcttgagttgatgtctgtataaggtaagagatgaggatccagtttcattcttctgtatgtggctagacagttatcccagcaccatttgttgaatagggtgccccttccctatttgtgtttttgctttctttgttgaagatgagttggttgtaagtatttggctttatttctgggttctgtattctgttccattggtctatgtgcctatttttatattggtaccatgctgttttggtactggtataaatcttgtaggatagtttgaagtcagttaatgcgatgcctccagatgttttttttttttttttttttttttttgcttagtcttgctttggttatgaggggtcctttttggttccatatgaattttagatttttttttctagttctgtgaagaatgatgatggtactttgataggagttgcactgaatgtgtagattgcttttgacagctttcacaatattgaatctacccatgagcatgggatgtgtttccatttgtttgtgtcatcagtgatttctttcagcagtgttttgtagttttccttgtagaggtctttcacctgcttggttttatatatatatatatgtgtgtgtgtcatagatagtttttattaccttgaggtatgtcccttccatgccaatttttctgagggttttaatcataaagcaatgctgaaataacatattatatattataaaataaaacattataatatataatatatataatacatatagcagctgttgtaaaagggatcgagttcttgatttgtgtctcatcttggtcactgttggtatttagtggtgttactgacctgtgaacattgatttttgtatcctgaaactttactgaattcatttatccaatctaggagccttttggatgaatcttcagagttttctaggtatacaatcttatcatcagtgaactgcaatagtttgacttcctctttactgatttggatgccctttatttctttctcatgtctgattgctctggctaggacttccagtactatgttgaatagaagtggtgaaagtgagcatccttggcttgttccagttctcagggggaatgctttcaacttttccctgttcagtataatgttggctgtcggttggtcacagatagcttttattaccttgaggtatgtcccttccatgccaatttttctgagggttttaatcatatagcaatgctgaattttgtcaaatgctttttctgcgttgattgggataatatgagttttgtttttaattctgtttactggatatattacatttattgacttgtatatccctgcattcctggtatgaaacccacttgactattgctgtattatctttaaaaaaattttttttataagttattggggtgctggtggtatttggttacatgagtaagttatttagtggtgatttgtgagattttggtgcactcatcacctgagcagtatacaaggcaccatatttgtagtcttttatcccttgactgcctcctatttttctccccaaacccccaaagtccatggtatcattctgtgccttcgcatcctcatagctaactcccacatatcagtgagaacataagatgtttggttttccattcctgagttacttcacttagaattataatctccagtctcatccaggtcactgcaaatgctgttaattcattcg

SEQ ID NO: 12567 - DNA, 8474 bp, Human
agtctctttcctgggtgtccactttggagagctacattccatgggcatgtgtgtggggtcctgcctctccatgatcctcattcccattttgtggttggttcctaggccttaggcttttttattcttttgagaaaacagcagtagatccaggcagtcacacagagaagcttgaatggtgacgatggtttctgctccttaaaacagaaacccaggtgtgggaagagagtgatgtcatctgatctaggttttccaatatgtgtatggaaagcatggtaggagagaccacatacacatgcacagacagacatatatacatgcctccccagggaagctgggtagactgcaggcattctgtgcagttctcaaactttctttcttttctcttcttttttttttgagatggagtctctctctgttgcccaagctggagtgcaggggcacgatctcggctcactgcaacctccgcctcccaggttcaagtgattctcctgcctcagtaggagtagctggcattacaggtgcctgccactatgcccagctaatttttgtatttttagtagagatggggtttcaccatgttggccaggctggtcttgaactcctgacctcaagtgatccacccaccttggcctcccaaaatgctgggattacaggcgtgcctggcctttaaactttcaagcatgtcagacttgctggaagggccttaaaacacagatttctgggccccacccccggagtttctgactcagtagatttaaggtgagatcaggtaacatgtatttctagcaagttcccaggtgatatggatgctgctgctctggggaccacacttcagaaaccaccttcttagataatctgtatctgccagcttttccccaacatataaggctgggaccaggttaagttttataagtgatgacctttggggtctgatggacacccaggcctctgtgttgagaaagaggaactattaaccccatgggagtatttgggtggcctcagaaggtaggaagtggcctttaactccatagaccctatttaaacagcttcggacaggtttaaacatctccttggataattcctagtatccctgttcccactcctactcagggatgatagctctaagaggtgttaggggattaggctgaaaatgtaggtcacccctcagccatctgggaactagaatgagtgagagaggagagaggggcagagacacacacagggaaaaggtgagagaaagcagagggcatatgaggccagttacaaaagtgtctccgacggactggtggtgattagatttcaatgtcccttgaggcccagaaggaaggaacagagttccctgttctcttttttcctactctttctcccaagctggattagcaagaatgggagagacaaaatatggtggtcaagtcctggagatcccctgtgggaaaagttgctttcctttctgatgcgacggctatgaggggcataagaccagtcagcatgaagatggggcagaggtagaaatgtgaggattcttgaaaataggaaacagatccaaaaggcccggtgagagtgggcgtgggagagcttatagtctccaaagacagatgaggggctgcagggccttggaaggtgggggtgctgggagtttgtctggtcctctttttccaatcccaggctatgcatggctagggctgagggttgtgttcacatagaggggtggtggttcagacccatgtttctgtccgaactgggaaactgagcacttgggagtcggatcatcagtgaggagctttgttggggaagatgctccctttccttctttgagaataagcacacttgtactctcctctctctccatttcccccaaccccaggccaataagatatgcaaatgatctccttaccttattggttggaggcctcaggaccacagatgacctcagagagctggccctttaagaatgccctttgggctctgtgcccacagccccctggagctgagcagaggcaccaggccctgctccatggagccttcagtctcctgggaagctgtgcctgtctggctctggcactgaccacatcctctcggccatttctgaagtgagtatatccagggcctacctgggtgtcaggccgctcacctagaaccccctctttaacacctgctctctgttgtctgttttcaagaatcctaacaccttggtaccctactccactcccaccctgactggcctgtgtccctcactgctatcacgtcagaaagataaacaaccttccccactactccttctgtacatccagttctttctggatacctctctcagtgtctcaccatctcctttctgccaagacccagttcctttaatctgtgtctgtttccatcccctctgtcctctcaagggtgacaggttccatagagagggcagcaaccctgccctggaacaggaagagagaggcctgggtcttcctctttgcctctctgggtagagcctgggggtctgacatgtggttggaaagaaggctacctaggcttggggcatctagaaggagccgaagtctaagccctggggatgaacactccatgccgcgcaccttctgggggtggggtgggagttactggaattgggagctggactagagcttggacttcaaggctgggaagggtatctgaggtcacccagccagaagttcctcaggtgaacatgtgccccatgattgataacagacaggagagttccttggtgacataagtttaggacactttttgttgaacttgaacagacggtttactaaaggattgctcaggttaatatgctcttgtgctatgtgcatctgtaagaggtagggataggaggcaacatttctcaaagttatctgagcacagacctcttcataggtattgttcagaatcagtgttctagagaacactctttggtatatgttacaaagtctaactgccctcattgaacagaagggaaaacgggtcagaagggtgaaggtgatctgccaagttcacacaacgtaacaagttctgaatagaaggaaaatcaatcttggtctgttccccttggagagactggccttgaggaaagatggtggccagttgattctgatctttctagaactaattctaggacctttcttttttccatataaagcctcttgcccctacaaaagggattcattgattgattaatccatagaacaaatgtacactgagggtcttctataggcaaggcacttccctgagtgctttgagagacagagagctataagaacacattatccttggctcttaaaattcacagcatacatgccttcccactgtcctaaaatatacactcactttgtcacagttaattaagcaatttaaaaaaatggcttggaaatggaatgatgcctcttgagatgacagacctctcggcatgtctcagcactagggttgggagcactgccatactgctcttgcttttcatagatcctgaggcatcagtggggcgagaggctgtgctgtcctcttcctccttcaggaattcagctgcttgtcccctgtcaggagcccctgccctctgaaaggttactcttcagcctggtggggactctgcagtgaacagagctgcaccatccctctggctttcccaaactcttgctccagggcacttgggctttgagggaagagggacttggtgaagaggggatggcaggtggcctccatgtgctccagacctctcctcctctttgcaggtgcactcctcccagcccagctccagaatggccctgccccccagccccctggccatggaatatgtcaatgactttgacttgatgaagtttgaggtaaagcgggaaccctctgagggccgacctggcccccctacagcctcactgggctccacaccttacagctcagtgcctccttcacccaccttcagtgaaccaggcatggtgggggcaaccgagggcacccggccaggcctggaggagctgtactggctggctaccctgcagcagcagctgggggctggggaggcattggggctgagtcctgaagaggccatggagctgctgcagggtcagggcccagtccctgttgatgggccccatggctactacccagggagcccagaggagacaggagcccagcacgtccaggtgagtggtcagcaagctggcctgaggggaggcagggcaaggaaggaggactgcccaagagaggaaggggagctcccagagggggttatggactgggacaggggacagagggcaggagaaggggagaaggtcccttgaaagcaatcagatcgagaaaactacattctgcttctcccccttttcttaaaatggagagaaatgagtaggctgaaccaggaggagcagggagaagataagattagcagagaatccaaagggaagaattgagctggggagtgggcgactccggggggtaaacagatacatggtgtgtggaaaccagggaaagggttatgtgtggagtggagctgggttaagactggtttagattggccttttcaagacttcgtgcttcccagcccccaaccttctcaggaaggattgggactcatcctattaattacagacacagatgggggtgttgcgggcattaggatgtaatccaaatcctgtgagggtcaccgggttgcaggcttcaggacagggaaacgcagcgcgttggagggttgggggctgtctgggtgcgggtccactggacacacccgggcctggagctggatgccggggatcccagagacgagcccggggtttaggtgcgcgacgggctcgcctgaccgtggccggccctgcaccgtggggcgcccgcctgactggagcaacggtcagctggggggcccggggagcgtcggggcctggggcgggctctggaccgaaacagactgcgtggaagggcgagccttccggtgaaggtgggagccggggcggggctgtcccggggcggagccaggtagcgtcgggccctcagggcagagccgggtgcgacctggcgctgacccggtttctgcattctccctccgcagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacaaaaacccagcccacatgactagcacgctgagctctgcagggaccagtgccaggcactggggggtggaagtgtggtgacacagtgaatgggaggtggaggagggttgcagctcccacctcagtttagtttttaattcagggttttcaacctgtaacacattaaagctgtaattagcaatgaggctgtattttcattctgaagcttgtaacctccccattttagcactacagaattttcaagatttcaatatccaacaactagatagattaggacctctatccgagatgctttttccctgcccaaccctgtggccttcagggctcagagcagcaaaggcctgaagagtgagctctgggggttgttggtgtgggttgggagagagctgtgtgcagaagtctggaaacctgggtcctagtcccagctcttccatgggatccccctgtcaccctgagcaaatcagttgcttcctggacttgtgttacttcatctaattctcatgtggattggacgacttctgctccctttccagttctggcatctccccagtatggaagtcccggtggtctccccaagaagtccccaagacaatctcgccaaaggcacctcctatcctgctgcagtttcccagctgcagcctaggcaggggatgcacagcccaggcgaggaagcctggcttctctgtgagcacatacgtgggtcctcggcagctccctccaggctgtctgggcctccagacctgcacagggtgctcctgccacctcccacctctctgagggctgaggtgagacttctcctgggatgacaatttgctgagagagtgcagcttttgtgaattaaacttgaagtccaggcagaattctaatgcaataagctaaatgttcttgcaatttaagaagtgttcattctttatccctgcttcaggctactgtttgtgtgtctgtgtgtgggagagggagagagagggagagagagagagagcaagaaaaagggaagtccccacctggagctgggtggcacatctgttatggagagccaatggaaatggggtggaggggcaggcattggaacagatggatcctccccctctcaccaccaccaccaccaaactcagaagcctcagtggcccagctcggcctgtcagtggctatccaggtctcacagtttccatggtaacccagtcctccagttcagcaggctaacgggagggcagatggggcctctgggcagagcacaggcgttgtgctgggagcagccgcctcacgagttactgtcatctgtcctctaccggacataataaatgggagaagctttcgggcatgggggaagaggctcccatatgtccctcttcctttctaccccctctctccaccccctccccagctgtctcttctcttcccatcacagttcttgctccctctttcccctcctctatcccagctcatccctcctccgcttaggagcctgcaatgggagtcctctcctccatcgctctcagaatttctctcgtctcctctcccttccccaccattggccactggccatcctctctggctctggattctctctctgaggggctcacagaacctttagcttctctttcttcatccccttccacactcattgttgaagggagaggatggggcagggagggtccttctgggagcccagctctttttctctcactctaaatttcacctgtgtctatccttgcctgccctggagctgtaattcagacccactacttttcttgttcacttttctcacctgcatggcacacaaagacagacagaaccatccatagacacctgagcacacaactaggccacatatacagtaccatacctgggtctcaaaatgatactcctgggttacctgagtatacttaaaaaaacaaagttgcacactgtggtgattaagagtagtgctttaggtggggcgcagtggttcctgcctgtaatcccaacactttgggaggccaaggaggaagtttgagaccagcctgggcaacatagcgagaaccctgtcactacaaaaaaataaaataaaataaattcagatgtaatggcatgcacctggagtcccacctacccaggaggctaaggtggaaggataacttgagcccaggagttcggggatgcagtgagccataatcgtgccactgcattccagcctgggtggcagagtgagaccctgtttcaagttgcagttctaccagttttttgaccatgggtgggttaaaatcaagcctcacttgattgtcagaaaaatggtgaaaataatggtaaccacctactgagaataaatgcatttaaataagcacttagcataaagttgacacatgctacgtaatgatatttgctgttgttgctgatgtgattgttaagtgtgtgaatctgtgtgttcatgcactgcacatccctgagtccatgagtgtgacccattaaggccatgaacagacacacacattgacacacccgggaaaccagactgtataggccttagatgctccactatgttcccaattcactagcagacctgctgccctccttcagtatcccccagcacctgctcttggcccgccccacagctgtgtgggggctggggttcagctcctgggggactcagcagggcctctctggagacagctataagaaagcttcagcctgccctcctgacagcccgtaattatcctcctatctcctgtaattattctccatggtgcctagaccccctggggttgggaggtgagggagggggctcctcagatcccactggcacatagctggggtaagactgcagagacagcagcctgcctggggagctctgtctcagattttgaaaggtgctggtcctcatttcttatggtgtgtgtgggggtgc

SEQ ID NO: 12568 - DNA, 56694 bp, Human
agatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttctaacaagttactttagtagtatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatttttttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttaaactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatggctgttccatcttacttgttagatcatgtttccattgctattctaattttgcatactgccagtcaagaaattattttttgtatccagctgaagtatttcttttatttaaattctttttttcatgcttgatcttttatagatatgaactgaccgtaagtccaagagatgtgggaaaatcagaatgaggtgaaagaatcttgagaattgaagtgctccctagtaaagacagctcagggttttcttttacattgctcttaggcattcgctttataaagatgtattgtagaattcttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatctgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttctacctcagatgtactctgagatgtgggtggatggtcctagtttttctataaagtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatccgtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaatatttccctgcaaatagttttcacattgttacctaatgataggttgacaaaagcctgaggggtcaaaccagtctaaagatgctaagtcttccaggttgtttttgaaaatgaaatgtaaatgtcattctttagtataagttctagtctacctcccactactgttcttgcccctcctttttttttttttgagatggagtcttgctctgtcgcccaggctggagtacagtggcgtgatctcagctcactgcaagctccacctcccgggttcatgccattctcctgcctcagcctcccaagtagctgggactacaggcacccgccaccatgcctggctaatttttttgtatttttagtagagatggggtttcaccgtgttagccaggatggtcttgatctcctgacctcatgatccgcacgcctcagcctcccgaagtgctggaattacaggcatgagccaccgcgcccggcctgcacctccatttttagtgtgaggatggaaagaagatgttttaattttttttcagagcacaaataatttatagagttttataattctggagaaaacctttcttttgttgttgtaagtgcaaaaattaaggtagctttttctaattacagaaataatttagaaaatacaagaaagaacagaagaaaataacaataaattcatatttgtccttcaattctcttttctactcagacacatgtgtacacatgaacacatataccccctcccttatatattggggattacattgaaacatactgatgtaaacttgcttttttcacttaaaatattatgaacttttttcagtgtaactaaagctaatctgaacattattttaaattaatagctgtctaatatctgaacaatccctttttgttggacaattaggttgtttccaggtttttttcacaattataaataatatatatcaaagagttatctatactcccaagttcattgcagcagtattcacagtagtggaatggaatcaacctgaatgtccctcagtggatgaatggataaagaaaatgtgacacatatacactgtggactgtaacacagccatttaaaaagaatgaaatccttgtcatttgcaacaacatggatgaaggacctggaagacctcatgttaagtgaaagaagccaggcacagaaagtcaaatatcacatgtcctcattcatatatgggaactaaacaattgaactcagggaggtagagttagaatgatggttatcagaggctgggaagggtagtggtaacaaaaataccattaaatagaagtaataagatctagtgttggacagcacaataaattaactatacttaaaaatcatgggccaggcacagtggttcacgcctgtaatcccagcactttgggaggctgaggtggggggatcatgaggtcaggagttcgagaccagcctgactaacatggtgaaaccccgtctctactaaaaatacaaaaattagccaggcatgatggcatgtgccctgtaatgccagctactcaggaggctgaggcaggagaatcgcttgaacccgggaggcagaggttgcagtgagctgagagcacaccactgcactccagcctgggcgacagagcaagactccatctaaaaaataaaataaaataatgtgtcgttcggggagtgggcctggtggcagtggcggtggcagggaaagagttggagcagtgccagcggcaagcgaacaaggtgacggaaatcacgcttaacaactttgacaaggtcctggagcatgatggaaagctggccgaactggagcagcgttcagaccaactcctggatatgagctcagccttcagcaagacaacaaagaccctggcccagaagaagtgctgggagaacatccattgccagatctacttggggctagtggtgggtggtagcctgctcatcatcctgattgagcagctggccatctttctccctcagagtgacaccagtaatgccccacagacctaggatgcaggcaccacctcagggcctggggactgacagctggtcctgagggagaagccaaatggctgcactggctggttccggtctccagagaaccttggtgtttgctctcccctgacccaccccagtgagtgccaaagggcagccccaacacgtgcacccctgcatttcttgtcatgccacagactggccctcgagggcaccctgccatactggccatgccgggccagccccacctgaagctcagtgaaagctgattaaaaaaaaaaaattatgtatagatcaaaataactacaagagtggaaattgaatattcctaacaaaaagaaatgatacatgcttaatgagtttcacaactacccttatttgatcgttacatgttttatacttgtatcaaaatggtgcatgtactccataaatatgtataactattatgtagccataactaaaaatttaaaatttatataaaaacagtattccataggactaccaaactagggaaattactgcccccattttctcattagatttttcttcactagagtagtataacatgaccgagaatttgggcttgctcagctctccacactgaccggccgaatgaccttggatatgtcatttaacctataagccactgttttctcatctgtcaaatgaagataatattaatagctgcattatagggttatgagaattagatggtaatttctgtaaagtgtcacagtgcctgggatataatatgaaatcaatgaagtgtagtggttatttttacttattattatacatacattttttattatttccttatgacaaattctcagaagtgggattgctaaggtaaaaatattagtattgtaaagatttttgatacatagtgctatcaaaactcttaggtaaaaaatgctcttggttttataaagcctacgccttcagaatgttgtactaatttacacttgtagcttcaccatataagagtatgagtttcttgggattctcacccgtacttgatattattaaaatattttttgccagttggataagcagaaggttggcatttagttatttctttagctacatttcaatgactaaatgctcaaatttaagatttttcaaaatgttttgcaatgacaatagtctgtgaaactgaaaaatatgtaacacattaatttttgttaaagatgtgtggtctgaattagttaattcatagagcatctttacctaccactttattacttaaaccaacaggtaagagttttagtagagagggctgttaggcttgctttaatgagtacatgagattttattataattatactattgcctctttttcacaaatggatggtgctaaaatacgtgaaagtagtttattctcaattaatttaaaattcaccttgtacttctcttaatttgcttattagtgaatcctttctccatggataaactcctcaaaactgctgaagtatgtatgaggtattgtcctcacgttctggggggtataccatatgttccattaagatgtttgaagtattcacagaccttccccttctcccctattttacgtttgcttcccaaacttcattctatttttaaattttaattcctttatccatttttgcatcaatacttgtttaaaaatctattttactagttctattcgtgccattaaatgaacaaaagaagaaagcagaatttgattttaactaattacctaatcttgatgctttctgagtatacaatcagtagagatgaagtagaacaatcagatagaactaaattgtttgaacaaaattaagtaaaactaccagtgatttataaaactgtacccattaataacatgatatagtcttattttcaaaggattgaaaattaatggaagaaattttcctttccactagctttgcacgaaagaaataatcttctttgaatatcctcctgtaaatcccactgcaaattgtagtctgcacagaacagaatcgtgatgcctaatcctcctcttttcatggtttagtctatacaaagagcagagctggaaattggatcttttgacagcagttactaagcaacagaatttggatgtttttggttaacatcctaatatataatgtagctgatttgttgaagtttttgcatatattagctgagagaagtgggcactccggaagtgactacaggtccctgtatggctggggaggtgggcatttgttgttgttttgttcaatacactgtgtcttttggcatttgtatctctttggcgtagaaaggaggctggtgcagaactttcagaccttgtgactttttatattattaagaatacccttctctgtggctcacgatatgagaaaatgtaagattttttcctgaaaagcagggagaacaaataaaggattttaaggtcattccaggaagctttagagctttgccaaaagtttaggtccacttcctgaggcagtttcattagcagacagctaatgtttgcttggtctactcccaagttatttttagaaacgagattattactgatagcacccatttgaatttgctcatttacgtttttatatgctaccaaatatgattagagtatgcttttaactaatcgctgacagatttactgcattagggattttctaagctatgagattcctacagtcatcagatttctactaactaggtacttcacgccaagtacttcagaactgagatgaactctttcagctcccagaagaaccagagtgtttggctttgcttacctaagggcactaaggaggtcccagaggatggagggctgaatctcctgagagcatgcttgttgtggcttgtgatcccgaaaggctgggattaatggaactaatgctggtgtgctcccatttgcacttgtgtagactctggagcccgtagctgctgcccctgtcccacacacaggtggctccccagttgtctgaagatcccaggagtgggctctgggacttaagagcttgccgtgtccttgagcaccacattcagacctgcccctaatccctgcgtggcagagccccgcttctcctgtccctcagtgctcacggagtgcatgtggcacactcttgccttaagcccaggctccccacactctgggttgtctctcatacccctccagcctgtgtcgtacctccacctttgcatgcaagagaggttacagtttaatatgacaatctcattatgtgcacaggtggacataacgggcttctgtgttttctagagctgctcttccttcctttagagtagacttcccgttatttcatgagacacaggctgactgatgccactctttcccacattgtttccttcttcagttcttcctgttttttctttagccttctctttcagacttccctcctaactttaagaccctatatatgtatgttgataattttacctgttctacaggaaacttcataatagaactgggctgactatacattctttttctgtgtgtgtgtgaatatatactttttatttagccatttttgtttacaattgaaactctgggaattcaaaattaacatccttgcccgtgagcttcttatagacaccagaaaaagtttcaaccttgtgttccacattgttctgctgtgctttgtccaaatgaacctttatgagccggctgctatctagtttgacggggattctcttgcccacaatttcgcttgggaagaccaagtcctcaaggaaggcatcgtgcacagctgtcagagtacggctcctgggacacttttgcttattttttgtacggctttttcgagttggcttaggcagaattctcctctgagcgataaagacgacatgcttcccactgaactttttctccaattcgcgtactagccggacttggattttctggaaagatttcagttgaggaacgggaacaaagattatgatagctttccgaccaccaccaacttcagtttccttggctgccgtaatattcagctccctgagctgagccttgaggtccgagttcatctccagctccagaagagcctgggagatggccggactcgaactcgtccggcttctcgccattgggcttcacgatcttggcgctcgaactgaacatggctttctcctgggagaacttgcagcgcctgcttaggaagagacccaaatctcgcgagagcacgtcaaaatccctacattcttaagattaattttggggggagtctgtaagatacggttcttaccttcttacctccagcctcagtcctcctggcatcttctgtgttggggcatctttggatctagagcaagcactgtgtgacctgctgtgtgctataactcacggtgagtttggcacttcagttgtactagtctggctagggcagtttgtacaattttacttttctcgcatctttctttccagtacctctcctcctgctgggatttatctacctaaagttgtggtgcagcttcccggcttagtatgtaaatatctcacttggattttcctgtggcagctaacctcacgtacttgccagccaactctgagtatcttcttagtgagaattctgctggggcctgggccagaaagggtgaaagggactaagggactgaggagactaggcagaaatcgtggatcctgggaagagttatgagcacaggttacactagtgactagataaggaagaaaatgtacatgtgagaagagaaagggatgtgtgtgtatgtatgtatttaaattagagcagagtagctacccggaggagtttcagttgactggttacctgaaactagtcaagttacaactggaattgcacagccttcgtcatggtcggtgtgttaatagagcttgctgtgagtgcacctctccctctgatagtaattagcacagagaccgactgcaaaaaacaagaacgtcactacttgatattaagtgactgctgcaggtatttttcctctcaaatgttatgtgtaggccatgcagtcaactgtgaagtgatttggaatgctttgtgaattacagtgtctgagataagttggtgagactacataccatgtagcaagtcatcattagtttagacctaagcaatgtcctgagtaaggtccttgcagccatataagctgtacattgttttgagaaggaaaaacatagaactactgcaaccagccaggctgtggtgttccaggtccctgtggctctaatccatgatctcacagcctgatggtcagagttatatgctggcatcagagcttttagtagaattctgaaaaatgttttgaaaagcaaagcattattttcagtgattccttaaaattacctgagtttataagataccacattggctgcggttccatcttcaaaaaaagtagcaaagaaccgctgtagaactgcttctgagcttttcagttgtctcgaatgtaccaactcaaagccaaaaggaaccatcattgtgtatcaagagactgaaataaatatcctattctcattttctctttttctgtgtttggggaggagaagataaaaggcccttcccttcttgctctttaaatgtactcatgatccattttcaaaccagcttcacctctgtgttttatttcagttgccaaatcaggacagatccttgactccagttttctctttcatcaccacacccattcattcaccaagttctttcagttcctcctcctaaacatctctagattctgtccacttaccagcacacccactccctggccaccatcatttctcacctagaactccacaatctcaattaactattattcccctctaatgcttttctatacaatcaggaaaatgtttctaaaacataagcctgacatgtcagtccattgcttataaccctttagtggcttgttattgcctttacagtaaaattttaactcatgaaatttgtaagactctttacgtccaagttccttcatcacctcttctaattcatctcacctaccactccactgcattgacaccaacaccactttattttaattcttattgaccgttcctgcagtgttcctgaatgttcacatctctgtgtctcctaattttcagtatattctgcttagaacactttcttccaccctttccactggttaactgttgttcatgcttcaagtctcaggttaagtgtcacttcctaaatttaggaaactgtcctgactccctaagtccatttaagagtcaagataggctgagttatgctgcatgaaaggacaacccgaaaatctcagtggcttaacacaacaaagtttattttttatttacactactatatctccgtcatggctcagacagtgagttctgttcattatattttctcagagactcaagctaatagataatagaggccccgccttacatctgattccatgatagccaaggcagggaaaggagtatggtgaatcatgcagtgactcctaaggcttctttcagaaaggggtgtatttcccctcatatttcattaaccaaagcaagccccatagttatgcctaacttccaaggcactggggaaatactgcctaccctgtgcccccgtatcatcttgtatttcccctagcctaataatgtcatgctttgttataattacatgtgacttgcttccccaactctaacttttgtgaaagtaggattatttttgtcttatttattatcctctgcagtgccttcattaatgcttgatacataataagaattcaaaaatatttgttgagtgagtgaatgaataaggcagcactccaagactcaatccttaggcctttttttcttcttcttctgccatttcttcttgaagatggcttcctctgtcatggtttcagcagtcactgccctgagagtgatttccattccctgacttcaatcagatatctccaacttctcacttaatatttctacttgaatttaaaatgtgtaaatttattcttttagtaaatacttcttaattactctctaataaggcattatattaaatgatatgaggatacagaggtaattaagacagcacttgccatctgagggcttgcaatctagtataatacaaaaatagtacaatgaatcaataatatatatacgtaatatacaaaatcctgtgccaaaggagaagacaagtgatttatggcaagatggaattggaacttgtgttgtttcaaccattgaacctacagagcagacatcattactgaattctgttctgtgctgggcactacacataacatgaacagaataaagcttttatccacctcacagtccagtggggagacagatagcttaggacgaaaggatagatggggtttagacagagtgtgggagggtaattagggggtaaagggatggtgcataggaaaacgttttcaccagaggggttgacctgattaaatatctggagaaattgtcagtatttatgccaggaaagaggtaaggaaggaactgaatcaagatggtcacagtgagactctattatggtaacttaattgttaggaatactttaaaaaccaagtatacacaggttgtttttaaacctaacatgaaaaatggttaatatcatgagtttgactttatttctgtacctaattataagtcttcaatggttaaaagatacccaggaaggaatatatgccattccaagcaagatgttggtgcgggtggggatcgggtttactatcttggtgtgctgaggttggttaccaaccagagagagtgggctgggatgcagaaactaattcttactcatgacactgatgagatttcctgagccccacctgtagtctctggaatagtaccttcatttccaaaaaggctagtctcaaggccttgagtacttctattcaacttgcagataagctaattcttctatctgatttgaaattactacatccttgccaggctaaaaccgttccttcactgcttaatttcattctcattttcttgaccatcttaagacagtgcattcatatcttttgtctggttttatacgtacatctatctgatccttcatactcaacctttaattcttttgtaagctcttttaccattatggtctgatttgagttgacagaattctgatctttcagtgttacttttgcttaacagagccacaattcttatagataataaaatggcatctagttttattttacacatctcttgtggctccatctagctcttgagtcattacactaaagtcctgctcctgacacagataccagagaccagtgtgatagaagtgatgggatgtgtcagttgattaatgatcagctagtccccagcctgcccaggtgtgacacacacagctgttagtgctgaaaacagccttagcctgctctctgttcagcggtgatccagtgtgtcaattctaatttattgtagtccaaagtgttggtgttttcctgtgctttgtttagtattgctcaagaagtaactaaacttcttggaaattgtcgtaactgtggaggacagtgagataataaatgactttgttttctttcagatctttgatgatgcgtacaaatcccagctcagttgtgtggttgtggatgacattgagagattgcttggtgagtcctaacttctgctgttgtattatctttgccacattacagctaatatctcaaaagttacaagagaaaattaacaagtatttataaactgtaaagcaatagaaatacctttctttgtcttacaaggaaatataatgttctctcttaaatagctgacatcaatgatagtattcattttaatatgccctgtgactataacaccattataaactgctttcttgtaagggcccatgtctcattttgtatcttccagtgtgcccttgccatagtaaatgattagtaattttcattgatgagtatatctgttatttaggacctctgagctcagaaattcacttgtgaactttgacagaactaatgaaagaagggtttaggatcacagagaaatctgcaaattcactaaaacactaagggcagaagttgtaagctctctgcacctcagtttctgctcttacaaaacagagactataatccctctcttgcttatcccacagagtaattgtgaagacaaaaatgggataataaatcttgaaaaaattttgtaagttaaaagtgcagtatagtaatttttaaaatatgtattaaatatctcctgtgttgaagtgcactcctacagaatacaaacatgaagaagacttggtcctggcacttaactcataagaaataaactgcaaggaagggccagaaagttgttaattttatttcactgtaaaattaaatcagtctgacataaattcattacaacaatggctcaggaaggggtaatacactctattgaaatggaaacccacctggtgacttaataacatctgaaaatactacccagtgtctgaataatcccttcttctttaagctgtccataatggtgtagtcgtgatttcaagctaactgttcttactgcatttttcccatgattttcagacctgcttttggtcctctgttatttatttttttaagttttggcagtgtctgttataaagcaaagcaggtatatctgtgaggtctccataaattgatagtgggttttgggtctgctaggtttgatacatctcagcccagtttatgggatgatttctttaaaagcttttaggcacaaactcatagctctgtgtaaattcctttatcttaacacaattgaggtgtgtggtcatagcaacactaccatgtcaggaatgtgtgccctctgagtacatttcactggtatgaatagttatcatctgtgcatgcttgctcatttattcaataagcacttgctgagcccttcctcctctggtagaagtattagagtctcagaaaaagacgctgctgcctgtctttataacatatgttggcaaatgttaatgcaaagtagaatgtgccatgtattttggatattctgtttttttttttatttttattttccctcccactgttctcatcaggtggatagtctgaaaatggagggatcagttttgacctcagggggcctgcgagtagctctaagcccagggcagaggtgcatatgcagtatgcagagaaagctaagcaggtggcatttacgctgaatcttgaattattggtaaatgtttaacaggtcagatgttctcttagaaagttatctgttccttaccatctgagggccaatcttagtggttctgccattgtttccgttttattgaaattccttattttcccctttgcccattttctaacatcatgttttaatatcagtgtactgaatggccatggtttgcagtaacttcttagaaatgcttggtaaatacacctggaatttttttttccttccaaaataatcccagaaaaaacatctacatgaactcaaagtgaatatttagaagctttttcaaaaaatttatagagccgagtacagtgggattatggcaacctataatcccagctacctgggaggcttaggcaggagggttgcttgagcccaggagttcaagacaagcctgggcaacatagcaagaccctgtctcaaaaaaaaagttacagataagagttcttatattttaagcatttaggttattagagatattttttcttattataaatagttttatgactgttatttaagactgtttactctttaaattttttttttcttattctatacatattctgcttatgtagggactgtgtttacttttgatgcaaaaaaaaaaaacaaaaactgaatgtttggaatatgtacatgtgtatcaaatccctaaacataataatgtttcttttccagattacgtccctattggccctcgattttcaaatcttgtattacaggctcttctcgttttactgaaaaaggcacctcctcaggtaaaataatactactaataaggaatattttaacaaagagtttttcagtaaatcgcatataatgatacaatctttaaataagcaggttatcataaacataaaattctgttgttgaaaggattttgaaaggtcgtccagtcttgacttctgtttaaggtaaattattttatcaacagaatttttccattccttttctgaagaaatcaaaatcccacagtttctgtgtggaatacaacaattagcattgtattttgttgttttgtaagttttccaccatattacatatccctactacctccaactgccaagggagattatgatattaatagagaaggcattgaatatgttcccatatgtttcatttataatttcatgggttttcctaaaaatttgtttatggggatatttaagtttattttctttgggcagttaaaaaactatttttaacagatgatcttgagttatttttcttgggtcatgtggcacttttgaggagtgaatttatagccaggatcttgattcctgtgtttgcatttttactgatgtggctattagagacttgtgattttggtaggttaacaaatttaaaaccaacctatgaaggttggttaaatatgttaattatgtagaggctgccagagcatgtttggctgtgtcacaagacatgagttctcttgattgattctgcatgctgtaaccttgaaaaatgccaatcaaaggcaggtacaaagcagttaagcactgacttgaaaagcatcttaatgtctgtatgagaatctcatatttaaagttagagatagaaactaatctgtaaggaaaatatttactcttaaactggtgaatctaatttttaatttaacagttatatatgtgcgtgtattttgcacttaaaagtaaatgacttgtcttggtttttctggagtttttttttaacttctaaaataatgaaaagaaacataacctataatagtcttgaagatttgcaacatatgtgtactgtggaaggatttttaaatcagcttttcataaaccatcattcctagtaattggagtcttagcttatactaagggtgaagttagagaggtgagtgtattttccctttctctgattcctgcaatattttcttaagtaagtaaacgtatatatctaaagttgctgaaacagaaataattatctacatatatcatgattcctccaatgttttcataaataagtaaacgtatatatctaaagttgctgaaacagaaataattacccccaacatctacatatattatgcacacaaaaaaactttatgtcagcatattaattataaaaactattagaatgtgagactttttctaggcatttaaatttatctcttaaaatagttcttcttttttagctgaaaataatttatgctaaaagtcacttgggagaaggaagattaacttcagtgctatcttatacttcttgttctttacattgttaaatactatacacattgatttaaacagaggtacacccccttggctgagaagcatttgtgatccaaagtagatactaacagaaataaacagaaactattaacgaatgatctgccacactaagatttaagaataattgtttctgtgttgtaaaacttattgtaagatttttgagggaaggaacattatcttatgcttttaaatctcacagccaatggcatagaggcttatacgtacatgcttcacaaataccttatcaacaaaaaaaaatttttcagtgtcttttcattttagtgggctcaagtgttttcatattgctggagtttatatttagacaggatatgataagagtgaaaacattcaaaaataagtaaagttcaaatggccaacaagtataagaagaggtactcaacatcattagtcatcagagaaatgcaagtcagaaccaatagtgagataccactcattgcatacctgctagaatggctatcatcaaaaagtcaggtaatgacaagcgctggtgcagatgtggagaaattggaacctgtatgcactgctggtaagaatgttcctcaaagaggttaagcatagagttaccatataacccagctattccaccaagtatacacctacaagcaatgaaaaacatatgtccacatgaaagcttgtatgtgagtattcatagcagcattattcataactaaacatttatctgataaaatctagtatatccatataatggaatattactcagcaataaaaaaaagtagtaccattacatactacaacatgaatgaactttgaaaacatgctaagcaaaaggagccagtcaaaaagaccacatattggatgattccagttacatgaaatgtccaggactggcagatctataaagacagaaaatatatttgggatggcctagggctgggaggggagaatgagaagagtgagagggtcactgctaatgggtatggggtttctttttggggtgatagaaatgctctaaaattgattttggtggtgttgtgtatatctgtgaatatactaaaatactgaattgtacactttaaatgggtaaactgtgtgctctgtgaaccatatctcaagcgattacattttttagaagtggtttaggagctacttaaatgatgaaaggagacatagagttagaagtgaggggtgagcatccaaggtacgtggcccagcttgggagaaagaggaattggatcatttaaaaagaacatggagtgaatttatctaaggactgaagaggaagaatatagaaatatgtaagaagtaagagatgtggttgccttagtgattggaaatggcaggggttctctctgaagggaataccatctggtcattaatctgaatttggtgactctgacctggactgccagattacctgcagtatacatgaatcagtgacaggataaattaatatttgtagtatttctagttggcatgtatttaacaaaataaaaatgtgctttgtcataccaccttgctttttaaaatgtttatattctctcaagaaaataaggggaaattttcaggctgatccaagtgttaagaatattagtcattgtaaaatggaagcattcactttgtcaaaccattagcatatagttttttcagatgtttttaattaaatattaaaggtatattcagctaaatattgtagaaatgcatagagtgatagaaaaatatttattactggtaagaaaacaaaagttgtgagcatttttctttaaaaggaggaactatacttatatacactacagtaatcatatcagtcacagaatcctcaattttgcatttgttgtatttccagctttcacacagaaaaattgtgtgtgcatgtgtgcacgtgctcaaataaaagaatcccttcaggggcactatgttgttatgtatccagatattctcttttctccttccacccctcccccaccaccccctcccttcttgtaaattggcttattaaaactggttcccaagccctccttttttccctttgtgattgccttggtcttggattttcagtgtagaactaaaaattcaagtcagatttcagttactaggataattttctttgaattttaaatttttctaagtaaatgcatagatttttaatgaacctggtattcagtggatttgctttaaatttagctgcagagttaatttcatgattgatttattagccctttgaaagtataaaaagtggtatctgcagttcgtgaagagtgaaaaacatcatcacattttgtttagcatctttttaaaaccaattaaaagcttttctaaaatggattgaacaggagaaaataaaacatgttccctaggtctttatttcaatcaagtttccctgtgttctgcaggagaagagatcgagaggggatagaaaaattgaaaagggctgtcccagcagggagccaagccggaaaaaagggcttctctgagaactcagcagcagcagctaagaaagctcccagcctgcttcatctacatgcagagtcacacaaggcatgggggtgctcactgtcacacagaggtttcacatgtgcttccctgctgattcctgtgaaaagctaacaattggcttggagggtaaaagaccactgcagttcaccctccctgagctggacgtacaatttgtccagtgttaggaaatgtccggcttagcagtgagaggcttgaagacacccctccttccagtgagattcctaacgccgtctcttttacttgatgacactggggctcttttcaagttttgcagatttatggaagttgaggggaatgtgcttttcaagatcaggaggatgaaagccttggtcttaatgtcaaggaggaagcggtagtgagtggtaaggccaggtaactcttcctgcagcctgcaggaccagtggcttgatttttcctcatagatctcttctgccaccttcttttttttttctttttgggagacagagtgtctgaaaaggaactccttgggctgtaaaatgacatgattccccagtttcctcaacaagtgtgagagtagttaagcctattaacctcactgtttaatgctgggtttgacacttttgtgcatcaaattggaaaacctcatctgtatgtaacagggtagcctcgtaatttatggaggagcaatccttcctcagttcagtgcttcccaacctttttagattatggtgcatacaaaatgataacatctgatgatacacttgggtaagtggatgaggccactcacaactggccagggctctagccttcccaacagctggcaggaattgatatcttagtccaggtataactcatttgaagctcaacgattggaaaactctttggaaactttaaacttttacaaaagaagaattaccactccaacgtcatagcagtattactgaagtagaactcagacctaacagttattagtgttctggctaaattttatgatgttgttgagaatagtaacttcctcgctgctctgacacctaggaatattacctaataagagagaaatacagcttaaagcttggaggacctaaggtgtggaccaataagaaactgtcagcattctcaggatggggacttgggtagacacacttgtttctgcatgagttttgtttttaacatcagcagtctctagacaacattgctttcatgtagtccttacatgacatcttagcagtcttacttcagatatggttataggacatcttggtatcttgataatattaagcaactctttaggctttgggttgctttagtgaaataagcagataatggaagagactccaaatcatgcaggcctaaacatgagtatctctccatctatttgttcaaaattaactctggctaatgactatgatatgactcaataagatatataaccactttaggaaagaggcttagtcattttgccagacacattaattttaatccactgatgtggtgacttttgcattgggcttcatttcttttatctaaaaaaaaaaatgatgcttgacagtttagtggcctgcttagtaagtcagtgacattagatacctactatatttataatattctctttaggtatactttgcttagtatagtagattttcttggaaagtcctttgtagattgaacatgtgtgtgtgtatatatacatatctctgaggacaaaggaaatttccagagatctgtgttcttgttttctggacagaaagataatgtatagtgaatgtatagtgatcaactaagataatgcctagtgaagccctttgtaaacctgtggactacatagatagacagtattaaagaacatatatatatagtacatatatatgtagattaatttcaaatgtatcaaaaacagtgaaataggccagacattgtggctcacgcctgtaatcctagcactttgagaggccaaggcaggaagattgcttaaggccaggagttcgagaccagcctaggcaacatagtaagaccagtctttacaaaaaaaagttagtcgaatgtggtggtgagcatccgtagacccagctattcaggaggctgaggcaggaggatcgcttgagcccatgagttcaagaccgcaggaagctgattcttaccaccgcactctagcctgagtgatagagcaagactctgtctctaaaaacaaaaccaacaaaaaacagtgaagtaaattattttataaaacattgctacagatatctgctgaataaaatcaaattttcaaaatagggttttgttttggttttggtagagcacatctatagtagatattaataccagaataaattataagatatatatgccattttctgataactcaaaattaaatatctaaattttaatcatcagagaaatgctaatagtgttgagacgaaatattttttcattgctagaatgtattcttccagatccattgccttaaataagttactgtggcattacattagcttttgaaaggtggggattataacgtcgtagtagtccatgggtgccatgactctagttaagagcaccctttctgtagaacttactctttgtattgaacttgaggtttaaaaaaaaaaaaaagaaacctatgtcttagctcagatatcatctggcattatagccttgaacgtcccttaatttcttggtgtctatttcttcatctgtaaaatagagataattcctcatgtgttacctactctgttgagggtcagctaagataatgtgtagtgaagccctttgtaaactggtggactacatgagctgtccaggcgcagtggctcatgcctgtaatcccagcactttgggaggctgagacaggtggatcatttgaggtcaggagttcaaaaccagcatggccaacatagtgaaacccgatctctactaaaaatacaaaaattagctcgacgtggtggtgtgcacctgtaatcccagcgactcgggaagctgaggcaggagaattgcttgaacccaggaggcggagtttgcagtgagctgagattgtaccactgcactccatcctgggtggatggagtgagactctgtctcaaaaaaagaattgcctttggatagtccacagaaccttttcagcttgtaagataggaaaactgaagaacgtataataactgctatatagaggaagtttccataggaagtgagttcagagctcccactttggaatgcctgaacccaacttccctcatttgcagtactgggaaaagaaacctgcttccccatctctcattcactgaaatttagaagcttcctacatcctaagacaaatactcttgtctggggattagggattcctgttgtagaaagaagtaggaagtggagacaggaattgccaagatcagtaggccaccaccaggtcacacttgtcttcagcctccagggactggcccacctgcttcctttccctgccaccacctgttgcttgtggctgaagttccccttttctcctaactcatggtgcaacaaagtggtgcttcacagtttctttcctacctttctgtcccagaaacaagaatgcagatctttggagatttcctgtgtccttggggatctcacaatggccagaagccctggccctccctctactccttaccctgttaatcttggatggtaggattataggtgatttcttttttattttgctttattgtttcctgtactttatagattttctacaataagcatatgttactttgataatcaggaaaaaataaaaaatgtgtatacaattatttttaacttagcagtataactgtcaaaaattccttaattccattgctttggtactaatttgctgctaaccactagggttaaatgagactacctttgtatctaagcttgtctatgtataatatatttttaaccttgttctttttatgacttaagatttaattgaatatctgaaatatgctgtgggttttggagtaaaagtgtgcaagtgcctcctaactctcacagttgtcctgggaaacccacctggcacttggctcagtgccatgctccccatctaaacttaccatggttgaatgccagtgtgactaaagttgaccaaggtagatggtaacgattgtcttaagcttcattgaaaggagatcggaagtttctttttcaccaaaaatatttcttttgacatagaagtttaaaacatttctttaaggaacatctgcttttattagatgtacatttaagaaatccttctcagtatagagataaaaagatgaataagacattgtacctgccctcagatggctcatagtccaagaacactgttcaattgtgaagtttgtgcacaaggtgggcacaggtcaagtagcaaatgaaggttaacatccagcccacatgctgcccaccaaggagtccaccctggtttgggactgaatctgccctgagtaaggttaccagatttagcagataggaatataggatacttagttaaatttaaatttcagaaaaacatcacataattttttagcatcagcatatcccatattttggtcagacttatactcaggtatttctctagcaaccctaacgctgaacaagaggaagagggtgccttttagctcatacgaggtgctggggcttggggaaggaagcaagggtggccgcactcacccagatgattgcttttttctaatttgttcacctagggtgtgtgtgcgtgtgtgtgtgtgtgtgtgtgtgtgtgtgttttctgatccatgcagaagctaactggtgtccctgtcacaatccagggtgggagaaagatgtgaaaacatgatgcatagagttaggttttatatgttacgtggttccagtggaacataaaggaaagtgtggtccattttacctgagaagatgtgcaaatcattcacaaatagtagtttcggatcctggtcttgaaagatgagtaaaagggagatttagtcagggccattgtgccatgctaaggaattcaagcgctgcagcaatggagagagaaggtgaaggatttatgtatgctaaaattagcatattattattattattattattattattagagataggatcttgctgtgttgcccagggtggagtgcagtgacgcagtctcaatcactgcagcctttacctcctgggctcaattgatcctcccgcctcagcccctggagtagctgggacaacaggtgcacaccaccacacctgactaatctttatattttttgtatagacagggttttgccatgttacccaggctggtctcaaactcctgggctcaagcagtccacccacctcagcttcccagagtgctgggattacaggtgtgagccattacacccagcctaaatttttttaattaacgtacaatatgatacttgagaatttgaggatatgttctgtgtacttatcttaggcttcatatggcatagtttcactggagggaagaatagaaattcataagaaattataggcttcattttttctaagtgactgaagcttaacctctttaaatatcaattattatactttagccttttttaagaggaaaaaaattgctacatacattcttagtgtctgaagcaaagtataataaactctatgttaatgaataaggaccatcataacaaaccataattgatgggtcagtattttcatgggtgggactcagcaggaactgttggaatatacaggattccgtcctggtgcctgttaggtagatacggtgtgccctgtttgttgagttttttgtaccttttctttttttagtggttttgctatcagctgttacttgcagaatccaagtgagttgtgtcagctggcctgcctctgatgactcctttttccagtgtgctgctttcatctgctataaattaaggcaggcaaccaccaggattcatgagctgttcatacagtaagagaactaaactgtggttgggcgcagtggcttacgcctataatcccagcactttgggaggccaaggcaggaggatcacttgagtccaggacttctagaccagcctgggcaatatggcaaaaccccatctctactaaaaatacaaaaaagtccaggcacggtggctcacacccgtaatcccagcactttgggaggccaaggcaggaggatcgcttgagtccaggacttctagaccagcctgggcaatatggcaaaaccccatctctactaaaaatacaaaaaagtccaggcacggtggctcacacccgtaatcccagcactttgggaggccaaggtaggtggatcattcaaggtcaggagttcgagaccagcctggccagtatggtgaaacccccgcctctactaaaaatacaaaaattagccaggcatggtgacaggcgtctgtagtcccagctactcaggaggctgaggcaggagaatcgcttgaacccaggaggtggaggttgcagcgagccgagatcgcgccactgcactccagcctgggcaacagagcgagactctgtctcaaaaaaaaaaaaaaaaaaaaaaagccaagcatggtggtgcacacctgtaattccagctactcgggaggctgaagtgggagaatcacctgagcccaggaggtcgaggctgcagtgagtggagatcatgcaactgcactccagcctgggcaaccagagtgagaccttgtctcgaaaaaaacacaaaaacataaaactgggctgcagtgagagctggagaggccttccagagagcaaggccccattttgactcctgtgggccccttcctctactaaaaaaaaaaataaattttccacctgttggtacaaagctgaatatattactatattaatattttcttccaccaaaaagttctttttttctgatttttttttttccaggagtgcagtggcgcgatctcaactcactgcaacctctgcctcccgggttcaagcaattctcatgcctcagcctcccaagtagctgggactacaggcgcacaccaccacacccagataattttttgtatttttagcagagatgaggtttcaccatattggccagactggtctcaaactcctggcctcaagtgatccgccctcctcagcctcccaaagtgctgggattacaggcctggcctgattttaaaagaaattagaataatactttcatgggttcctcaaagtttcataggccctgggcactgtgtctagtgggtaagttgtccttgcctgtcagttttaaagttacttgaacctcacattgttttttcagtactaggagtgagaggatttttgcttatttctggttcttggctgtgctctggatagttgaaattgtttagcagattggcctccagataagtaaggcattattattggatatagtaaattcatgttctggaagtttggggcctaaaggagcaatgtgggctctgtagggttaaatgagggcagggtatggtgagaaggcaaattttgaaacattgtgaacataagagacaattgcaaattggcagaaaactggagaaagcattttaataaacaaatgctatggataaaaatcacagaggtaaaaattaaattagaaaggagaatattgacctgattagaacacaggggtcaatttagggtatatcaagctaaaagctgagataggtagggaaaatctactgtggatataagagtggggagtttggatttgctgattaatgtgtggtcatcttagttaagtttctaatgagagagcatgcacagaacccttcctttaaggtattaagaatactatggcatggtcagtacaactttatctttttctttttttttttttttggacaccaagttttgctcttgttgcctgggctggagtacaatggcacgatttcggctcactgcaacctccgcctcctgggttcaagtgattctcctacctcagccccacaagtagctgggattacaggcatgcaccaccacgtccagctaatttttgtatttttagtagagatggggttttaccatgttggccaggctggtcttgaaatcctgaccgttggtgatctgcccgtctcaatatcttcttaatttatttaaccttttctcctaagagcacagaggtcattatttctaggtaataaatctccctaactcaaattaagagatcagccattgctgatatggggcttgtgggggcaggggcaagagtggaccccaaatctagtttaaaattacacaaataaaaacagtagacagcaaagcatagtgaaaatagcaatgaggcctgaactgtagtttcagctccctcactggacatgagagcctcagacagatcactttacctctcaccccaggtttctcatctgcaaaatgagacagagaatgagggggtttgggggaatgaggtaatctttaagagctgctcccaatgtaaaatctgatgattcagtgtctttttcacaaattggaattagatatcctttaatatcatgaagtctgcttttgcctatagtattttaaattattaagggttcagtttctcgtttcatattcagtctgtatcatgaattcccccccttattgtcttctgtcctgcttgcagcaccatgaggatggttacaaagaagtagactaagaatttgcttcagggtaaaatctaatggagagtttaagtgtagttgcctgcctagttgtggcatgatttatttgaaacatccttcctttggtattcagcttaaacatttaactgcaaaaaaaaaagaaaagaaaaagttacaggcatttaaacaagagaaatcagaaatgcatgcaaagaggcccaattcctctcccttcacttgtctctggttgcttttaatggtagtcgatcttttcccttggtttggggaaaccaagagttgtaggagatgttaatagtacttggtttttgtttttgttgttgttgttgttttgagatgttttgctcttgttgcccaggctggagtgcagtggcgccatctcggctcactgcaacctccgcctcccaggttcaagcgttctcctgcctcagcctccttagtagctgggattacaggcatgtgccaccacgcctggctaatttagtagagacagcatttcaccatgttggtcaggctagtctccaactcctgacctcgtgatccacccgcctcggcctcccaaagtgttgagattataggtgtgagccactgcactggccaatagtacttgttatctcactagcttaggttaatgacagctaatgaatcttatctttcctctgctagagaagtctgtgttatccagtcaatagctaatcaattgattaaaagagataagccagactttggcacgaagcatacatgccgttcattctagattattttctttaaaatttgttgctatcaacacttggggctcagaggtgtagactctgaaatgatagttactttccttttggacacttaatataatgtgcatttttctaggaccagaaagtaataatgaaggagtgatctgctacccttgaaagctatactgggattatcattcattcagtgcatatttattaactttgtactttgtacaaggcagtatgctagccctggaaacatcagtaaagccaaaccgacttaagtcctgtcctgatgaaggagaactagcaagaaatacagtaaatatagtaagtatatagtatgtaaaaggcgatccaaactggaggagggaaagggcaggataagggttggggagttgcagttttaaatggaggtatgtggggattgagttggcctgtggaaaagctgacattcaggcaggtccttgacttggagggaaaggcctgtgtggctatggaagggaagagcattccaggcagaggaatcctctctgtgtgccaggcatgccatgctgagtactgcaagggcacagatggatgatacgtggtttctaccatcggggagttgacaggctagaaacaagattcaggcttgaagataaatgcagagaagcactatggcaaggtagaatttttctaagggtctctgttgaataatacaagctaagaaaatatgaaaaattattcctatttcaagaatgaagccaggttaagtgatagaccaaaggacctctaccaggaaagcttcttactcttggctctgagccaatttcctcctcagaagttgctgcctctccctgaggccccacgctgccatgagtccttctgactctctgtgagtcaccccactgccatgactccttcggagggggtgtctgacctcttgcttcaggcctcttctgggcctcacagtaacccttgtgaagctgaagatgggagctctcatcttccctaacccagagccaaccttggcctctctgcgtcatttgctgccagtgccctgtgtttgtttttgggaagagagggattttcaggcatcccgtccctcacccacctgacctaaccgtatggattcctgacaccacaggcagaggactattcttcaggttcctctgaagcccacctgttcagatgcttgcttcttttccttcttgcctgttctgactgtgatgacagagaccccgcctcaggaatctccacctcacactctattctcataagtaggtagaattttctcatcgcatatttatggttgaggaggagatagatgctgagaagttaaataatctaccccaaatcacacagctgtgagtgatggggcctctacttctgttgcaccaagctacctgtccatcaggggacttgcctcaccattgctttctgccagccctgggcttgccttaaaaaggacatcatatgcataagacactggttaaaaggtgcagcatggtccctggagatgctcactcttacaactggcctgtccttggggcagcagctcctcacaggcccctaagaggtagacctcctgcctgtggctgccagaaccctcttctccatcacaggtcttcctcctcaagagccttctctggtttcctgttgctttttatattaaatatttcccttagtttagcatcccgagtctgccttttgctgattgttccctccctgtgtctgcagacaacttcgttttcagccttggtgctctgtctcagctgcttctaccacacacataggatttaggcgcattcaggacctgtcccttcttttcaagggccttgccagtgcctacttgttgtcattgtctttgcagtactacggataaccttcctagataacccccctccaggaaactgtccccataaaccgggtgccctccgccatgattagtttgtatttgcgagtgtgttacttggttgtgttccctgaatatttatttggttttcccagctaagttgtaacttatttgaaggcacaaaccaaatctcataattctattaagtacctaaaaggagtaaattattgttaatgctccaattggctaatgtctatttcatattttacttaccagatttacaaatgcttaatattctgaaatatttcactctcatttacaaaaacatcagattctactaagcagaaaataaagtttaatgcccccagcacatagcagttttgagttgcacttttaaactcacttcttaatccatttcagggttttcaattgttcacagttaattcttcttaccaagggtgtattacacttgctcagcattgaatgatatggaaagaatggcctttctttcctgcataactgactttacttttgttcataggttgaaatcagcccttccatttcactgcagtattatattagtggcatttttatttagggaaaaaaaaaagctttcttccacttgaacttttgttacaaatcagtttattgggtccaatcaatgggcaagacctatgaaagggtgtggattatctggttggtcctttgtgtggcaaaaggcttagatgctgcttagtactcgctcattcttcatcatgtaaagaagtgttttttttgaaggatcaacacctgactgagccctgcctttttcatggaaatgttttcacctgagttgctgcttatggtactaagaattagttaactaatacttatttaaccttggaacaatgtttatcataatccgattggcagatagtcattttacttaggctttttctttatagcatcaggactagcaaatctcagtaaagagtatgctgggagcaatttcttttttcccaaataggttatcactctgtgctttttttttgctttccgtcaaggggcatgtttgggcactgtggacattaagactggtggccacacattaggaaggtggaggtcccctcttgggttgagcaccacttttgtttttaaagctgcatccccatttcatgctgctggcagtgtttcccttcagacgaatcccatgcaatgtatcactttaatatattcggagctgtttttcatgataaagcttccttatgagcactaccactaattaatacacaaaatggcccagcacaatttaataatttggtaatgtttttcaatgttttcttaaagatgacgctttacaagtcaagacccaaacttgcctgggtcatgacctctttgcagtttttggagtcttgttaaacaagaaggaaagcaaaacataaattagcgtctccagtatggttgctctacatttcccaatctttcaacactttgaagagcatagtcactgttaatgtaagagaacatctcatgaggaaactggcagcgattttaaaagtccggctttctggaatgagtaagaagcttcttcctcagtgccactgttctagggccaacattgtcctttgtgagagaggagcaagatgaggaagtttgcattatggactatggaacattaaaaagctaaaaaagagaagtaacagttacctttaatcatactgaggatgtatcagcatgtgtggcctttggcatctgttagcctttagggctatgttcccaagtttgccattagaatttagtgttaaaaaatactttaaatataacagcaccactttttgttatagtaaaaatgtatgtctttactcgattgtaattacctcaacacccagcttttgttgttattttgcccttggacttaggtatttctgttcctctggcttagaatgtccttccccttcatcttcctaatcaacctactcattccttacgactcaactcatgtatcatctcctccagaaaaagctttctctgccacgtgtttcttccctctacctgacatccttgtgcgtaatacctccacctttccatattgtactataattatctattttgcatctgtctttctgtggaaggtctgttgcatattcatctaggaacttggtaaatgtctgatgataagcatttgattttttcctagttgattcctcaaataataataatgattaccctttaatctgaatgctcacaggtgtacttctatctcatattctatgcgcagtcatctgttaagctaatggctaattgtaccagagggtctcaactttgtttctttgatctgcattggtttatggtggtaccttgcccattcttggcacagcaggtggataaaaacaatgagtaacattgagaaaggctaatgtgtcttattgacagtagtggtataatgtttaccaaacccaaattgaaattattttggtttcttaaaatcttttcccgatagcccatttattttaatgttctgaatttccaagatctgtgtataggttcaatgattagtctttactgaagacttatctatggactgagtgtgtattataaatctagtgacataagtttaaaacttattcctttttcattttccaagtaaacttttttagtaatgtgtttttctttgtaaagacaggcagtatatgatttaggtctggatctggtttccagtcttggctccatcatgtattggttatttggccttgaacacaaatgacttgccttgaacacaaatgacttatatctgtgagattcaatagcttcatcagtaaaatggggatagtagtagtactgaattttcatgattataatgaaaattaattgagagactgatctggagaggtgccatactacaaagaggattaagtggaggtgtccctattaaatggcgagatacccagaaacattaccctgttgactccagtatgctggcaacgaggctttatagtctttgggaaggagactggaagattcttctctgggaaaaatgtacacatactgacctttgaaggacccccagtaatcagccaggtcttacctgatcatcctatagtgaagccccccgacacagtatttccattcatagtttagctcttaaatgtgaattagctatccagcaatcaccagacacttgaggaaagcctccagaaaacaaattggaaaaaggggcaagtcataggaaacagacaaaacaaggaacagaagaaaacatcatttttgcaatctataatattcacaagtttgttttttgagacagagtctcactttgtcacccaggcaggagtgcagtggtgccatctcggctcactccagcctcaaactccttggctcaagcgatctgctcacctcaggctcccaggtacctgggacgacaggcatttgccaccacacccggctaattttggtatttttgttgagatgaggtttcgccatgttacctagacaagtctcaaactcctgggctcaagtgatctgtccatctcagcctcccaaagtgctgggattacaggtgtgagccaccggcctcagagatctaaaacaagatattgtattttaattgcacaggatgcaattaaaaaagaaaacattcagaaaacaagaagagctcttagaactgaaaaataagttagtgtaaaggttggaagataaaattgatactaacctgaaaagtattagaaagagaaagaaataaaaactaagagtaaataagaaaattagaagattagtcctagagaatcagtatccaactaagaggttcccagtgggtgatacagagaaaatgaatgggaggaaatctcaaggaaatgtatttcctagaactgaatgattggaatttccagtttagaaagaaggaatctagtgccagcaaaatgagtatagaaagaaccatcttaggatatgtagttttcaaattgcagaacataggaatgaagaaaagattctgaaagttttgtattaaaaaggttagaaacaaaagatcaaagatcagatagcatttgtcttttagccttcagtgccttcaaaattgtgagaaaaaaattatttctaacctttttatttatttatttatttttttgagatggagtttcgctcttgttgcccaggctggagtgcaatggcgtgatcttggctcggctcactgcaacttctgactcttgggttcaagcattctcctacctcaacctcccaagtagctgggattacaggcacgtgtcaccatgcccagctaattttgtatttttagtagagatggggtttcgccatgttggtcaggctggtctcaaactcctgaacctcaggtgatccacctgcctcggcctcccacagcactggaattataggcatgagccaccacacctggcctctaaccttattttttacaactagccaaactattaagacaaaggatacaatagtaaggctagaataaaggtatttccagacatgcaaggtctttaaaattttacctccctcactctttctgaggaagcttttgggtacatgcagcatagacaggggaatagatgaggaaaaggaaggctgggatacagggaatctaacagaagagagaggaaagctccagaactacagctgtgccccaggcctagagagtcaccgcttcagattgaactgtgaacacacaggactcctggaggggaatttcttcaagaacacaactttaaactatgtaatgtgtttgaacatactgaaaggagacttgtgattgttttagagacaaacttgtgataagtacctggtaaactaagcaaaggggaaaaaggcaattaactccagtaaaacaaaatgttgtccaagaaaggaaattgaatagtactctgcatggcctagctgtaaaccacatttgtataaacataataaatactgaatatagatttaactaaagactgtgaaataactgtatcggaaggatgtaaaaaggggcatgtggtgggggaaggggggtagtgcaaaattaataataaatccccatcttccatggtaggaagttagtaaatcatatttaaagctgaaaacaaaaatctaaaaccagtaatgtaacattattatttgaagataaggaagtaaatataagaagaaaagccaagagaattgaaaatggttgcctttgaagaaagggaactgagaatggtagcataagcctggcatagtttttaaactttttttaaaaaaatattttggggttaaaagtaaaaatgaaaaatattaaatgtgacaattatggaaagcactttagcccatgccttttacagttcagtgttgcataaatataaactcttattaccctgctccttctaaaaagtgtactaaagccttgtaaagccagcgccacatactttctattcatttcatcttttttccccaattcccaccatacatgtgccatgttggctctgaggaaggaattacatacatacacgtcagtatctttccatttgtttgtgtatcttcttgatttactaatccattgttttattgatgtgaatgagaaggagctgttcacatgttgccactttctgaatcatgtggttggtaccttttttcaggattttcaggaaaatcctgaattgttttcttctgttttgcctaatcatttgcatcggcaagattaaataaaagtcttttgcaaattgtgttcaagcttactgtagtttcctaattagtcttattatgtacattttaacacattttctccctatgatcagggccgcaagcttcttatcattgggaccactagccgcaaagatgtccttcaggagatggaaatgcttaacgctttcagcaccaccatccacgtgcccaacattgccacaggagagcagctgttggaagctttggaggtaaaaatgagtcaatggattgcacactgtttataagaaaggaattgaggctgaaataagtagtaccacattatacctggtgtttggtttttatgctaatctggaacatgggacccggggatattacaggttgtatataccttatccaaaatgcctgggactaggccaggcacggtggcttatgcctgtaatcccagcactttgggaggacggggcaggtggatcacttgaggtcaggagttcgagaccagcctggccaacatggtgaaaccctgtctctactaaaaatacaaaaattagctgggcatggtggtgggcacctgtagttccagctactcaggaggctgaagcaggagaatctcttgaacccaggaggcggaggttgcagtgagccaagattgtgccactgcactccagtctgggtgagggagcaaaactctaacaacaacaaaaaatgcctaggaccagaagtgtttcagatttcagattttttcagattttggaatattgcattatatttaggttgagcatctctaatctggaaatctgaaatgcttcagtgagcatttcctttgaatgtcatgttggcactcagaaagtttccaattttggagcattttagatttcagacttttggattagggatactcaacctgtacctccagttgttttcaggaattagagaagaaagatgaatatacatgacagtgagttaatttcccattcctcaatgtaggcagctacaaactgccaggaattaattgctctgtatccagcatgagtgatgtatatagattacttggaccagaaacttgaatgggtggtggtgtgggggtaaggtaatcactgtatagaaaaattaaccattcatagtggcttttagcacatttccttgcatttaataagttggaacaatgattaaagccttagaaatgtcaaaaaaaaaaaagctacagaagtaaaaggaactttattaacaagtttagaaatagaaatgttttcttaattttttgaaaatgacagtcatttttaaaaaagaacgttcttcatttaacttttaatatcaatattcacaagtaacttggtgagctctattggaaaatattatctactgagttgttcagcagtggtggagtcagtaaagcttcttaaagtcctcaaggcccccaacaaaattgaaatttatctatatgataaatgttttcaggttacccatgtagacagcttttgtgcagaagctgggtaagagaattaaaggagtttgctttgacacatacagattgttcctagaaaagaatgttaaaaattttaacttatatttattatggattggagctatttttttccccagaaaatataagttacatagcggtccataagaaaacagggtttaagataccagttttcactttcatgattgcacctaatgggtttaggatggtgaaggtcagactggattttaaagtaggagagaattctatcaacttgaacagttaggtagttcttatcactcttcttttaaaggtaaatagaattaaccaatgttgatgtgttcactgtaaaagtgctttgattattgtttattgtttttgtagcttttgggcaacttcaaggataaggaacgcaccacaattgcacagcaagtcaaagggaagaaggtctggataggaatcaagaagttactaatgctgatcgagatgtccctacaggtaaggtacttcgttctccgtatgactcagacagaacaaagcttcaggacacaccaagagggttcagtatttcctttgccaaggttttaattaatttaagttttgattttcttatattatttccaaacttaatttggtattagtagcctgcttctgagattgatcacttaacaatactttttaacttcttaaaattcaaaaatggaaggaaagattataaagttagttttcatttagggagccactaggtcttagaactagaaaagacttcaaagagcagtcgttcttctgccccctcattttggagatgaggatactatgtgagccacaggctgtcagtgaattatccaagatcacatcaccaggttattgatggagaagggatggtgttgcacctcaagtcagtaagcgactgcacatataccaaacggtgtctgggagactgctttaagggacaagttaattaagttgtgcagtctagacttgggatctgtatatttgtccctggctgggctcctagaaatttcatgcaaactactgtagggttgaagcatccagaatcacatagaaaactgagccccagggtgctgcctgggcaaagacagatgaaacttctttgggactttctcatatctcctggcaacttacctttcttcattttagaactccacccttccatgtgcccatgctgtgtcttcttgtccttatctgacatactaggtagctgataaatacctccctatcaagccctatgagttcagagaccttggctcttactattgagtccacagcccctggaacagagccaacacatatgaaggtgctcagtaaacttttattattattattattattttgagacagggtctcgctctgtctcccaggccggaatgcagtgccatgatcatggcttactgcagttttgacctcgcaggctcaggcgttcctcccgtctcagcctcccaagtagctgggactaccagcgtgtgctaccacactcaactaatttttgtattttttgtagaaacatggtttcactatgttgcccaggctggtcttgaactcccgagctcaagtaatccgtctgcctcagcctcccagagtgctgggattacaggcatgcaccactatgcctggccctcggtaactttttttctttttttttcttttgagacggagtctcgctctgttgcccaggcttgagtagtggcatgatctcggctcactgcagcttccacctcccgggttcaagggattctcctgcctcggcctcctgagtagctgggattacaggcgcccacccaccatgcctggctaattttttgtatttttagtagagatggggtttcaccatgttggccaagccggtctcgatctactgacctcaggtgatctgcccgcctcggcctcccaaaatgttgggattacaggcgtgagccactgcgcccggccagtaaacttctgttggatgaataactgtaaattcattttacagttaggtaaatggacagagtggctgtattctaggcatcatgtgttactaggtgttactaggtccatctaggtggacagagtggctgtattctaggcatcatgtgttacttactgatggtcctgcattctgctagtgtgggcagtgagcggcagaggtgaagtttctgtttcacagttacatctgaaataggctcttggaccaataacaaattggaaacgtgaagtgaatgctttttaatcttttctggtaaatttatctgaaaataaaatttttttgactttcagaaatctaatttaatctactgagctttcagatggactatttttaagtcaattaatttattttccattatgagccataaattaaagtcacagactaaccactttgtttagacttattcttggtaaaagtgcaaatacaggtgtattggctctttccttgaaaaaaagataaatctgtcagattgtcagcttctttttttttaagtttcagtataattttttttcaataattgcatagaagaaactatgtggattttttccccaaccctcatccctttcccttcctttgatgcctgcaggtcagtgatcaagttaatgcttcttatgcatgtgggatagagagtgagagtggggcactcaggcctgatcttcagcgactgacatttcataggcctctgagtttgaaccccttcatgtcaaatggatttcgtgcagctgagtgaattctctttagatctgccttagagaggctgaacctaagtgaagaggcatgtagttttgcagaatataagtcgtggtacctctctgttcactacatgctattctgttaaaacttgcacagagctgaggatctgctctgactggatgtcacctgagggaataaagtcatttatctagattacttttttcctccctttctcctgacttttaattccatagctacaggcaagtcagtaagttgttgctcacacatattaaatatatttaatgggcaaagaactgcaagtaccaactacaactgcgctccagccagttcttttttttttttttttttttaagaacttgacaattgattcatatgtaattctattcccaaaaaggaaaaatgtttcttttgttagctattcacactttttcttagtcctttgtagtctgacctcttacctttgatacatttgaaacttctgttcagtgtttttctgggatagaagaaatcttaaaaaaaaaagaaagaaaagaaaaaaaaatccgtggttggagtgggagtccaattgcacatctccccacagctgcactgagcatttgaaagttattcctggagggcagggagttccctcttgggaaacagactcctgctctgaaacatattttaaaagttaggtgtgtttcttacaataaaaattcatcttcaggaactaaagatgtttttaacgattgttttctagataacttcatatctcctgtgggcctacgagaataaagtacatttaacgagttagtataaatatgaatagaaaatgaaaaccagtcgagatagctaataataacgacctgaacgaagcacctgaaacaaagttgcgccatcttttcttagactcatgacacattcgcagtcacaggagacccagattcatctggagatgatttcaggaatcagcagtactcttcatttttttagttttagcacaactttgttactacaaagaagaaactatatgacggatactgaggctaagaaaagctacatggttggttatgtagagttaataagctattttttagttgttgaattaacctcaacttggtatcttctactttgctgtgactttagtagccttttacaccttcaacaggtgaattggttgtcatttgaactctgatgaatggccctgtccagtctcacagcgatgcctcacaggcatcagcacagggcacgcctggcccaagtgcctatgatggccagcgggcttgggtcttttggaacccagtgtacatagttctggaaaaccccattcacttcctccaaatgatgtgatctgctttgttttgtgtgagaatgctggtcaaggagcaggtaacacattcagtgacctagcagagcattgatgaagtgtgaaaccgaacactgccttctcatgaagcaagtgcagagttgttagaaggtaccattaacccatcttcatttcttctgatgtatttagatggatcctgaataccgtgtgagaaaattcttggccctcttaagagaagaaggagcgtaagtacatacaacatttaatgaccatcaaccaaacttaccaccctgttaaatccctgtgcctattctaagagttgctttcctagataagtttgtttccatttatttgaattcttcgctgtgttgtaggtccgagagaccaagcaaggaagttggttgtactgttggtttgctctccctgtcctgcttcgcaaaacttccttgtcacaatgcaggaaaaacttaatggtacatatttattggaacctgcttttacatgcatggagctgtgaccattttcttttgtgaagtgctcatctaatagcaaatgcatagtgggaaatgtaggataaccattaagaagcttttagtgatttttttttttttttttttgatgaatagttttttacggaccctcatctgtttttttgtgttttggtatttcttttgcagtagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaatgttctgtagaccagtgtttcatatagaacgacatgaacagctgataggaatggaggaagaaggagggggctcaggaaagaaacctctccgtgttttgttacaagtagcataacatgagggatgatttttattttaaaaatctcttatttagaaagtatagttatttaaaaacatcattagagtatcagaaaaagttaatatacaaccatctttatgctttatacttattttatcttactaaaaaaaaaaaatgcctggcacggtggctcatgcctgtaatccgagagggaggctgaggtgggtggatcacttgaggtcagtagttcaaaaccagcctggccaacatggtgaaaccctgtctctactaaaaatgcaaaaaacagccgggtgtggtggcacatgcctataatcccagctactcaggaggctgaggcaggagaattgcttgaacctgggaggcagaggttgcagtgagccaggatcacgccacttgcactcagcctgggcaacagagcaatactttgtctcagaaaaagaaaaaaaaaaaatcaactcaggtacctaagccacaaacaaggttagtaataaaccagaaaggagggttgccactcaattagaattactcctttctgtgaaatgtacaaaccaaggaacttcaaggctctcagtgagattgcttcacatggttcacttttgtatcctccatagttttttacatttttctgagctatcagatctcttaacctcctaaaccttgatccttagcattggctcagtttaggacaggaggcagctcagaaagtccacaaggccctgtggggaagaggccagcttcaagaacttccacaacgggagttcctgggaggaggaccctgaggccgacctggtccctgcatagccttgagaaggtgggttcttgaagctgcccaaatattcttcaaagccagtgctgtacagcagagcgtatgagattacagaacggcctgtgaagaagcaaaggaggctccagctagctgctgccttaggtttcttcatctataggcgaattgttaaccggctatttttttgtcataagatgtttttgagatcaaaacctcaaaagaggaggttattttatcctttctaaatttgtacatcttcactgggacactttttttcaatgtcacacagaaaaattgcataattgtggttaaagtcagaaatatgtttttactttaaggctgtcttttcatatcctaaaaattgcagcctcccctttaaaagtttcagcaacaagtcacaaaatcatggagtagattgaagtgtgtacaataatcaaatcctgatcaacagacttgttgaaacagtgagtcagctataaacaaacaccccagcccaaacacagaaggtgaaagcaggatttcattttccttgcctgacaacttggtccatagcctctttaaagaagtgactgggggcagccgggcgcagtagctcacacttgtaatcccagagctttgggaggctgaggcgggcaatcacctgaggtcaggagttcgacgccagcctgaccaacgtggtgaaacaccgtctctactaaaaatacacaattagccgggcatggtggcacatgcctgtaatctcagctacttgggaggatgaggcaggagaattgcttgaacctgggaggcagaggttgcagtgagccaagatcacaccactgcactccagcctgggcaacgagcaaaactcttgtctcgaaaaataaaataagtgactggggaagggtgtgtatgagagttcaagaaagcaggtaagttgcagaatttattgcaaaatgatgtagagtttctcatcagctggcaagccgtactgagactgggtcctggagacgagcccacaagggtgtgtgctggacgggcaccatggcataaagatgcgggagatagcgcctgtgattggcaagcatcccaagtgggtgaagacaaaatatccaaggagggatcatgtttgaaa

SEQ ID NO: 12569 - DNA, 200663 bp, Human
  misc_feature (1)...(200663): n = A,T,C or G
gtgtgtatgaatattcttacacacaactttgtgtgtaagctttggtgtaaagaaaagctttgggaagctttggtgtaaagaaagtcaacattttcactgcctggttgatgattttctgctgaggtctacaggccagtacatccttcctgaaggaatccagatcaagagacatttacgcagaggtatctgtctgcctgagaagctggtcatctccgatctccagcgaggttccccagagtgcaaaggaagacagctgtagggcttagagtcaggatccttttacagtagagctagcagctcttggaaacgttgctgggctttgctgtgtacttgtgctgatttcaaatcttgttaagccaagaagtagtgcctggcaaatggttgatcctgccttggctattcatgcttcccaattcatttttattgtgctaattaaacctcaagtggtatttcaagtacagattgttttttccattattgaatctttggccagcatattaacgctgtagaattaacatgagtcagatgcttacttatttgtggaagactttacatttaaaagatcaagacttggccaattttgctcagattcctttggaaactgcgatgacagggtgatacaatttctctataaataaaggagactcactcttctacagaatagacacgtaattatttttaaatgaaataattcctttatcaaggaatcataaataccactttatcagtggtatttatggtccatgatgaaatggatatgtacagctcgggaggtagtggtgaagaccctgacctttgagttcaaattctaggtctatatgtactcggacaatgttgaataatgtatttgacttttccaaaactcatatacttcattaattaaatgagggcaaaatacttatcttcaagattggttctaaggatgagataaaacaaggtactaggcaagaatatctggttcagtgaatgctcaataaatgataatattagtatcactataattaaatgcttttagagctgttaattatgtaagcttgagtttgaaaaaaaacccacattagattttataggaaaaattaacattatgacataacatttcctactgagaatctctttattttaacctttctctcctcagaatttccaaactattagatacatttataaaggtaggaaattcatcccatgggtttgtacttgaaatgccaaggtgggtgtctttaggcttcatcagtggggtctggctatggagggggtcataccttgagaacaagcaccatgacgggccttgactctgatggtcaccccagagtcagcagataaatctataaatatagaaagtggaagagtcggctgggcacggtggctcatacctataatcctagcactttgggaggctgaggcgggtcgagtgcctgagctcaggagtttgagaccagcctgggcaatgtggcgaaaccgcatctctaccaaaaatacaaaaaattagtcaggggtggtggtgtgtgcccattatcccagctactcaggagcctgaggcacaagaatcacttgaactcaggaggcagaggttgcagtgagcagagattgtgccactgcactccagcctggttgacagagcaagactatctcaaaaaaaaaaaaaaaaaaaaaaagggagagggagagtcaacaaagcacaaacacttgcaagctgaaaaagcagatggttgagtagtaactgacttaaagggtgagaatactggttaccaagttgacaatggagaaagccaaggggaaacttggtttatatggcagaactactacaatgcttagagtgtgagagtacagggaacaccaaacactgtattggttgaaagtcggctaagcccaggtgactgcacctctcctgcctcagcagaaaaccggaggcttaattctctaaagtggataaaacaaaggttctgagaaactacagatagagtgaggccatgggaaccataaagaatatgatggatttacatactgaatattaatatttccagacctctttctcctccaagcaggaaattggaagagcattatttgaataatttgaccacccccttcctcaaaatgatttcatgatcctgacatcaggtggtacctagtaaattggccaataatattgtcctacaatgaagatgacaattcataaatttgtgcgatgtttctagtaccccattcttaaagatgtatgaatagccagacataattgaggaaagcttataattgaaagataaacacaaaagcaccaaagagagaaagagaggaaaaaaatgcgaaaaacaaagctgatatagagaaaagaaaaattcaagaaatgattataaatatatgatagaaatcgtaagagacattgcatccatggaacaagaagagggtgctataaaaaaagaacactcaggaacaaaagaagggccttgggaataaaaaattgacagaggaatgaacaaccttaaaagggggctttaaaggttaatctaaaaaaactccttgcaaatagagcaaataaatgaaaagttggaaaataggaaaggattagagaattaaatggactatctataaggtccaacctccaaacaatagttctaagtggtaagaaagcatgtgttatagttatattggcacatttttttcctttcatagtggtacatataacggtgttgcaacctgtaattaataccattttaaatttgatgaaataaagtaagtattgcatattagatggttctggtgttagtaaggcttgcatactcataatactcataataatcttttttttttttttgagatggagtcttgcactgttgcccaggctgaagtgcaatggcgcgagcttggctcactgcaagctccgcctcccgggttcaagcaattcccctgcctcagcctcccaagtagctgggattacaggcacccgccactgcgcacggctaattttttgtattttttagtagagatggggtttcactatgttgtttaggctggtctccatctcctgacctcgtgatccacccacctcggcctcccaaagtgctgggattacaggcgtgagccactgcacccggccacatactcataataatctttatgtctccattgagacaattacagcacatgaaaaaatgtgaagacagagtatgttgaatgtggtgggggccatggggagggctggcattctgtgtgtaagcgagcctatatttcatcttccacagtgggaggtcaatagatactgctgaaacaggaaaaccaacaagtagcaataaagaatgatacttagtgatgagcagagcaataccaaaagaagaagttaaaagagatgaaatgggtgcctcagggaacaggaaatagtgccacatgggtaaggtgggactactgtttttcacacatagtagcttgaatctttttcgtaatttttatagaattatcaactcttgtgactaaatatttgatttttgaaaaacaaaattaagtatatacatatttttaaaagtcacccagattatgccattgacttcaaggagatttttcactaagtaagcccatttcttctattttgccttgacatgctctgtaataaactgaacagcttaattgtcatagaagttgtgaagaaaacacattgagaaaaacaacagactcatctaaggccacaaagttagtatgtgccaggtttagggtgtggggcttgtattacactctgttaatcattgttatatatttcattgccctgtataactctggctattaggggcttttttttttttttttttttttttgaaaccccatgaaagatgtaacattggtctctattggatgcttacgggaaggaagagtttggaagggggggtctcactagcccctgaaagccagatcttattggggaatcctctcccagtggtgggataaccatgaaatatagactgtacaaatcttattccagtctgatttcactaataaagaaagatggctttgccggtaagaatacatgataagagaaaggtttatccataataatgtgaagacgaagggtcagatattgccaggtgggtgggttaattgcaatttaacggctgttgaaaatgaatcgccttctttgacctccaggttctgatctgagttaatgatgtatcatagttcttcaagacatagctgtcgggtgactatagtcccaagcagagttcctgacaccaagagagggacaggctccactagcaggtcctgacatattgttataccctctaagacatgcctacgtgtaaaaattaccatgattcttatgcagtttaaagcagtgtccacactcagttggtgtgataatttcatgaagtgatagcagcatccctaaaattacacatagcttttgaaatataaaagtataaaaatgatgctttgctggactattaaaaatgtttatgaggttcaaagtttcatctgataaatacattctcagagtctttccaataaaaagaacttttcactgaaatgagtccaacccattttcattatattccaaacaagatagcaattttacctataatatttaactatgatttatataactttgaaactttctaacactgcaatagttcaaactgcctgtctttgaaaaatgctttgaaactacattttcttcaatagaatgagtctttcaaaatctgtgtctggtagagggttagatttgtgagagttacttaaagcaaaaaacagatttttgcaaaaacaaaataggtgcatctcacccttttgtgttcttgagcattagtaaaaaatggggggtaggagacaggaggaaataaaagacatgatgtcagtccttatgtacaatctctgtttatgtgcaaaaactggattagtaactgtagaacaggaaaagaggtggaagacagttctttatactagtgttcttgaaataaaaggttattcggcaataatgctttaagtaaagtgcataatttattttgaaatctaattatagctttttttggtttatgttagatctatgaagctgatcaaagtagcactttttcagatcaacagaaatcagtctcaaaaagcaattaaagattgatttttaaagcataaacagttttcaatttattgcttttattttgatactgcatttaactatttgcatatgcctctgtttacttttcttgttccataggtttgccatctgcaaatctggccgcacctaacctcactgtggaggaaggaaagtctatcacattatcctgtagtgtggcaggtgatccggttcctaatatgtattgggatgttggtaacctggtttccaaacatatggtaaggcttgtgtttggctgtgtcttaatagagagacaagagtgtttcagaatgcgagaatgtattaaacctagtgatgatcatttgatattttataaggctacatatagaaatttacaaagagtttttgatgtacattcactttctacttattcttaattaataaagactaatgcaggcttgcattttagttatgcatacctaagagagcgaggagtctctatatccctagtgagctctttgtatcatcctgaacaaagcgagtgactttccctgtggtcttctcccttggagggaattcagggatcaagtcaacctcatgcacttagcaattgaaacctagagaaatagaataacttctgatttacttcttcgcctgagcccagttcaggcagagaagcttttctaatgctatatatacatattttctctagttaggggaagaaaccccaaatcttgtcactttgggatcaatcctaatcaaggttatttttgtctgttaattcatttgtagaatgaaacaagccacacacagggctccttaaggataactaacatttcatccgatgacagtgggaagcagatctcttgtgtggcggaaaatcttgtaggagaagatcaagattctgtcaacctcactgtgcattgtacgtaatcagactggcatgtgtttttaatagcaaatgatcatggacgtacctacgtttgttgctggggcactctgggtgctgcttaaatttgttaaaaaaagtatatgcagtgttttgtgcatactctattaagaaacattatcagcctcttttactgttcaatttctgcttaataactcttgctcatgcatgttttttcttttaagcttctttttcgattttgagcttgtcattttgtgccttcctctgtcttttttctgatagaatatactttgggctggttgctccctctggttaatgttttagcttaaattttcgtaaatcagtttctaaaactttcttcctctataaaagcaatatgatgctttaaagttatgatacctaaagtatttactagctgttcacaaatgcctaattgtactgttgataaaataaaacctcattcttttgttatcaagtttctgtgagaaggtaggattagtcctacttaaattactgaaaattattatcaccggtagaaaacttttattattattgttttaaatttctgtatacattgaatctaagttcaaagatatccctctttttaattaaacataagtacattgtttttcagtattgtaactaatacaatatacattttgaaattccaaattatggcttttagcatgaaggtgtatattcagtaaaaactatatagacacttcacgtcattgtaaattctgagctggcacggtataaattaatgaggttttactctatttggattagaatttggatgagaaaaacatgaacatgcatgtgtgtaagtgtatgtctgacttacacacgtgtagacccatggccatagctggtatcaatatgctggttaacactcactcatagcacacattcagtgtgtgattgctggagtgaatgattgaaatcatcagctgtaatcctttatcattgttagtacaatcactatgcccagtgggtactaaactcataatttctcatcattttgacccactcagaagcctgaagtcaatgttatctccaaacatatgcaagcactttcaactgtatgtccttaaatcagcacctaacccaaaattcatttgagcatggtggaaggaatgatgggccctgggtgtggggacctgggctggtgggaggaaggtaagtgtggcccctgccccactgtggtccttgtagtggttggttcatagcacaggtctacaagtgtgtgtatctacacatgcatggaccttattttgtgtaatatatatatgtacattatatatattatatatatattatgtatatatatatgcatatgtataatatatatagggtctccccaaattatattttaattgaatttttatagatgaagtcacatattaaaaacttttgttttccaaagactattttaaggaggcctgtgagagatatttggtaaagcaaacaattaaactttgcccatttaaatttagtaatatcacatttctcagagtgagggacatagtcacaacatacatgtgcagagttcagctgcacaggtgctcagttgagaggaatgtcactggtaactggaaatctttccgtaaattatgaaagtgaattgggtccttttatcggctttgcttcttcctaggtagtactgtgggaggatttacctgaatacaagtaagggggtaatatcagattacctgctttctattaaaaatatccaaacttgagtttttttctcagtttcaggttaatatctgtatggtcactaggctctgaaaaattgaccttatctgtcatagtttagacaaagagcagaagcaataaattataaataatattaacaactggctgggtgtggtggctcacgcctgtaatcccagcactttgggaggccaaggcgggtggatcacttgagatcaggagttcaagaccagtctgggcaacatgatgaaaccccgtctctactagaaatactaatattagccggtcacgatggcaggcgcctgtaatccaagctactcggaaggctgaggcatgagaatcgcttgaacctgggaggcagaggttgcagtaagctgtgatcgtgccactgcactccagcctgggtggcagagtgagaatctgtctaaaaaaacaaaaaacaaactaaaaatattaacaaccaagataaccagtgcagagaccccactcagagggtttgtctgttccctggctacaataccttagatttttttctcctcttgtttgatgaacacatacagtcaagaagcagtgcctgagagggaagggccactgtattaaacatcaggattcaagattcttgttccagatctgccttgctcagtaaccttgatgagctcacttaacctcattgcactttggtttcttcatctgaaaaaaatgatgctattagatctcaaaggtcttttccagtccttgattttgtaattaccaaagccagactacattaaaatgaacagatgaagcattttaaataccctcacttaggataagtactctgtttaaaaattctacttgataatgtttgtttccccaaagcataaagtgctttatatctaaagttgaaataatccctactctgtccaggcttagattggaccccaaacatttaaaagatctaaacattggcatctaggatcctagcaaaaatggacaacactatcatgaaatgtgatactttcaaagagtatttactattgacaatcagtaataaatgttgatttgttatatttataataattcatcatcagcagcaacatttattgcattgatcagtttgatctgttttcgaagttatgtgagatcagggcttcaggcaaaattttaaaagtcatttttgttatttaggaaagaagtgctatcaaaaagtattcattattttattattttgagtttttttggtgatgaatctgtataatatcaagatacagatattagaaaccaaagtcaacttcaaatgaactctttccgctgtcagaaatctcttggatctgtttggagctggttttcacttatactgaatagatttgagaaatgactgtaatgcaggggtcttaagtagaacagagaaaggagtctctctgaagctctctttggggagttacatccaccctgatgatgatacaaaatactgatggattccagagtttctgatgatgtgtttttctaagccaaacaatggttgagtaaaattccctatcaatgacacagacatctcgagatggggagaattctgagctttctgatgctattaactctctctttttcaatttagttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgagtaactgacacttttgtatgtggggagaagataaagtctatcattcacctgttgacaaaatcatgtatacaataagccatcccccaacctagtggcttaaaactccattatttagtgttgctcatggatccataggtcagcggagtggttttattttgcatgtatttattgtggaattcagggtcatgaagcagcagctacataggagatgtgcctgttatgataagtgtggagtgaaagaggacaactgcaacgatgtgaggcttcctaaggcctagattcagggctggtgcactggactgtctcttcagcttatctgccattggccaaagcaagtcacagggccaaagccaagttaaggggcagggagttgtactcctcccaagaaggtgatgaggaaattaataattttgaacagttatctgatacacactggattaataactactccaggatgcttgggtatcttatgagaaaagggttattattattatttccatcactgttgcaagtatttaatgagattttgtacccacaatggcaaaacccatgcaaaaccgcaagcgcaggaactgtgtatggttggctcgtgatgcatttaagatttattttctagcctcttacctaattcaaaaaggagaattctggtttctcatccatggatgagaaattagtgtcttggactgttttgcttacccgggctgactgagctgagtgattcttttattggctccggagctgttttcctaggagtggtaatagtgcttctctggccaaaggctaggactgcggaaaggatggctagcatcaggggtctactctgggcacagcaggagcgtgtcagtgtgagcttcaggaacagtgggacaagtgtcatgcatttacctgcttcagatgctgtccttcagtggagtgttcttacctactcagtctcattgcccaaatgcttgctaccaatgtggtggccaaggcctgtgtttggatgttgggagctgtacatgaatagagttcctcatcagagtagctctgagtcagtcaaagtcatgcaaagatgacttggtggagagaagggaaaatagaaccctggggagacttgtaaggcaggggctgcttgggctgcatgtacctgtgtggctcccagggcccccccaccagcaaaggtgatccatgcaaagccatctctgcaaaacaataaacaagaatgcagtccttctcattacatgataagttcctattattttgctcttcactagacctctttttaaatgcacaagcttgcttagtatattcaaaatgtgatttggaatatgtgtttgatttataaacagtagcccttcaggagcacataaaacaagcaatatttggatgcaaaacccagacacccctggctgttgctgtcttttccattaaatcttcctcttaattgagagtttagctgcttggctatggttgctgcagtaaatccctagcttgcagtgtgcaggaagtcatgtttgagggaataatagcttcacagttaaatccagagacactgatttaggacagtagctttttgcttgttcttacataaactttttatttctgaataattttagatctgtagaaaagttgcaaagatagtatagagcgttcacagccttatcacctcccccaccattgttaatatcttacattactttggtacatttgtcacaaatgagaaactaatattggtacattactaacaactgaacttcagacttatttgaatttcaccagtggccctttgaaactcttgggggcaaaacttgattcagagtgaaggtctgcagtgaaaagctgtcagaagtggtctgagtcttttgatatcaatgcacagtactgttggtgtaaagccagtagcttctgttttggaaaggattttgatgtctttccttttgaacatttctatatggtactgatatttggtagagctgaactcttcttatccatgtggcctcattttcattgatcatttctgctagtttttacttagcttgtgatggggaagaattgttttctggtataagaataacttggtgcttctcaaacattccctttaaaagaaataattatttataaaaaatacaacttaggctaaattttataaatatgtttcctccccttctttctttccatcttcttgttcatgaatttattaggtccttaaaatattaataactgctttcagaaaagcccgtttttttgttctctttaagtatttacttaagtgtcagctatcaaggagtaataaatgaaagtggaaatgaaggagacttggcccagggtgacagtggatataaatggccctagtgggccataaaccagtgtgaccgattagagattgaccccacttggcttgggaaatagaatcgttgtgggtatttatgagactcacaaccatagcacacagacaatgacctttcttagaattgcttcctttctctattaacctcctttaaaactaaagaaaaataaacaaatagcaaaaaaaaaaaaaaaaaaaaaaatccctgcttgtctaaagtactttccaagttaacaacagcaggtcaagtttggctttatattccattaatatttctgctattatcatatgataattgatgaagaagtttagctctcacaaatattttttataagaaatttcagctactttctcccagttgttttggtaagatcccccccttccctttttttatttgttatattggaagtttcccggcttacaaggaagcaggcagcctgggctcactgtgaagctagttgcatttccatacagagccataattaatgtgacatctctggtgtcgcttagcgtatgtgcacctcattcagcttagagcagatttctgctcgggcgcgctggctcatgtttgtaatcccagaactttgggaagctgaagtgggcagatcgcttgagctcaggagttcaagaccagcctgagcaacatggcaaaaccccttctctacaaaaaaaatacaagaattagctggatgtggtgtgtgtgcctgtagtcccagctactcgggaggctgaggtcagaggattgcttgagcctgggaggcggaggttgcagtgagccatgatcgtgctactgcactccagcctgggtgacagagccagatcctgtctcaaaaataaaacgtaaaaaataatttttaaaaaagaactaagatttccatgggatggtcattttgcttaggaacttgtttttgaaaagagagaataaagactattgaaagaaactgaagcataaataaaccaaaagtctccaaaacaaaaattggtgaagaggaatggaccaattggatgtaatgacagtcctcataacctttacttccgcttgggatgcagacactagacgaggtggcagacactctgttctctacttggaggaaggatggggaagttcgacctcaagacagcggcagcccagtccaagggggtgccagtcacagcgtgtgaggatgtgaggcaggcattaaaagagagcggcccagcaaaccaagatccccgtgtaatgtatcttgagagtgctgggccttgcagactctgccatttccccagccagcaggctaatgtggaaggacaggtgctagcagatcttcagatgtcagcaggaccccagacaccaagccagcgcccttccccatctgttaatcactggtagcctggctagtaactgagaaagagaaaagaccttcccagactccagatactaaatcgatcactttgggtcccacatttaagaattgaacttagctctggttagtttgggattgtgtttaaggcaaaaaatgcaaactttcagcttcaaaatgaaatctagaaaaccatgatgtttctcttccagcacactgaagagtacaacttgtgacaatcagactacaggagttttatgttacttttgttttccatcatgtctttaaaatcgattcagtatgagagatcttccctggttcccagaacagtagcttcctgccccttgttgcacatttgaatcaactggagactttttgtcactattttgtttgattacatttttaaatacacattcctggggcctagctttagcaactcagattccgtggctctgggatgggagttgggctttggctttttttgtttttaaggtccctagtgattctaatgagcaaccaggagtgagcctcactgattggaggagaactctgagctgtgtaacatttttctgcttttgattgagtgacaaacaatcctttggttattttcagctgcagatagaatctcaattgagaaatggcatgtcccacctgagctagaaatgaaaactctggatttgagctcgtggccagtctcctgtcctccccaagttcaggctggcagtatggggtcagggatggagtttgttgaagtttcagtgtccctgctgcccaggtgaaagggggtggagaaggagatgacagggtagttggctcactagtggctttgtgctcttggaacctgggaatgttcaatgctgatgtgccgactttctttcctggatacctttgtgggcttttggagatttctctctctgtatttcccatgacatgaacaaatgtgcctctgctccagctggcacaagcaactcctaactccaggaaagtactttatgttgttggggtccctcagcaggacctgactccccacaaagactttctcctgtgctgcctctggactgcaggggacactcatagtctcttgtcccctaggtgtacaggtcaagccaaatgccacctataccccatggctgcaggtttctttcaccttctctggcaagggtcaggccttgtcctctgagccatccgtttgcagagaacataattcaactctcagagtggttccatggaagccccttggtggggtggtgtcagagcagcacttccctaaagaaacttctttataaatccttccttgttctctccttccggggatatcttacactctcaaggtgaatcagacatttccaaggacataggtccagttctcagccagttcctttgtgatttctgcctctgagtgcctcacatcactttggtataagttactgaggcaggaagagtctcacttaacatcctattatgctagaatctagggattttgaacaatgtgccagctgtctttggaggtatgagaaacagagggtcctgggctaccccttgcagcgagttgtaacacttgagacaacgtagaccctacctcttaggaaggtggcaggggtggggtgcaggatggtgggaataaaacacagcctcttgcccatataacaaaagacaccctagccaaccataaaatataaaaggtggagaaacacttggctgcttattcctgtcccctgttcctctttgaggttgcctttattctggttgtaagacatcagcttctcattcccagggatgtccctgccttgatattaggcaggacccagatgaaggtatgcagaaaatataggcaatggaggacaaagacacctctttaaatcttctttcttgtggaagccagggaacagagactattaaatggaataggtggaacctctaagattttacttctaatgagataaactttcacttattctcaattcaaatgactcattcagatctgatgtttgaacttggaatcctgagcatagttagcctccactttccatattatttaaagagcagctttgctgcagtgggaagggtttgggttttgaactcagatctgattcagtcacagatctgagttccatcctccatgatctttgcggctttgagcaattttcttaacaccttggagtgtgaagcgtgactttccttctccataaagtgtagggttctagccccaagtagaggccatctgcctgtcatgtgtcagccccagcttagaaggttgccgccttgaggctgagcatatctgaagtgccgatgcagtgcctgacacatgataggcaggtgctcagtgttatttatcctctccttaggtaggcattgagaatatgataaaggaggcgaacattccccacctccctttgtgtttatgccctgtagccattagggagcagctttctacccagaaatgcttttatctcagactaactctgcccttccttattcagaagcatgggcttgcccagaaaaaggatcttgagactctatcattttactacctgagctttctagacttggcccttgatatgatttggctatgtccccacacaaatctcatcttgaattgtagctcccatgatttccacgtgtggtgggagggacctaatgggaggtaattgaatcatggggtggatttttcctgtgctgttctcatgacagtgaataagtcttatgagatctgatggtttgatgaaaggaagttcccctgcacacactcttgcctgctgccatgtaagacgtgtcttgcttccccttcactttctgccatgattgtgaggcctccccagccatatggaactatgagtcaatgaaacctctttcctttataaattacccagtcctgcgtatgtctttattagcagcatgcaaacaggctaatacagccctttaaggagaaaattaagtcaaaaatttgacccacctttcagagggtgggtcagtcttagatctttctgctgtctaagctcttttcccccttctccttttcatttggaatgtagcctagaaatgtgctgttggggacaaaaccaatctcctgtcctttcttcttttttgtagctatggtcaaagataccctgactccaatatttaggtacctggctattactttgtgtttcattaaaaaaattgtcatttttttgctgagtgcagtggatcccttgaggctgggagttccaggccagtctggtcaacaaagtgagaccccgtgtctatgaaaaataaaaagaaataaaaataaaaattgtcgtccttcatgctcactgagaccttttgactctggtaaaacttctcagtgagttgttaaatcagggcttctcgaactttaatgcacataccaaactcctggggaccctgttaaaatgaagattatgattcaatggatttgaaaatgggccaaactaatgtatttctaacaagctccccgatgatgccagtactgctggtccatggatcatactttgcttagtgaggatgccctgcagaagctggagggaccactggaagaactggtcaggcatccatcaagatgacctcactgactttccctgaggatatcaaatagtaataacaatacaaatatagaatagatggtgcacagagatgccctttaattggttttggcataaagttggatgaattcaatatgtggcttaagaaggctagggagagtgaacaaaaagtagagacagcagttgcaggcacgtacacacacacagggtggggttatctgaggaatcttcaaaagttctcatgtatcctatttagcttaccagccaaaaagaaagacttgtctaagatgaaattgatccactgtatgtcagtcattgaaattcaatcctccatataaaaatcccttcatgaaccagaaagtgtacatggagactgagtggagattagaagtgatgaaggtttctttttgagtagaatttgaggcagaaattaatggcagagagatcacttatgatttgttgtgaggaagaaacctgaagcctttgttagcattttctgatcagatagcccaagttgcaacaattttgaaggccaggtagtcctataaatgtgaacatcacgttgatgcaaagtagattctgttcagaatcattacccaagtgatttaaccctttggcttggaacaaacctaaccagagcaccagatgataaaataccctcgttttaaagcttaccattctttaggcagtacataaagagtgtctgtatggcccactcattcaggaagaatgtcacagctcaagaatgctcattcacacaagcagtgggagtcagtgacttgcgcttcctaattcgggagctcctgtctcctatgcgaaatgcgcgtcaggaacaaactataaatattggaagagcttttcccacagcttctccttccgtgctgttttatcgaaagattcatgacatctggatgaactagagctctctgcggcacttagaatgccccacactggtggatttagatttggtgtacttagtctaaagaacgaggggagaggaaatttctccaaatgttatgcattaaataaagctctcctggctttatactatttgttcctttggtcttttgtcaggacctatttcttgtcctggaggtgaaggagagaaatttatgtctgcttttctgccttaaataactgagaagagaatgatttggccatacattcagaataatgataattaagatttatacttaaatagcttcttatacctcaggagtgctaatgttagttaattatgcttcccaaagctcctgaggaattgccagagccaatgctattatcctctcctgtcttatagaagactccattgttacagaaaaagtggagactcccactgctatatagcaaatgagtggttcagccagaaaggaaaccagatattgcaatgccaatttcaggcgctgagttcagcctgcccttctgaaagagaagagaagaacctgaaaatcaaaaggctgatccccccatgagtgagaaaatactgtcggcaaagcaaggacagtttatttgaatagaacaaatcttttgtaattgccttatcatatggaattctttgaaatatttttcaggatcacatgatcacattaaatagagtctgcaaatagaatggatagaaaagtcttttctctctctctttttctttaggtagagcattagagggagactaaaagtttaaaggaaggaaacagatgtgtcttcctggcctccccattattttttatcttgttagcagaatggaaaatgaaccctactgtcaggctacctctcttcccacaatatatttttttttatccaacaaacctgtttttcctttaactatagagtcttaacagttgaaatgtcataaagatgttttctctttcatcaagatttacataaagtcataagattattcatgagctataagtgagtttagaagatggaaataaaaaggtcctattttaggttattttgcatggaattaggaggatggtgcagtgcttgggtttgatgctgttggggaaagaggaaagtgattccatctttgatgtgtggaagaccaaatgccctcagggctcatctgcctcttggaggtgcagacctcactggctccctgggaagctttgtcaggagtgcggctgtggctgtgatacagttgctatccttcttttactatttttttcaacttgtattttagaatcggggtgcatgtacaggtttgttacgtgggtctattatgtgatgctgaggatggggatgtgactgaacctgtacccagctaataagcatggtatccaataggcagtttttcagccttcccccccatccgtctctctccatcttcagtagtcccacttggggcacttcaggctgtaccgtggactggctactcactttcggtaattcttgacaacattccttaggtcaagaacaaagtaaaggtgagtatggcaccttaggatgctcaacacgttcttcagaaaacaggatttgaccatcagatctgcagaccttggtacttggccttcaacctctttcagctgaggaggagttgcagcttacatcccagtgagctgtggggatcatagacagtctgctgcttgtttggaactccagtgggttgaatagagttcctggatttcaatattttattccactgtctcccaacatgaagatttaaggcttgacgctacttcttgctacctaaatctgagatttctgatttgatgagcactactaggatagcactcaagaaatcataataaccctttcaaaaccccactttcaggggcatggctcaagtcagatacagcttctttgtctttcattaattctcttcttcttggatttttttctcatagctagtgtttgtctttcctcagtgaccttttagtcctgaatatctccaacagggcttcctaactttagcatataacagtgtgcaacagtatgtaatgaaggaaccatttagaaattagacttaaaaatggcaagacattttcaacatctgaccattgccagaagtctaaaaagaaagtgatacattttttctgtcagcatttaaaatgatgttaataattaccttactgttggagtgtaaatatcatgggaggttttgctaaactaggaagttgctggaagcaaaatacttgatgagctggggtcagctgtagtaatgtgaccctcacttttcataaacattaggtctctatcctctcacgtgccagtctaactaaacctttgtatactgagaggtgtttatttgttgtggtgagtagacctttgtcagacatagtgcagtatgcttgggagaaataaaagcaactctgttatagttcgtctcacattgtctttctgcgagtttcataatcttacactaaatttggctgttgtggacaaaagtaaagtgacagtacttgtcatacatctgggaggatgaaattaggaaaaaatagtgcttttcacaaagtttagatatggcctaacagttttgctggtgaacttggtaggaaaggcatgcgctgatatgggtcataagactggatggacactgacctatttttaattaaattaaattaaattaaattatttatttatttttgagtcagaatctcactttgttgcccaggctggagtgcagtggtgtgatctcagctcactgcaaccaccgcctcctgagttcaagcgattctcgtgcctcagcctccagaatagctgggactacaggcatgcaccaccatgcctcgctaatttttgtatttttaatacagatgaggtttccccatgttgcccaggctggtcttgaactcctgagctaagatgatctgcccgccttggcctcccaaagtgttgggattacaggtgtgagtcaccacccccggccctggcctattttttagattatgggctaacgtctttatttacgattggaccccaaatcccatttttccatacctaacatttgttacagtgaatagatgtgatgttcttggatcttcctaggggcttcgtgtgggtagtgtgtttggatgttcctgttctgcaacgtggcagattaaacctgtatgtcattcatagtcactgaggccgtttaaatgtgtggctgagataaatctggctctgaatcctcaggcttgtcactttcttatggagctgtaggtgtaaaagcgatggtgaccacaggcccttctctcacatgcggtgggggtctgtgggggcctgagaataaatcagtggccaactcctcccaggctaaggagtgaaagccccagaactagaaaaagccctcagtcctgggcagatggaaaggatgtggctgggagtgtccccgttttaaaacttgtaaggaatcctcttagttcctggcagtctgggatggttggccaccctactgcaaatgaagacccacatacttatatccaaatatttaaagattataaatcaaatcagtgaatgtgaattgtgaaatagagtaggttccaccttcctgcaagacaaatgtatagttatgatgacgtggaaggctggatttgaagttgaaaatctcatattgtgttgaaaggcacatcaggaagagggacaagtgaaatcttctaaactaatggattactgagtactttgaagactgacttgctctcttgggcttatagaatctttccttcagcaggggtagtaaattcccatggtgagggggactccatttggtctagggcttttgtaaagggaaaggacttcagaggacaactgagtcccctgcaagtgacatcaggagggcagccactgggacttcttgctgctgctttattcattgagttagccctcaaactacagggcagctttcaagactcttctcagagtgttataacagctataagcaaccctgacaagacatattcacatatgataactcaaaatgagtttgaattggtgtttgggataataaaattcttcaaaatatgattgaaatttactggaatcaatgactttgcatacattgatacagtgccatcatatgtggctgcacagggtgtgcactgcacaatttcccatcacatgtggctgcacaggtgcacagggtgtgcactgcacaatttcccatcacatgtgactgcagaggtgcgcagggtgttcatggcacaatttcaggtgatgttattcacatggactacaacattaaaggcgccccctagagttgtgcgaagcatgcactatacagcagtatgcagcatccctggatggaagtacacagccattcatttcattttttttccctgctaaaatagatatttttctagttgaaatgcgttacaattctaatttgaacactggggccacttttatttggttcttcatttagactaaccttgattattcactggggaatgcatgaacagaaaattggctcatttcgctttactttaatggcattttcctgctaagggttcagaagtgaaatgaaaactgagtaagctttatggtttacaagttttactgtttcacatggcaagtgaggactaaaagcataggaaatagctttggaaattcattttgcaatcacttaaatgttaaaacaaaatttaatttcatttccaagtagactttcatgtagagacccagttagctctgattggagaataagtagcaaatgtttttgttaccagttcttgttgatgctgagttaaaaaaaatgtttttggcaagtctcataggaataccttaaagcagaatattttgatcatcttggtgactgcagagccatcctccaaaattaaattgataacttttacatttctctctgacataccattttttaataacttcttacacatcaatgatttcaatagaggaagtacattttatttttctttgttgtgttagggcttaaaaaaggtttcttcagccctagaaactcccctgaagataaggtggagaataaaattgtgctttagatagcattatgcagggtggttaataacaagctcctgaatgcaaatggccctgctacacagttaacagtaaccctcaaaccatcagagaataacaaaagtggtacgaaaattatttgtctctggaataaaaataccgaaactgcaatgaaagtagccaattgtataagagaaacagtaccaaaagaagaaaaatggtaataattcattgattgctgaagttttttcaaagcaatttgtgatctttttttgtgatttgttttcttttttggagggatgaaagtgggagaaccggggaggggaacggagttaatgtggaacaactcaagaacttaaagttttgtttacctgtcctgtgaaagcagtctattaaattgcaaaacttcagtgtatgtctagcttattttagttgacataggttagtaattttttgactccaaaatgcatacttacaaatctttgctctgttttgccttttaggtgcaaacccaaattatcctgatgtaattatgaaggtagctatcgtgttttctactttgtatttctttttcaaaatgtttgtgtatcatgaagtaaatcaactgaaagaagactcttctaagctcagttaaatttacactttaagcattacataggccaaaatagtatttcaaaaaatcattcaatattgatggccgttttcccttgacatttacagtgcctgtaaatagcactttctctctcataccctgttcttggaagtagtgaatccattccgctggctgtaacagacatcgtatttccttaattgggaactaattacctgtttaaaagccatggctaccaagaaaagggaggtatatcagtttctggctatgacagtaaagccaattcaaaatgatgtttcttgtgtaatgaaggtgtttggctcacagatgggaacctcaaaggtagggcttgatttagggttggttaaagcagcagctccactatgtcatctgggacccaagttcccttcaccctactctctttttcccaccacgccagcttcactgaaggctggtccccttgtggttacaagagaatgtggcgggggagctgctgccattcacaaggatgggagaaagggaagcgctcctgaaggcgtcctcaaggaaagagaacttcccaagagacaagagccaagccctctttgtatccaagtcaagacccaattgggtcatagtccattcttgcccttattactgctaagagggatggattatcccttcagtaactaaattcacccccagactttaagtcagcttccccgaaggtggataggcttaaccccttgaaaaaaaaaatgggattctctcaggaacgtggaaagaaagaaaccaaagtccattatattagttttttttttttttttttttcccgagacggagtctcactttgttgcccaggctggagtccagtggcgcgatctatgctcactgcaacctccgcctcccgagttcaagcgattctcctgcctcagcctcctgagtagctgggattacaagcacgtgccaccacactcggctaattcttatatttttagttaagactgggtttaccatgttggccaggctggtctcgaactcctgacctcaggtgattcacccaccttggcctcccaaaatgctgggattaccagggttagccaccatgcccggcctatattagcttttgatggaatatcgcatctctcctttgctgttttgatcgaatgccaaggatgttttcctaggtgtgaaaacccatatttaacagatttccaagccagcaagccactgtttggggaagtggaaggctacatttcaagacttgctttaaatttaggaatgattaaaagattgattaaaacattacatttatatattttctgtaaaatattctgttccttaattttatatttatatatattgattgatattttattttttctataaaatgagcctgtctgtatgtttattatatgcgtgtgtatttaacctgagctaattttaagttggggaataatattgtctttacctgcttgtgcatgttaagccatatttcttccaagctgtggtttggttgattttttgcatatgatttgtgtgttgttgtgtttgtatttgtcttgatatggtttaaaggaagaatctctcaaattgtttcacagagaaatacgtttgaattgtggttttacatcttaaaattacatttttgaccctttcccagttaattcaagactttaaaaatgtcatcttcctgttagcctcagatcctactttggatcttttggccaaaatgtcatgatactaaactatagacacttgaatgatttaaattttgcagacgtagttggctataacatgaagagggaaaactaaacaaataaatgatatccattagtgtttaaaattaataagttttaagatattcaaaaggaaaatgatgagaatgtggttttggcattaagaatgaaacagcaaacacatagaaaatagatttttttctgttattttttattcacaaaggaacacattgctaataaaaatacaatttaaattggttgccctgaggccagcatgatgattctacctggagaagtttagctggggctgcattaacaaggtagcctcttcaggatggaaattgaaggcagtgtacctatttagaattaaaatacaaacattataaacctcattgtttgcaataagtttaccaagagttttctgagaccttttatatgcaatattgctaataaaaactttgacaacccctgaaaaaaaatcagtcattatttctatcctgacccatgtagactaaaattgatccagaaggcagcaactgcatttgcgacttggtgaaatgagaacagagcgttaacaattctaagtattgtgtggatctaccttttaatcattctgaaactgaaatattggcaattcagaactcttcaaaaaagtttacgtgtggacccaagtttcatactgatgcttgttccacatatcctcttacgtctctgccctttgtgcaaataagttgcacctgtcctggaaatcagtgttgctcatttcaaatctggcgtcacgtgtgagcgctaccatcttcttgccttcacctggtcatgtaactttcctccactgatattcttcagctgtaaaactggtagttatgctctgtctctgaagacctttccgggtctataaatctatgacacgtagatgatcgattccctgtcgtacttgttttaaatatgccatccataaaggggtatatgcttatgtgcaaagaaaaatccctgaaccaggtttggggctgaccaacaagacaatgatgtaaaggtctgggttgaataaaatgtgggcgttgtgcagtctcagcgctgcagtgcattgaactcagcagcctggtcacgtccctccacagccagactgtcgggggtttggaatctttgtgatttgtcttgcttcattctggctcttactgtggccctgtgtttgttggcagcttaatgacaacttcatgttcttcctcattccccctttgcccacttaagattatggaactgcagcgaatgacatcggggacaccacgaacagaagtaatgaaatcccttccacagacgtcactgataaaaccggtcgggaacatctctcggtgagtggaataaataggtgtctgaattggttctgagcattttggatgcctccatgttagaggaatgtagctgcttcaataagacacttttattgttcagatataaatagggtgttaacacctaggttggaagaattaataaaaggcttaacaaaagtgataaaggtgttatatggcctttgacttatttgctgcttttgtgcaccacttttggttgttagtggttcctatttcaattatctgtgctttagaagggtatcaccagaagagcaagaaaccagctttatcattcagggactacaccttcatacctgtctccttaaatttttaatataattttgactgctcgctagatgtagggaatccagtagcttctgaaagggactggcggtggaggggatataatcatatgaacaaaattaagattagttgtttagaattcatcagagaccctggaggtgaatattagcacctcaaatacaaatagaagcagagcaaggcagtacaagagatagaagtggaggagcagatgttttgttccttgtagctgggacactctgaggagcctttgtggggcaagtgactttttgcatggcctgtgcagaagggttgggattttgacatacaggaatggaagagaagggcatttggggcatgtgaacaggagcttgtaggtggagaaacatcgtgaaggtgcttgattggagggtaaggcatgtgcaggacagcagggttggagataaagattgtggccaggttgtaggtcttgacacagagtctcaggtgtgtagatttatggcacagtgaagagccattgaagagggaagtcacatgatcccaggggtctatggtcagttgctctggtccgaacccaacaacttcctccagttgtttcttttcctcactgtcatatgcacacagagcttcctgtgagctctgcctccttataaattccaaatctgtccatatctccttacctccactgccactgtcacaggctaacccaggggttggcaaactatgacccatgggccaagtccagctcaccacctgtttttgtatggttttcaggctaagaatggtttctaccttctaagtggtttaaaacaacaaaaaagaatgatatttcataacacacgaaagttttgtgaaattaaaattttattgtccatgaacagagtgttactggaacacagtcacttgtgttcatttacgtactgtctgtggctgctcttgtgctccgatgggggtggagtagttgcagcagagaccatatggcctgcaaagtggaaaatacttacttctggccctttacaaggaaagtttgcctcagttgttctttcctgcatgaccacgcagcctcctaacccatctccctctcccagccttgtgtttcctggtcttttcccacacagcagccagagtgatctttgtaaagtgcagatcagatcattttttttgttgttataattctcagagtcctctcactgcaattgcaataaaacttttcatatgaaagccacactcttcatggtggcttatgagccctgggtgacctcgtccttcccgagctctctgacttcatctcccacgctcttcttactgcttgccacctgcctttttcatgctctctccagtgctccagtcctgctctttgtacttgtggctccccatcccaggcatttgcttcctgatggccatgatgtggcttcagctaggtggccagcatgcagccattgcccacttccattttcttctgagcagttatcattgtctggaatgaccccatttatttgtttgtttaatgtatttttctcttctctagattctttagtaagactcttagtaggggcaacgtggtcagtgtttttcacagctgtcttcttaagccttcagaatactggctgacacctagtaggcacctagtacattttgcagactggctagacttgcagtgaacagtatagggcagaggaattggaaaggggtgatccattaggggtttggtggagcaataaagacatgtgatatatacttgaaccaaggccacaagagtggaaatgggaggtgcgtaaacagatgcagtgcaactgcaactttatgcatatctagtatagaggtatgcatgcatgcacatgcacacacgtatacacacaaacacacatgcttccgtagatgactatatgcattacattgaaatagcaagaacaaataccatggtaagtcaactggggaatggtatctgcttcctgccgtatgcaatcattttagtttttaattcttataccaatccacttaatatttcttggtgtaagaaagttgtttgtgtacgtaagaaatccaagcagcatgtattaagcccaattacacaaaattatatgttgactttagttttctgggttttttttttttttttttttttgtgatggagtctcactctgtcacccaggctggagtgcagtggcacgatctcggctcactgcaagctctgcctgccgggttcatgccattctcctgcctcagcctcccgagtagctgggactacagccacctgccagcatgcctggctaatttttttgtattttatttagtagagacatgttttcaccatgttagccaggatggtctcaatctcctgaccttgtgatctgcccgcctcggcctcccaaagtgctgggattacaggcatgagccaccgcacctggccttctggggtttttaaaatacaaatgataaatttaggcacctgattggcatatctccatctatagtatagttgctggaaggcaagatcagtgagtttgtatattatgactttgcggaaggctcctaaaatctgtatgagaggtgcaatattgtgttttgtagaatttgtgtggttcagatattttatatataaagagttcttgatcacaggagggatcattagattagaagagtttgagagccaagaagcagatacaaaagttaaaaatgtttctggtccaacaagtgctcttccagcattttgttggatttgcaggggagggcagatctcccttgttctatcctaagaaatatcctcagatgaaaactaacccatcaagcagccaaccaaccaatcaaacaactgaccaaacaaactcacccatgctcatctcccgtgtaaaaaccacctcaacacatgcaaggtacacaaaattctgtatttctcaatctgattttgaggaagttattcttttcattgtcaaaggcatccttgtttacgaaaggatttaaatttagaatggcttcagtagctttaagtatttgtttacagatccttagctgcttttcagcagtagagcccacttcccattttctaggttgacttacacattctataactaggcagagaagccagggcaggcattactgtctaatgaagaagcagaagcttggataagtgaagcatctgttctagctgtcatgactggtaaaagcaaggtgtcctgtgaacgcagggatctaggactcctaaatcccagttaaggactgtccaaagcagggaagagactgtactgtggtactgctgcatggttgggggactttcaggccaagtcatctaacctcccccatcgcagttttcttatttatcaaatggagtttgactttgtttatttaggtattctccatctatctgtagaagtctgcaatttaataataaagaaacttatagctaaaatactatgatctctttcccatgaaaacattagttagaaataaagatttttaaaaaacacccaaagtcatgaggtcagcttgagtgaaatggttacgtttatccataattagctttgtaggagttgctaccattctgtttgtatataggctgcagagacggagttagatctgtattggctgggcatggtggctcatgcctgtaatcccaggacttaggctgaggcaggcggatcacctgaggttgggagttcgagaccagcttgaccaacatggagaaaccccgtctctactaaaaatacaaaattagccaggtgtggtggcacatgcctataatcccagctactagggaggctgaggcaggagaatcacttgaacctaggaggcggaggttgtggtgagccaagatcgcaccattgcactccagcctaggcaacaggagtgaaactccgtctcaaaaaaaaaaaagtctatactcaaacatttgcagaagcgtttttggggagatatactcacagttaaagtaccagagaagagaatgatcattacttttgctccacactggccaagagctttgtatgtcttctttttgtgctctgtgatttatttaatgctcttctcatctgacatgaaagatggtgtcctgggagaattagccatatgtttttattttcctgccttcattctcaaccacatgctttgcagagacagtgtagtggataaatcacaggatttatacttgggcagacttggttccatttccaagctcagaaggtgtgactgtgagcagcttacttaatttttttgtaaatcttagttttttcatcatcatcatcacagctaacattaatttattatatattgtagtagatactgttccaaacccattacctgcattaactcattgaggatttacaataacctacaaagtagaataattatattctccatcttacacatgaagattatgagatgcagagaggttaagtaattctgaagtcatgcagcagagtgagaaatctagattttatactcaggaaaaacccatggtcttaatctctaccctataatgcttctcactatgagatgggtatatcagtcagaataagctatgctgcagtaacaaaacctccacatcttggggacttaaaacaacaaagttttctttcttgcttcatttcgtgtattggctaggagctctgttcagccttgtccttgttccaggactgtggatgacaaagcatccacatttttaaaggttagcctttttctttatgacagagataaagagcactgtggagcaggtggagcagggttcctcaaccttggcactattggcgtttggggataaataatcctttgtttggggggctgtcttgggcacagtaggatgttaataatgcctggcctctacccactaggtgctagtagtactttccccctcgttgtgacaaccccaaattgtcaagtgtcccctggatggcaatattattgtccctggttgagaaacactgccttagactaagatcttggacaagaagtgaagttctacaccctggcagtgacacaagtctgaactagtcacatgaaccacttaaccacaagcaagccaggaaatgtatcctacaaagagaaacacagagaaaaccagaaatattagacaaacagcattaatgattactatggatagggataataatatccatcttaaaaattgttgtgcagattcttaagccagaatggctctctaagaaatctcagagcaggcattggcgactatgttcaagtccagctgctgccattgtaaataaagttttattggaacacagttatgcccatttgtttacatatcatcattggctgctttcatgctccaccggcagagctggatccttagttgcgacagagactgcaaggctggcaaagcctgaagtatttaccatctgacctttacagcaaaagtttgccaactcctggtttagagaagccaactgtttttggaagcaggactttgggctgagtaagactggaaggagacacatagtgccgctgacaactttgctctaaaatgttaagatgcacttagaggagcatcatgccttggtcagcagcaatggtagcagagtgatcgcatttctatgtgtacctctgtcatctctacctctgggatgggagaggattcacatatatctacatctaccctcttgacttgtgtaatccacacctggcaattacatttttaaacttacttaaacatttttaggcttatatcatatatatgggaaaatgcacatatcataaatttacaacccaatgggctttgacaagtggaactcaccccagaagtgccctcctgctcccttccagtgccactcactgttcccagggtaccctgacttctaagagcaacaatagctaaccttaaaaatagccttttattatggacaattttcaaacatgcacttcagtagagagaatagtaaaatgaaccccattgtattcttcaccagcttcaagaattatcgggctggatgcggtggctcatgcctatattcccagaactttgggaggtgtaggtggaagaattccttgagcccgggatttcaacaccagcctgggcaatatggcaaaaccctgtctctgcaaaaaaacttaaaaatgagccaggtatagtggtgtttacctgtagtcctagctactcaggaggctgaggtgggaagataccttgagcccaggaggtcgaagctgcagtgagccatgattgtgctattgcactttagcctgagcaacaaagtgagactccgtcacacacacacacacacacagaaaaatcaccagtattttgctgttcatatttcatattctctctctccctttctctgcccacctctctttctctctctcctccctctttagatggatggagagagagctgtaatatttttaaaatgccaattggatagccatttttataagctttaacttatgttttctcatttgtaaagtaggcataataatagatcttacatacttcactatagggttgtcgcagattaagtgagttggtgtacataaggctgttataagaacaagtggtaagcattcaataaatatgaactgcctgtatcattatcatcgtcatgatcatcatcaccatatgattatagggaactaattagcaaggttataaccaccctcccttcctttctctaggtctatgctgtggtggtgattgcgtctgtggtgggattttgccttttggtaatgctgtttctgcttaagttggcaagacactccaagtttggcatgaaaggtaagaagggttgtgtttatttagcttcttatgtggatcatttttggcttatgactaatgctaattaccactaaagaaggaagtggctagatttatgatgattaggttttaaggctaaaaaaatagcaacaaggctttgatactacaaatcaagacggagcaaaataatgttgattactcagcactacccacttttccatgagaacagttgtcccgggagacagaactgggttcttgagtatcaagggactaataaagatatgacaaagaaatagtacttgatgtttcttttgctccagaaaggcaggtgagacacagtggggataggataacctggacacatgtattttgtgcagaaaggtctatgctgctgtacatttgattcccaaatcttcagtggtatgcttttggtgttgttcctgcttttccagatcctcattctttgaaatttaaacaacagtgttatgaagcaaaataagaacagctatcagcagtatatagaagcttcgtgaatacatagctttttttttatttaagtggaaaaattagcagggctagattaaaaattaggcactaattgacccaaaatagataacttgtctttttttagaggatggaaaattaattttacagggaaaacttgtataaatttcttgttacataaaaaatgccttggagcagtgatttaatgatttaaaaccatttgctctgaagtttaaacttatgtattggataatatgccagtgttgtattttgtgtggtctcctatagatagacactatttaaaagtgtctaaatgggaatgctgtgaagaaggtttagtggtgtcttagttgtgctggagagtaggtcaggtggattttctttatctgtatggtctgttagaattatgggtaatgttgctaatattgctatttacttgaaagggaatgtttcagtagcaataagttgcccagcatacactgacatctgggatagagcagatctatttctgatgtttcctcttttccctttgttggtgcctgtgaacatttctaagccagaaatgaacagggaggagtggtggtaaattggggcttaaaataactcaaaaaacctcgtcctggttcctgcttggccagctgatccttgatgtttcttcaggggaggaaagatctttcattctccaattataaataaagcttgggagagggaccaccccacagtgattttaattcatcctgtggggtggttctcaaacttgactgtgtgccaaaaactcctataggacttgagaaaacacagattcctgggctacccctagagtttctgctttagcaggcctagtgttcacctgacagctggcatttctaacagtttctggagaatactgatcctgcttgccctggttgttgtgttctctacacaacagtgtagggaatcactgttctctacaataaacatgggctgccaggcccccttcagaatgtgacaagatgttggtagagacatcgcaaaccaaactcacccacagctttgcacacattttgggatccccatatctcaactgcacccaggcccaggctaggcggctgctctgtgtgtgccgcaccctaccatggcatttggcggttctcatgtttatcaggtgctttccttccttagaggcacttggactggatgtctctaaacatagatttcactggaggctaccaactaacattagagtttctggtcttgaagggtttagtttgaaatatttcatcccatgagctttttggagagaggatatacccaggttcttctgggatctcagcaaaagctaagtgggaatccatggagcaaaatttaggaacttcttcccacccttggtttaggaaaatcactggcagaattaccagtaaatggcaacctactccttacaatgtggcaatggaggagaaaaagcgtagacattttctttcagagaagaaaattatgttgcatattgagactccagcactaacgctgaaacagtatttcatttagataatttggggtgattaccactaaagcgtctacgttttctgagtataacctgagggcatccttaatgaattataagaaagagtgtgcttaaccctgccacagagccagtaaatggcttcctacagcagtaactactatacatattgtatgttttgttccctcattcctacacacaaataaaatcatttttagaaattttgtctcagagacttttttttttttagaatagcttactgttctattttaagctacatgtctatctggggcatgatgtgaataaaaagagcctgatctagggttattgttttgcaagtcagatgtcgagttgataaatctttggggatctagaaattaagatatggttcatgtatcaagtgcagatgaaactgcttaaaacgtggtatttaaacattaatgtgagtcagtgtattttaaatgctattagagctgagattaccactgaaaaacatatgcttaaaaaagggaagaaaatgtaaaaacactattatgcttccgaaaataaccaggcaatgtattagttgtggtttcttagtaacaacggtatgaactgtgcatagctttggccaggactaggcaccatgtaagaggcttgtggctgctgtgcagatgagctgttcagaatgttattcctcccttcctaagcatctttggggagggtctaagctcatccttattctcttttgctggaggcagatgggacaggaggaaggtggccagctcacccataggcactcacagctttttgcccatccctagcaatgcgtggtttatttcgagtgttgactgtttcaatctgtaatggaaaactcgagaatataaatgacagttcaatgctgctgatatgaagggcccagagaaacaaaccccagaaacctcttaaggtcaccacactacagctgagtgcagggcaacacaagctttatggattggcctgagatccaccccttactcctgcaaacattacttatggtattgctcccatggggaggtgatttctaaattccaaactagtgagtgaaacttggatttgtaaatgcaaccagtgaattgcagtgttgtctttgaagatgggtctgcaggtctgtaagcttcgtcgggttttgttccttgttctgtggattcatcgtaaaccaaatgctgatggtccactccagaacaggcagcacagactttgagctccatggtaacagcattcatatttgtggtgttcatctttatctactgagtgcctagcccagagttggcgctcaatacatattaacgacagaatgatcagagaagattttcaactccgtccacctaagttcggtaattggaaaacagttagtatttggaggatggctaaacagtgagtgactaaagagagaacctgagacttttctaagtttctaaaagagacaaagtcccacctcttttttttttttttttttttttttttttggttattccatatgagtcatggccatagataagagatcagtttgtcccggttttgtctcagggtatgtaggttttcacacactgttttcaacaatcgtcattgtttaagtttggaggattcactttgactttttattttgcatgtgaacatcttcaatttctacctccctacctttgaatgtatcgttttggaatatgttgttttttcagttctgaagttggcaaaagtgctagattggggattttatcttgtggtaaacctagaatttatgttttattcttgcttgatagagtttaagcttcttgctgctagtgtccaataggctcccggccctgtttccataaagatgtcaaggggtagaatatctcccagtcagtttttccttgtttatttctgtgcctttacactgtcctattgcttttttggttgatatgtagctaccataattgcagaagccaaataatgcccttctgttagtgttggccatctatgtagggcttattcatacatatgtttaatatgtatgaataaaatgtataccaaatctgtctaaatctatgtcggtatcaatatccctatatgaaaatgcataatattatcccttttcttctaaggctgcctctggtttgttttaattttagttttcactgaagtagggctgaaagaattttccagaacagctccattgccaaaggaataggcaaccatgcctttgaatgctctccttgtgttgtaaccaagtcttgtgtttagctctcgcattgcttcctggctccgtgtcttcactgaagacgtaggagtgcatgtgaggggaaaatggaagcattgaggagcaccagagctgccaagtcttcaaagggtgctccacattgggagccctgcctgtggcattgatggtgtacagggttgcaaaaaatataagggagccagcagggaggagggagcttggcattcatcaccctgctggaggatagtttcggctatcagttttgtgttatttacatttcctgatggaagtccacatatgatatctaattcctaagtactaatgcagcctttgtcactcaagagtgaaatatctaaatgaccctaagaaatctctgtagaagagactagaagaggaagctttcttctcattcagtgctaatagactgcacagatttcctctgcagcctctgattcttgtatgtaaactcccctatccacattcatttgtcctacttaagtgttggaggtttccaactagtaaaggctggaaagctaccctgccttgggatgcagatctgggttttcctaagtccagactgaaggcccacagttcaactttctgctcttataaatgatctctgagtgtctttcaatagcaaccaaaaatctgcctatttaaaaatagtcataaacatagcggggccaaagctaaagaggttgaaggttaaagccttttatatgagctgaaaacaattctgggaaatttaagaggttgagtttaacagatatttggatcaacttttaagaggaaaaaatgtgaccaaaagccagaaacacagttgtagaaacatctgtaaggacaaactgttttccatatgcaccctcttccttcttcttttttttaaagaaaaatgccgtcaaaaaattagaatggtaacaattgaatgcactcttgtttttcaaaatttcaaggagtttagaaatacctaaacataaaaatggatgttcccatcaccttcttctgcatgaccatttccactcctagaaataactttctttaactgtatagggtgcatatagtatgtaaacaatcaaatatatggcttcatttttgattccataaggaaattataataccagtcttgttctgcattttttgggggtaacaatttgccttgcggatttttctttatcagtacctagctatctactacattccatttaatagtatttcccagttgtctgatatcaggctacttggatctgaaacctggctctgcctcttacgagctatgtgactttgagcaaatatctcatcctctcttgcctcggtatttccgtctgtaatgggacaatactaatacctaacccatagggttgttatgaagacaaactgagcttatatatataaaccacttgggaatgtttctgacacttagtaattgctctataaatatgtaatgttgttaatattattgacaaattatgatttatttgacttttcttcttttaatggacatttatgtttttaccaagttttcagaaaattatttcaagtaattttcaaataatatcttctgtataaagatagatacttggaaatgtattgctaggaggaaagatatatatgtttaaatgtgaatagattaccttgcataaatgcctttccaatttagtctcccactaacagtatgtaaggataccctttcatttcttactctgatctatactgaatattatcaatcttttggctatttgagtttaaatgatacattgattaataatgaatgtaaatatctttatcatgtgaaaaataagagtaatgtttatttttattgttgagttatagatatactttgccaattatatatatatatttatttattcatgatatttgtggctcatattttcttctagtcttttgactttttgatagtgtcttttggtaaccaaagagatttacctttttataaaagcaaatctgtccatcttttccatttaagttgtgtcttgcttaggaagatctttcctgctctaaggtggtaaacatatttctaaatatttatttcactagttttttactctatgtattttttaaacttagccctttagtctttttgtaattattattattattattattattgagacagagtttcactcttgttgcccaggctggagtgcagtggcatgatctcggctcaccacaacctctgccgcccagcttcaagtgattctcctgtcttagcctcctgagtagctgggattacaggcgtgcgctaccacgcccggctaattttgtatttttattagagatggggtttctccatgttggtcaggctagtctcaaactcccgacctcaggtgatccacccgcctcagcctcccaaagtgtttggattataggcgtgagccaccgcacccggcctttttgtaattattttattaaactttggtatgaagtagtcctctctttttcagagacgtatagaataaagatatttgaataaattctagtgtgacattttcatagagatgaataataatattttaaatttcttgtatcagaaagccactaataaagcaaaagagaaattttgaaaatctcagtaattaactctttctttgtgaaacaagtaatgaactttgccagttctttcttatagcatgggaatataaaccacacaaaatagtatcagagaaataagttttcacagaaaccctttgttaaactactctcctcccagcttcaagtggagttcaaagtctatctcagcactctcttaagaggcaacaaaatttgtcaatatcaaccaagtcctcagaaatttcagaaaagacattcagttgaaagagtcattgagtaaggtaacaaaatgaaaatgaatctagagaaaagaattagtccaagtgttccttttctgttgtttggcgatgctatagaaagcttttcccgtgtgtttgtgaggtgaggatctactttttaaagtctcttacttctttccctgccaacatttggcttctgtctatctgagagcagaagatgcttattctttacaacatattgaaaatgtgtgtcagacttctaagaattggctagagtagcccagacaggaagcaaaagaatcggcatctctgcctttagccttgtaggtggatgcactctaccttttaattgctggttttacctgggaattcccacaaccgcagcatgattcatgtgagagctcttgttttcctgtaatgtagaaagtgcatgcaatattgtttgggactttccatgctagtattttcactaaaggtgaaagagcctataaaaaattagattttgtacttaaaggtcaggaaatattgttaccacttctttggtcttccattaaccttggggggaatttgctttgacctcctcacatagcttatggcctatttcagacaggactttcaaaatctgaaaatcttctggttttcttcttcttttcccccttcacttctcttttacctttcgttgttttccctgtcattttgtcctgcatgtctttgctttctaattttatattttttcctctcttgtttttcttccatctcattcctaacatctgattttggtggaaaagcttttcagaatttatgaagaagacagataataacttggcttaaattctaacatatgctttgattttatcttactttattttgagcaagaatactaaatgactatgggaatacatttagctctaaatcagcagaattgtcacgtggcacttcagaagacagcctgtttgaataatgcacatccttcatgtttgtaagttgttaactcctgagtcttcaacccaaggaacatataggaaagtaatattgaagacatatgaatcaaacatgcttgagtttaaatcccagatctcccgcctgctggtcatcattttgggcaaattgttaaactctaaatcttaattcctctttggtaaattgagggaataatactcatctcttcaggtgattataagaattaaatcagtgcttagtttagtatctgtctctttaaactaattctctaagaggtagttacttttcagatttatgttttagtaatacattattaaagaaaatattatagggtgattcttgttgaattcatattgaatctggaatgcagaaaaatgtcgcaaatgtaaacagtgaatattagtgtttccaggtttattagttgagtctatagaaaaaaattgtaattacaatgtgtatctactttatgggtatgtatcatgaatacaaatgtgctgatatgtgtgcttcttttaagcccttcagccctttaatacactatgtgtgaattattgcaaattcttaattttattgtcctctgaagaattcatcactttaaattattttggggtttataaaaacttgtttcattgattgattgatttggtatgtaggttttagcagtttttcaggggagaaatattttccaaagtaaagaggtggaaagggcaggaatgggagggggatgggaccccccaacacccactagcttagatctaaaaacacgacctcatggaaacttctaatgtgtttcccttttgtacagaaaggattataactgctaaagtgatttattttaaaaaataggccttaattctgatgtatgtacagcctgctagaaaggaaaagagggattgtcaagaaattaaattcttccttatgcaatagattgtcatttatattattataaccacagaccctgcattttctgtgagaaagccaaggcttggacaggctaacagtggtggaagacctttgtttttatcaaagcgtcagcaaaagcagaaacacattggccttttctgtgatcatctgggaactttagtggcctgaggacaaagagaatgagagagagaatgagccagtgagctagtgacctgatctctatttcaattctttaagtcttttgtagacattaatatcctggattgaagcagaagagtcatctctgtcttcagcgacagtgtaaggaaggaagggggaggtgacttaaggggtgagggtgctgtggggagggagaatgttgagaatgaagtggtgtttctatttatggttgtggttgtcaactttagaagtcctggcaagacttgagtatagtcaaccacccaactgagcctttcctgcacttgcttcctggattgcctgtaaatgaaaattgcataaagaccagaaatattataatagtacaggacagagaatcatctgagcctcccctccagctttaatatctaccaccttgttacaaaaccattatatacaatcacacactcactacaaaagtctgccctgcacttctggtgagatcctttattattatggtgtgtaatgatgtaatctttttctctattgtgtagccacagtctctttactgttgacatatgaaatactgcatctggagccaacactaaatatccctgactataccttcaaatgtgcggtcatctccagaaaatattgcctctaagttatcaatagaaggtattttctatttagttggcattcccagtgaatctgtttactgttaatttgcaggtagcatgcatcttgtcagggtgatatggtttggctatgtccccacccaaatatcatcttgaattgcatctcccataattctcatgtgtcttgaaagggacctgatgggaggcaattgaatcatgggggtgggtctgtcccatgctgttctcgtgatagtgaataagtctcacacgatctgaggttttttttttataaagagcagttcccctacacaagctctctcttgcacactgtcatgtaagaagtctctttgctcttccttcatcttccaccacaattgtgagacctcagccctgtgcaactgtgggtccgttaaacctgtttcctttataaactacccagtcttgggtatgtctttattagcagcatgagaacagactaataaacaagggtacctttgacattccagcttgagagcaaagagaggcagccctgccttagccatctcttcctggaatggtgtggatgtcagggagcagctcaacatgtgggctgtttcttgatcttttaagtcagacttcatagcatggctttgtcattttgtttgaagtaaatccttgaaacattagatgtttctatattgaaatgacatgcattccatagcccaaaagacataatttctgtgttatttacttgtagcctttcctctatgagtgaggacaagtgcaaggtgattttagaggtagatttatgtgcatattatgtaatcgtttatccctcacattatatcttcgttttcctgtgatgtcatggcagagggtggattaatcagtaaaatgtctaggattggattgagaatgagcagacacctatctcaggcacaacctgtgagccatgtgactttatttttctattgttcaatgaagtatacccttttagccctttctgtactgagtagcagaaaattaatctcctaccactctgggtaatctcagacaatggtgggtaatcacaaaaaattccacactttctctgtcacttcaggtctctcactttcctctcccttactcaggttgcatttgcctttctgggaaatagtggagagtgtgctgcaagttcaataaagtgccacagtgtggccttggtggtaatttctgtatgctggtggctgtccatcttcccagttgtccttggccaccactctattcaagtcataggtgtaccatcttgtgttcctaaccaagttctgccaccttcatatgtgtctccgcaagggtgtctttgcagctttggggacatggaaaatactgagactggcccccactgtctctgcgtagacatactatgcagagacatactattcccctactttattactcttgtgccattacaggcttgggattgctctgacttctggacaacttctctcgtcttccaagaaaggggtcctcaggattcttctttttgaaactctaagtctgagtcagggctctgtgtttccttaaccctcatacttgacctggggacaggttatagactcttcctgcctgtatctaaccatttttcccctcactgactctcttcctatttcctatggggacaggaagaacatgaaaaatgattttttctgatttcatcttcttccacatacttttcatcatatatgtggatcttggttttttttttccctccagctttttactgtaaaattttcaatatgaataaaagctgaaagaatactaacaatgaatattcatacactcaacacctagattcaacttctgcttaacatcttgttattgaaaaatacattgacagtatcatgttccttcactcccaaatttccagcatgtttttcctaaaactgaggacacagtgtcctaaaaccacagccacaataccattaccattgtgctcaaggaaattaagataaccctgtaataacagatattacctagactatcttcaaatttccccagtgatttaaaaatgccttttatagttacttatatatcaaaccaagatcaattcaaagttcatgcgttgcatttttttttttttattgagtttctttggtcccttgcagtctagaacatggcttctctttttccctgccttacactggctatttgaagagactaggcagttgtcctgtagaatgtccctcattctgtctctgtgtgattgttttctttggtattcttcaacttgccgtttatcctctgtatttcctataaactggaacttatttctaaaggtttggtcagattcaggtgagaggttttgggaagaaaacatcacagaagatgatgtgcacttcatctgtgtcacatctggaatcacattgtgtcaggttgttacactatcagtggaagttggatcaccttttgaagatagtgaccaccagataccagatcttttctttataaatacaagtttttccctttggaattcatagctggtttgtagggtgataatttgacatctagcaaatatcctctcctcctaaaacttgaacctactgggcttagcatactttcctaaaagctacttaatttctaagggttgcagaggtgtttttctaatccaatcatttcttctgtttttatttcattaatttttttttaaaggagagctttctggccttggccaagaatttcagctctttcattatagttctgtcttgatgactcttccttgaggcaatgattgggtgcttgggatccagctgcctacactagggagggtcataggattatagaaaaaaagttacagttaataggatcactatatcaaaaatattattttattataagagtatagttggtgggaatgcaaattagtacagccactatggagaacagtttggaagttcttcaaaaactaaaaattgagctaccatgtgatccagcaatcctactgctgggtatttacccaaaagaaaggaaatcagtatacggaagagatatccacactcctatgtttgttgcagcactgttcacaatagctaagatttgaaagcaacttgtgtccatcaacagatgaatggataaagaaactgtggtgcttgtacacaatagagtactattcagccataaaaaggaatgagattcagtcatttgcaccaacatggatggaactggggtcattatgttaagttaaataagccaggcacagaaagacaaacatagcatattctcacttatttgtagaatataaaagccaaaacaattgaactcatggacacagacagtagaaggtgaccagaggctgggaagggtagtgagggatgcggaggttgtgaggatggttaatgagtacaaaaacaccagaaagaatgaataagacctactgtctgatcgcacaacagagtgactatagtcaataataattgtagcttttaaaataatttaaagagtttaattggattgtttgcaactcaacggataaatgcttgaggggataaataccccattcttcatgatgtgcttatttcacattgcatgcctgtatcaaaacatctcatgtaccccataaatatgtacacccactatatgcccacaaaaattgaaaaacaataaataaaaaagagtataatgagcctaaatgctttcaggattcccttttgcattttgtggctggtggtagcatcaaagacagtgagagctagcagcaggtgagaaatcacttgcagcctttattttatagatgaggatggtgggcccagagaacttgagcgacttgcctgagggttacctggtttgtggccaatccaggggcagaagccaggtctcatgactccagcttcagtgttttctgctgtgaaactaagacttgtaagaagactccacaacacaacttatttccatgccatgttcactgcttgagcgtgtcatacgtgactagtattgtcttgcccctgggtaatgctatgtttctcaaagctggggacacttaagatctgtggtaacaagagagttttaggaggtgctcagggactaacattttaaattttggtaattctgttatctatttattttagtgttcattagaaaaaatatacctattacatcatactgttggtttcatcatattattgtttaggatgagactaaattaatataatagaaaaaattaaaaaatatggtttaaacaatttcatttcaacttaaattttaaaaagactattgggtaggactatccagtgcactgcaaatttaaaactgaacagaacaagctttccacctcatggagtttattaaagtttatgggaggggagagagaaaaacagagaaagaaatatagagaaatctacaggtgatggcaaatgctatgactgaaagtgaagcagggcaagagggctttgctgtgtttaaatagttaagaaaagctgctctgctacgatgacactggggccaagagtgagagaaagtgagggagggagctcgctgatgtcctggggaagagtgatctagacagaggaagagtgggtgcaagactaaggtggccagagcagagtgggggcctggggaggagagcagagagggatggaaatgcagctcactgagggacttgcagcatttaggagttttgttgttgttgttgttgttttgtttttttattcagagtgaggagtacttgtcttatccaaggtacttggatacgacagaaattgtgaaagtgtatggagagagattaaatgtgggcagcactgatgtaatgatgtattaaattaatttcttatactgaagcatgactgaagggaaagatatctcatgcggggagagttcctcatacaagagtatggaggaaacttcacttcagggtcatgatcagcttcattttgagaggagaatccacccctcaacacacatacacacactcaacacacaaacacacacacataaaacacacacatacacacaacatacacacattcaatgcacacaaaccacacacattcaacacacttttaatacatacattcaacacacagatacatacataacatgcacattcaccacatacaacacacacacaacacataatatgcacacattcaacacacacacttttaaaacacacgttcgacacacacatacacacaagacccacatgtattcaatatacagaaaacacctgcactcatcccagaatgatggcttgaggtttctaggtgtctgcggttcccctgggtcatagtgtacactcctggcatgttgtaattgttacccatcacatggccatggccacttgagactagaaagggataggacccagactttgacttatgtcttgactttttcttgaaattcttctcatcttcagcctgattccttttatacagtctaatctactctaaggcctgggatattatatcattaattgcaaggctaatataatttgagtaaaattttctcttcttgagatcttagttgctattgggagaaaaatgacactgaaaactcagctgatgcattttcagagtgaacaaagacattgtgagaattttatttttcctcctcacaatggttaaacattaagtagaacccatccatgctttttgcatagcattccttttggctgaaaagataaggatgaaactaagattttaagactcaagatttttgaggccatgtatttgcagagagaaaagagcacttgatttttctgtttattgtcctcctgacaaattattaatagtactttgccgtctttgtctgaattaatctttcttgaatcaccattggtgatggtgatagtggagatctaattatccaaatctcctaaaatatggttttctgtctcacacatttagcctaggaatgactgagtgtcacagtgcttcatctccccttcttaatctctctatattttggaaaatagttgattggctgtcaccttttgggatctcctatcttcttcccacatatttccccatactacgtctctctctcctctggtcctgcatgttgtgaaacagtgtcttctacctcttttcccccaaatatctgggaattcgattcttcttaattcttcattactgtcatatagctctttctctttacaaattgctcaatagtacatatttattctagtctgatttatttcccatcacctaaaatgcttatgggttagcaaactcagagacactaactcagatattaccagaaaaccagcatgtttgaaaagatggatctgctgtgtacagacttgcataatggaaacctaagaatggaaaataagggctatagtcttggataatcccattcattggcatgggctctcaaaaatcaataatgttaagtttgctttgacttctcagttccctctctagccagaatcttacactacagaacagattcttaccaatttcaacaattttcaattacaaaacaatgcaaggaaaaacagaaaagaagtctaatcagattcagaattttcagaattcaaatatgccaagtgtaggaaatgccaagtctaagtagcttagttcaatcactttagcactgattgtagcaaatgtttcaccttaaaatgatagttcattgtagctattttgtaactgtagtaattgttgagaattttgtttgtggaagacactcagtcattcctaggctaaatcctctccccttgccaagcccctccctccgcaggggtttttctttcatctcttgagctactgcagtgtcctctgaacccctgagatggaaaacatcccctgacccttggtggcaggtactgtagttacttattattcacttatttaaaaatggacatcatatctaggtgcaaaaacttaaggtgcccattaatcatcaatatgatctctctgttgggacccccagaaattcatcatgacttttgttttgacgtatctggttattcagtgtttgtaggtgtcaaagaaaaccagagctcaggactattgcaatatggaaaaagagagctcagtatggaactgggctcaactctgcatacagcatggacatgtgggaattcatagccaagaagcagggtgggtggcagtggatgggaaattactaagaggaaacatcaggggtaaggggggatcctggctaaaccaatgtaacaggactggtgctgagggcaggccagggtgatagacatcccctgcgggacagtagaggatgaggaacctgattagatgtggaggacaatcagatatggaagattttggcttaaccaacttaataggattcttaccaatccaaggcagacgaacgtggaagtccaaaagtcaggcctacttgagaaagagttcaggggagcccaagcagaggttggtcaaggagaggatctttgtcgtagggtgtactctgctcttccagttctagtcttccagatgtgttgacgtaattgccttaaattgtacgtggtcaaattataaacattattgaaaaaattttaaaaggcagtgtatggaactacttactaccctaacaaattaattgcatgtgttacttaaaaatattctgatatctcacatttctataatcattcataatagtacattagttaatcctaaaatcttatgacccaatctacctacccaattggctgtctccattgagtccctgaatgatcacctgaagttaagccagatttcctttctatagataaagatgtagaggcataagaaattctattttttaaatgacaagaatttatttgaataaggcagagtcttgaatctctgtactatagatctgtgttaaccaaatgcattgacgatacaattcaattcaaacagcatcccagaaatctcagagtggtgttgttggttaaatgaatatgcacatatgaaagagccaaagacttattgctgccagtgtttctcttggtttttaaggagttagccagtgctctttcccatgacttcagtctgagcagggtctgtgccctccattagggaccagcacaacgttcttcagcagaaaaccacaacagtagtgggttgaggagctcattttttgatgcctgaaggcaaaccttcaaaattgaattttatactctcaggaagtattgattgcaaacttattcctttataaatcaccaaagggaaaaatgacttgatttacagttaaatgcatatcatttggtgatgagcaaactcctgtgagctaaaggaagaggtgacacagacacgtttccacagcattttcttgattcatattgcagctgtcgtcagtgctctgctcaggtaccctctgactccctttactggccttgtgtgctcaccctggcttctgcatatgtttgcttctgagggtcacgcacctggaaccttgttcagagggctggacttgagctagtggagctcctccccactcctggcatgtgcatgagaacacacacacacacacacacacacacacacacacacacacaaacacacagctggaagcagctgggagttaagtgccttccactcccttccctcaaccctttgccaggttttgctgatgagtggtgaaggagtatgaaaggtcaccctcttgtcttaagtctgggcaaactctgtggtataatttacacgttctctgcaggatctgtggtataatttacacaccacagctctctgtagaatcaggctgaggctgagatttcacctgaagttgcaatcttgcctggcttcttcctcccctccctgttcccctctcctgggagcccctccttaataaatcacttgccatgaacactccactctgggtctacttctgaggaactggccaaagacagtgttggaacactaagaaatttaatatgttatttgatgccttttatcagcatctttaaaactatttctgtctctcatttgctaatttggactttatatgtgcaagtgggggaatcttaaaagttaatttaaaaatgaattgaggtgtagattatagttaccatttactgagagggccgttgtgggccaggtccttgacatatttttttccacgtttcataataatcttgctttttaaggatgagttaattgaagtccagagaaatttattaatgtgcccaagtcacagagctagtaattggtagaaccacaatacaagcccagatcttgtgatgttgatgtgttagctcttccaacctccctgctaactctcctttcccccctgggtattaaaacttctatttctagagctatcaaggaggcattctggcatcaaagtttatgacttactaaaatgaaaggagactgtctctttaggaagagataaaatacattagaaaatgccagacttaatttcccagaatgggagtgattgaaaataatttctaataagagcttgagtcatgtcactttgttgtatacagagagacttttgtgcgatgtttgacagaatctgggtggttcatagaaacacaaaattattcagcaggtgacaacgggacagggcattagcaatgagatttgagagcaggagatggaaatttctttcgtggctctccctttgaggtggtcacgctcggtcctgtgactatagtgtaccacagtgctgtttagaaaatgacttcctcggccctgaaatggaccacagtgtcctgaaagccctaactcatcacatagaagttatcagtccattgcagggaggttctttaagaaaatgaagggataatggcaatgatggcatggccatctagatggacttccttctagtgtccgtattgggacctgattgaattattcactgctgacacaagccctctacacaagttaaaaattcagcaaaaatacacaaaagccatactagagacctttaaagtttctgtatggtgaagtcatcagcatttatcgcagactgtacctagtctttctttctggaatgttcttcctccatccatctgcctggttatttcttacttggctttttaagatgaagctcaggtgtcacttccttcaggaatgcttctctgatccccacaacatggacaaagtccctttttagtaaatttgtgtgatcgtgtgtaatcatctagaaaaaaaatgcttagcttatcatattgaaagaatatgttttcctgttaatcttcccactaaccatctgagggccacttcggggtatcgtttgagaggtcagcattgtaatggtaaatctgaaatggtaaagagtaaaatgaagtattttatttttattgtatttttgcctttgaggcaagatagagtagcagaaggagcaggggctgaggttttactccaagctttcctatgttcttcttctgtgactcaacctctctaaattttattttctttcactgtgaagtcacatgccagcaccaaagttagggaagattcctgagaatggtctaaaggttaataagatactgcccagcaaatatttggtgttccataaagtttcataaagcatacctcagatggacaatgatggggaaataggtttgttaacagtggacatgcatccatttacttgttctccctataaacaatttttttttttgagacagagtctcactctgtcatcacccaggctggactgcagtggcaggatcccagctgattgaaacctccgcctcctgggttcaagcaatttttgtgccttggcctcctgatgtagctgggattacaggcatatgccaccaagcctggctaatttttagtagaggcagggtttcaccatgttggccaggctggtttcaaacttctggccttaagcaatctgcccacctcggcctcccaaggtgctgataaacattttactgagcatgtacaatatgccagccacagggaatctacatgtgtacatcatacctgtgtgatgtacctctagaagtttgtagtctagaggaggcctgacatcccagcagcttctatggtggctaatgtaagaagccccacaaaagagggggatgattcattgtctacagaaatcagggagttcttcacagcagagtccaccctccagtggggtctgaaagagtgagtaagagatctctgcacagacgagatggagaaggaggcagtgttacttactgaggcatgaaggctcgtgttggggtggcatggatattgatggagtgtaagatatgagagaacagtggcaggggacgatgatggagagacagacaagggtcaaggtgcagaaggcctttgtgccctgctgtggggtttggagttgatactgcaggcacagcagagccactgaatttagtgattggtaacgaaatagttaaattgagagtgctagaatgtctaaatgtgaagagtgatcatgtttatatagatttcttagctcctgccaagcctttttttttactttcttaatttggtattaaagttggaagtgattaataaagtgataacattactaatttttaaaacattctggtctcctggccttcacattgttttaatggactgtaaatgcttgcatgggcatgcttgttaaatgactaatgtggaatccattcattccttcaacatctatttattgagagcctgctctggactcttatagaccctgaggatggttagagtccctgcctggtggagcctccattgccatggggcagatggcaagactaataaatatataagggctatagaaattatggcatgggaagaacacagcagtgatggaggggtgaggggagtccttctttaaggaagtgctctctctacctgactatgaagaggagggattagtgcggggttccctgtttaggaaatcttaaatcttactgtttttccattgctgattttaacgttcttggagtttagtaagtagtaggttctcctctcttttctctctctctctctcaaaggcaaaatgaaaactatatttatcaccacttatggggcacgtctgaagttcgctgtaggaaaataaattttctaccttacaaatatttctttgctgggatttatgcagaaggtttatgatagccagtttctaatctagaaatcacagaattggatttgagaataaaagcatcttttttttcccctttcacttcaaaaagaacacttaacactctttctcttttttcaattgagtccctactctgtgcttggttttgtgctaagtgctttatgcatacaatctctcaactcctcaacatgtctctgtgagatatgcatcatcatcttcgttttgtaactgaggacattgagactcagggagattttgctgatctgccaaggtttgtggctcctaacgtcaagtctgcctcaggacagtcatgtcctaactactgtgccttcctgccctcccctatggcctggtttcatttcttcctttgtttattctcctgtgaccctctctgtctaaatattttctttctctccctcattcatttggcaaatgtcatctattgagatggcaaacatacccagactgctgggcagtcactgggaggggatattcaggcttcaatggaggggactggacccatattgagttctgaaacatggacaaagtcagaaacgagggccaatggccttgtctccaagagtggttttcagtgagatggatgctgccccggccagttttcaagggacacagattgacctcacttctgaatctcaacagacaggatggagaggggtctccatgtctggcacttcatgtactttgtctcgcttagttttatccatggaaacatttggtagatgtcattgaccctttctgcacataaagaactggaggctcagagaggttatgtgacttgcccaaagctgcaaggctgttccaggtggtactgatttcaacacacagctcatttccagaatccaaaatcttagtgctggagctgtcattctcaaagtggatcccttagaacactagcattggggaaaaggctggtttctgtagtccagtgtagcaaatggagctttccatagcccgtcttggagaaacacattctgcgtcagcatattatagggtccataggaatcttttaattctatttaaaccagattcacaaagtgtatttaaccacagaaatcttttcaaaagaaatagtcactaacataatgagaaactagcgcatggaataatgacatacaccttactgtctccccagttgtaattttggtagagagaggatgaagagagagaggttaggaaggaaaaaagaagacaaaaagaaaaaaagacagtggtggaaggaaaagggacacaggaggtactcaaatatttcacaataaaattctaaaataccttgtcagtttttcttttatttccgagccttctttcttgtgcttttcaaattggtacacaaatgtttccctaagtatataagatgagatagaaagattaatctctttgggctgatgacagtcttaaataatggtccatgaggctgagagaggccgtctgtgcaggtgaccaagccctaacaccaagatgtgggagctgagaggtggcatagggcctgggcctagaggcacctgctcctctccctcattgcccagagagaatcgaatctgctttccttggctcccacagcaaggaggtgacagagcggggacaactccagcctcttgactcccagcccagtgtgtttttccctgcagcacatttattttttttcagagtctgtcttatgctcacatattattttccctgttatgcttagcccatcagcatttgcttagccagagatattgccagcaacataaaccataaagattgtaatttgcctggtttattgcttgctacagtccacagactcttggcgtaacctaggacgggcttctcctgcatatttcttttgctcttggttctttgaatagaatgtgtatataatttggaatcaagacaaatttataatcaatattgatatttttctcttataaatatgcatatattcctaatcagatatttaaatggacttcctgggttgttatggatatttttattaaacattttatagtttatgcagatataagagtgacaatatgtatacagtttatatttagttgctgttagacccttgctctcaaaatgtggtccttggaccaatatcacttaggaactttttcaaaatacagatctggggcctcatcccagacctactgaattcaaatctgaattttaatgaaattctcaggtgatttatatgctctttaaaatttgagaagccctgatctagagtacacaaaaaacattaaggccagtcttcgttttgttcatgcccatttttcccagttgcacatttatatctttgacagagtgcaacagctctgcacttttcatcttagaaacttcattgtgggctgttttctacattattacctaagagagtatctataaagcatctctgaggcacacagttggtacctgtctatctatccaactagatggatagataggtaggtagagagatagatatagatataaatataaatatagatacagactgtttaaaagctttattatttatttatttattttttcttttgagacagagtctcactctgtcgcccaggctggagtgcagcagcatgatctcagctcactgcaacctctgcctcccaggttcaagcgattcttatgcctcagtctcctgagtagctgagattacaggcatgtgccaccacacccagctaatttttatatttttagtagagatggagtttcaccatgttggccaggctggtgtcgaactcctgacctcaagtgatccgcccaccttggcttcccaatgtgctgggattacaggtgtgagccaccatgtctggcctgtttcttaaaagctttattaaaaactatgaaatgtctaagatcttaccctactttcaagctaacaagttagcctgccatgatttcatagatgatggcagaagacatgagattttggggtcagagacagaggactctattacttttacacagcatgtggcatgaacagcatatttgtatcaattctctcttccaaaaccccatgagtgtgaggcaggtgggacccaatggatgcctgcacattctctggattgtgttataggagaggaaccctgaatttagggaatctgaatcttttaaaatggacagtaattatgcctgctctttgttttggagacactttattttggaaggctgttcactatacaaacatctttgaaaagataatccaaaacaaagggcagtcagtacctttctttgtgagatatacagaagtgctagagagaactgtctcctcctaataggtattagaacatctttatcattgggttttaggaccaataaatattttctggtggccatggaagatatatttcctaatacctagattgtactcatggttgtttctatcagaaactttgaggggaaacttccagtctgggcattcagttaagccccttacaggaaaagagaagttatagaaaggaaacaagtggggttgtgcatcataaatagtagagtcactggtagctcttcctagtgttggttgtcccattttagtacagaacctcctcttattctcaagatgagagatgtgacaccgttcagagaactctggagaaactctaacggatgtttacaagattggaaaatagtagtaggaagaaaagcagagataaattggggttaataatcattttctaatacagtagtcttgttgtccctaaatgggttatcatgcaaaacagttaatttccctttgctctgggtgtccacaaagagcctgaaactttcagaaatattgtagaacagatttcttctttgactcagagtgtttctcagctctcaaagaacaagagagtttggagaaggaaaaacgaatagttttacacagcatatgacaatagtatgctgagaaatgttcaggaactagtactcaaggatacagtggggttggggtcctaatttgtaatgtttgctgatttccgcggtgtaaacattcccaccatgaagtcagccagctcaaaaaagtcctgaaaattagacaaagaagtacgagctgtctctagcaagccattgcaaaacagtcataattagcaatttttcgacagtgaaggtagtttgatcatgcaagaggtttgtttgtagaaactcttttttgcaagaccttttaaaataatatatgttctctttgcccccggtgattcaagctagatttaccttaaggtaggatgacagcctacatgatcttttgaagttcgtttcaacagtgcaatttgatttttcgaaaaagctttcctgtctggtgcagtggctcacgcctgtaatgtcaacattttgggaggcagaagcgggtggactgcttgagctcaggagttcgagaccagcctgggcaaaatgacaaagcgctgtccctataaaaagttacaaaaattagcccagagtggtggcgggcacctgtcgtcccagctacttaggggactggggtgagagaatcgcttgagcctgggaggcagaggttgcagagagccgagatcataccactgtactccatcctgggtgacagattaagaccctgtctaaataaacaaaaacaaaaacaaagccttccttaaattgtgggtttaactagctgatttgcttcctttaaataaattggccaccagctcagcttatttctctcctatggaagggcctgtaggtgcagtctgattgtcactgatatttttagagaagcaggaggttattcagacttaaccaaccagtgatgattccttatacttgggttatatgtagaaccgtagtgaattacaactttggacacaaggtgcctgcatcgttggttggactgagatcatggtaaatcttctctgcactaatgaggctttgtgcctcttcaagagacttaccctggaattccctctgggctcagtttggctgtcgattctgtaaagtccctctctggagggctctattgctgtgttgacagcaacattttcccagagaatataacagtggcccacacactgcagcttcagtgaagctcatgatgagtaagcctccctcctgcctgaactgtgcagttcccgctggtggactgtgccttcacggacaccgtgcaatgtccctatcttctggtgtgtccgtgcctgtcatgtggagtttgatacagtggactgatttcttctctgctgtgtcctctccctcctcaatgttgagggatatgtggagagagcaaacttgctgcacttagcccaccccagtgagatgcccttttcatggccttaacaggctggtcttttcttctcccagcatttaacagaagggaggacctcgactttaatgcagatttgagtgcctccttccctctcccttgggtaatattgattagaaggcttcaattacttatttatcagatttataaaatgcttatcttgccaaggtctctgggcacatggacaagagtaaaaataaacaacaagcaataataataataaaaatccaccaaacataggtgctcattctgaaggctctacatgaatgccattggaagcctggtgacattgatttagagcttccattaccacttgactttttttttcttttctttttataaaacacacccacgtccaagggggcttgttctcctgcataaagcaaatgcattaacaagcaaagagatggaacacatagatttgctgttgaggctaaggccaaattgcaaagaactcatatgccatgttgcagagatcagtttccaaccccctcatcttttcttttgtggtgaaggcaaaaatagaagtgaatcttaaaagagggctttgtattgtctgtcccaaatttttgtctagacacactgagacaaattagcttcaaaagagttttcttgttctgcaaaaggggcagaattctctgaggagggtgtgctatgtcatgccgtagggttgctgcacctttttttgtttttttgacactgacacaagaacatcacagtagttgtgggttgtttaaaggcttagctgtgtgctgatgatattgtttctcctcaactgttcaagatcaagaaggtgaggcatttaattagatcagaaaagagtgagcaagtttgaagaacttttctcaacctgtcagatctgaaatcttaattccatgctggactttctctctggagaagcctccttctgtattcctgtttacttctgataagagtaaacaaatggtagaaatgctaaaagggaaccaagatactctggaccaccaacacgtccagcattaacaacccacaccactagtgggtcaggttagcatttctggcagctagcctttatgattagaaaataaggcattataatgggactctgcggttttttttttccttaaaaatctggttttgattattaacactcttgccattagggaacatttggtctgagctacgtgttagagttccaccagtacaagggaagaaaaaaaacctgagctatccccttaaaacagttgtcatactatgaaccccaggctcaatctgaccagttgtttgtttttgtaaataaagttttattggaatacagccccattcattcatttatggattatctatggctgctttcatggtacagcagcagagttgagtagctgtgacagagaccttatgtctcagaaaacctaaaatgtttactctctggcccttcacagaaaaggtttgctgacccctgccttaatggaacacataagcaaaatatctaatgaaataaccatccacctcccggacttccacatattttgtaataggttgtggagatggggatcttgcccggttcagcttctctgttttagtcaggccagtccctaaatcaacgtaggcagatgcacaagcagtgagatgggagcagaagttcaaacttaggggaataccaaggtccagctctgcgcaactttaccttaagagtctgtgattccctctgtgtacacttccatttcatatactaacatgggtactgtgtaaaaagagaaagagacaccttcaaagctaccatcaggggtagcgaatggtgctagacctcactggtccatagttcctacttgattaggtctcagttaagagctagtatattagatggttatacatggaaacataggtggatgttttttcctctctaaaagaaagctatgagctatgaagttttctggcttggatgggtcagtgataatttcgggggtatggcagactttgtgatattttcttgggaagtaaaagaaaaaaggtatggttctgataaagattctgtcaggaattctatatttgagtcttttttttgttataacatcacactaattttttttatacaaaagactgtcagggttcagggtgcaaaagggtaaatgtgcagtctttgtatgttccattgtcttttcttcctctcttcataacttttgcagagaaggccagccttgtttgtatgttccggtgtccaaaccttatgtgtacaaagtaactgtgtggttcagtcagaagaaaggtgataggagttttgagaaactggcattttgaaaaagggcaattcctgcctctgtaggagtcttagtacttttaggatgtcttaggagaacatacaactgaacaccacctctaaaattaatttctacttacagctgagtgtttttatgtatatgttttgttgacgcttcttaagagttcataacattctctggtatatcatacttttcagatcataagtatacttttttcttactcatataataacttttcatatatacaaacatctaattcaagaattacccattaaagacctagccttttttgcttcccgttgaaaatgtgaattttgagattaataaataatgtattttagtcatttcagtataacattcttaacttcgccggttaaaaacaatacctattttcaatgagatgaatgccccctggtggaaacagtggcaaatatttgcactgatttggggggcccacagacaacaagaacaagcatatcaagtgtaatgatggaacaatgtaggcatataattgacatagcttagagagtgtctttagttttttaagtctatacttcatttaaatgcagtaaatagaagataacatcaaattgggagggtcaaaacattcaacaaggaactaactaaacccttattatggcaatttctctagcgtctttcttttcagcttgggaatctcttagctagtaaagtcatttatatcaaggctcttcgtaacgattttttaatggaggaattttcaataataccttggagggtgttctaaaactaaatagttgtataagagagaattgcttaaaggattataagatggcctccaagaaaacacacacacacacacacacacacacacacacaaacacacacacccacaaacaaacacgtcagtgggtgagaggagcaggttttgggatttaagcttcaccaatgacaactttatgttgtttgtctcgttaactgccagacaatccatctctggttccatagggaatgcttaccaagccaggcatgtgagcttgccaggactcatgtttttatagaaagctttattttggaaatttctaatctgaacatacttgaaatctaattctcagaaaactttggaaaaccatttaaaaggaagcaggaaaagggaaaagcaaaagtgaagtatgaggctgtatcccctctataggaaacggaactgtgaagaagcagaggttgctggcacgttctgcggctctcccctctgccccgtcatacctagctttgctgtggctgtcgctctagcagaaaagctgtggtattttttctgcctctgcaattttcccacttggatggagcctttggaaatgaaaaaaacaaataatcaagagccatcttgtattgaaagctgatgttctgcatacttaatgggctgaatcaccctttcccttttcagatatggctcatgtccattaagccgtggatatggctgataaataccattgtacttgtcatatcaccaagtgccacattttccgaggcagtgacgtttctttacctcagcatttgtgagagattgcactctggagtataacggttcaggctgaagttgtctattaacttgaaaggacttagagatatgttaatggctgggtgggaactcagttctttagaaattcttcttaaaccagtacctttcatcaagtcacgatgcttaatcttatgttatccgtggcttatgtcctgaagtgggtgggaaatggggcttgacttccccaaatgtaagaagtgtaatatacaatacttctcacatatgagagatcaagagaaactactgaagcttccagtagatattccagaacttgtttctttgataagaaataggctgttctcctactgtgaatgtcctctcgctgtcccacctcccagcatgagagacccctaaaatataatgcaacaaatgctcttaatgacattgcctctcacagatgtttatttagaagaactgtgaagggtgacctgtgaagggacattttgtgtgtctagggattgactttcccttcttgacagtgctctttatcacaatgtatttttgtatctgtatcacatttttgtgtctgtattgcaatgtatattttgttgaaatggttttggactctaaacagggttacccagcttgatcactcacgttctttacttgacttggctctgaataattctcagacatttcctgagtcagattcatccctgaagggttagtatctactgtcagggatttcaacttaattttattcactttcagatatgtgtctgtatcaggcattgggttagatggtcctatttcccagggaatgacactttggagggaaaatgtgaagtcagtggatactttaaatagagtttgaaaggtgcctagaaaatggtcctcagagatgggcattgaaggaggctttgggatttgcagagtgtgagagttggggaaagagcatggagaagagagagggatggattccaggtagaaattttatgtcccaagatgtgaaagtgtaagaaaatgtgtggcattcatacatttgctaggagtctggtttggcttgagcagagaacgggggtagagaattgggagaagagactgctgggttgtgggggcagggcatgaagggggctagggagttgacagtatggacagaatttatcccaaagacttcgcatggaggagtaccctaattaagtgtatgctatagaaagaagacttggcagcatgaggagatggaggttggaagactggggtgtgatgggaggtgggactgccactgggttagatcaagttcaaataactcagtctaatattagcaggctgtaaaggtaagattagaaaatgaatcccaaaaatgttgtgggcaaaggcagcaaggttgaaagaagctgtatggcctgagggaaaggcagaggggagtcagatgagtctgagttcaaaacctagcactgccggttactagttgtatgacctccaatagtctcacctgtctttaaattttttaaattgagaaataataattgtgcatatttatgagatacatagtgatgcgtgatacaaataatgcatagtgatcagatcagcatatccatcatctcaaatatttatcatttcttcatagtgggaatgttcaatatcttcctcccagctatttgaaactgtatgttattgttaactctagttccagtcctcacctttctttgctggctttccatcttctggacaatgggaatggtactctttcttcatggtgctgtggtggaagtgaaattagattatgcatgttacaggggtagagtttgatagtcactctttgaggacacatgagtgtgcctgtgtacatttgggtacgtgtatgaagaaaggagagacagaggacctccattcagacatcgattttctctgtgcttatttaaaactcttcattcacatgctgcacactcaacaaatacttatttagtggtacacacatgcaaggtgccagctaaggactctgttccctttagtgacatctcctgagggggtgagggcagaagatgtttaataaattaatgttggtcaactaattcatgcccacatatgatgacaaaagtgtctaatagccagtacaagtcaaaatactagaaaaccatccatctgagttattaacattttaatttagatcaatagggaaaaataagtccttagggggtttatttatatccttagtgagtgtttttttcttctcgcaatttagtttccttgagaactgaacatttataaagtgtttttggtgaacccatttatacagtagaattcattttctctaggaggttgggaactacagagagaaaccagagagtcataaattctatttaattcaagttcatgcatttcactagagaaagcaccttctttatcctcttattgtacttcccctgagacctctgaacagatgatgttagcagtgatttaaaaatgcaaatcatatcacagaagtcctttaaaggattgttcctcactcctcctcccaccctccatcacacaggcccttaaacaacaggaatggtaaattcaaaaccaaaacttgcgtcataggtaaaaaccaactatttgctgaaataggctgtaccagtctggctattttgatcacccatgatagttggaagacagaggatctatattctaaatctgatgaatgtatttactattcacattacatgtttgaggtgagcctgctatatgtacatgtggagaaagaagtgtggttataaggcaaaataaatagtagcccttgcagtcaagtggcttccgtggatcaagagctcgtataactcattttccagaagaagggcagatgcattgcagtgggagttcatagagaaagattactcttggctcatgctattgagatacttttatggaggaattagtttcaagttgtgcctcgaaaatattggcctgtagaatcttccagtttgagaagtccctaattacacagtgtttatgggcatgatttttaattgtgtactgcaccttatttcttcctatgagatttttattcattctttaataactcacactacatttgaaaactgttcttgggaggtatttaagaagagttgtgggactaactcttcttaaaacataaattttgagagtcagggatggctagtcattgtggacaaaggatgaactgaggttctttcattcccagccaagctggtgacttgcacacaagcgccatgctatcagagcctctccccaggcagtgtgcaccagaatttattgcaacctcagtgtgaaaggaactgagaaatcctttggcaacatgacctgggaattccaaaagtcgcccatgcctttgtataaaaccaaggaaaccagagcacattcagccactgtatgagcctgcagtcccttatgctgatccctgccaatcccatctcatctgagcctcacattcccacagtcccctgaagcttaatcaagttggtaaaatttatgtgtgttccttagaataaccatcacaacaattattgctattatttatggagcacttgcttgtttctaagcatgtttccatgcactttgcatgcattatcccatgtaataccctaaacaacctcatgagttaaacaatgagactgagatacgaagaggtgcagtaacctacctggcctcacctgtgtgtagggggtgagtggcaataccaggatccaagcctaggcttacaaatttgcagcgatcttcaagattattatttattttaattattcatttctctttgttcttgttgttattttgatccatctgtctctacttctggttcctttttgctgtttttctccaaaataggatatgttgttttctttatctcagtagacatcttttaattattttagcctaataatacttaagggggaaaaacaaaaaccctacgaaaagaaaagtattatcttaaaacttaaataggttcagtgggaaaaaatcttggttcagaggaaggctttatgttgcacatgtttgaattatggacttaccgctcccagtggccaccacgtgtgtgtgcttgcaaactcattttttgctttgagaaactgtggacatgtaagagtgaaggtggcagctctactacaaagaattttgcatgagtgatcctgaaaaatatgtcgaaaatccactctcgattttcatctttttaaattgacattttattgtccttgaaccaagaaagaagccattctgtttctctgctggttagacttttggaagcttgaaatggtgctatcaaagacaatgcagattaaaaaaaatgaccagtcaggtgggcgcggtggctcacacctataatcccagcactttgggaggtggaggcggatggatcaccagaggtcaggagttcaagatcagcctgaccaacatggtgaaaccccgtctctactaaaaatacaaaaattggccaggcgtggtggcaggcacctataatcccagctacgtgggaggctgaggcaggagaatcgcttgaacttgggaggtggaggttgcagtgagctgagatcacaccactgcactccagcctgggcgacaagaggaaaactccgtctaaaacaaacaaacaaacaaacaaaacaaacaaacaaacaaacaaaaaacaggcacaaaataatctcctgggtagcaacagagacaactaaacaaggtcaactcagtagactctagacccgggggacatgggttctagactgagttaatcactggctctttattcatccataaaattaggatgacatgaactgatccctcacttattcagggtaccaggtcatggcgaaatgctgctgcataaacagtaatgactctgtcaatggaggtgtcttagtaaactctctatattctttctcatctcatcttctcaaatattagaagtcaggcaaaaccctcattttcagttctaatgttcaccttattagctatgtgacctatggtgaatttcttaatatctcaaagcaaaataagtatttcttcaattgcaaaaataaatggtgataataatagctcctactgtatagagttgttgtgaggattaaataagggactatctataaatcccttggtatggtgggcaatatagtgtatggagaggtgatctaacttaccagtgaagagcaggactatggagacagacttctcgagtttgaatgctagctccagcatttaccaaatctgtggccttggtcatgttattcacctttctgtgcctcagtttcgcacctctaaaagggcataatcacaatgctacttataaggctattatgaggattaaatgaattaatatatgataagcacttagaagaaagctaaaaagcttggcatatggtttgtgccatgtatcaggtattactatggtacataataagcataagagtaacatccaataagtatattatcatcatcacgatcatcattatgttattacgttgtaattattgatcttggcgatccaaagcaaagtgactcatggagaatagttatacttagtagggacatgaaaatgaaattttaaaaattgggaaaataggaggaaaatgaaaatgaaattaacaaaaaagtataaattcagtagatgcagatcagagtcattgaaccagcctgtcatttctcaaacatgagctaagtgctgggactatagagaggagaaggtcatctttgagaagcacctggtgagtttgctgaaaagcaaacatcagagggcaatgtgacatgttgtgtcatcaatgtctatctgaggggttcagatgggggctcttccaccccagtcctagagaccagagcttgctttatgtagaagaagccacttgaacttggatgtagaggccaagagtctcccaggcagaacagtgggacaggaaattctgtgcagaggtttgagtgtgtgggatgagctcaaggtggggtgttctgtgggaacagcgtcctggatgatggagacacagcatgcatgaggagggggagcaaatggcagagtgggtgggggaattcgagaggtggcctgggatgggcctaaagtggatgttaggtagaagagggcttcctcagctttgcgagctaccttgagtttggtgcagggttccactcctcccagaccaggtggctacctcccaggcagtgagaaacaaggaattagaacacagcccacacccatccattaggaagtcattagcctagaggtaagtagcgcatcctctactttggctctgctgcgtgctcaccagagccaaagcttccgcttgttagctgggaagggcatagagaaaaagccattgagaaattgcttttaagggctttgtggtggccattgagagggtatttcagaggagtggcaaagcagaaaagccagctctcaaaccaagttgaagaacagctaggttctgatttgccaagagctgaggtatctgcctctcattcaatggcacgcagggggagagaagaaacagtgaggctaacagggacacacagagaggctactgcctgtcctcaggtatggctggaagagatgataacaccacagattggcctcaattcaagcaggttgtgaaatggctgagctgctggggaacagccagaagcctcggtgaggtgtactgaattaattgtatctgctccagatcttgagagcccagagccaattgtccagagcctttgccttcaagagttggaaggcagaatgtgctctgctgacctggccctcagaggcagctgcctacctgtccaccagcggaaaacaccgaggctcaaggtttggttagcaaagaaagacaagtttgaatgttagacctggaaaggggagtccaaggctgcctaggacagcttccttggggaagctgaggcccagcgtgacccatggacttgttaaaatcagcctggagtaaatagcagacctaaatccagaagaactggattttcctgatgctgcacatgtttcactatatgcgtctctgcagccttatccattctcccttagcccctctctctggtgcccttttttgccctctggccgcagagattgtcagtcaaatctaccttaaccctaagctttctgatcccttttctatcttcctacccataagagcatttcctgctcttttctcagagccttatttggtgattggtaactaaacagcttaagtgctagggtggcaatgtagtggatgtaggggatatgacattctattcctcctgggcaatacatttgccttttacaagataccttctcgctggattttcgttcaaatgttccacttattctcctgtctacattccaaactctatggtattgactggtgatgaagggaggtgatttgagaagggacattttttagtacggacatcctcctcagtgcatagacagactcttggtctgggaatctaagtggtctatatgccagtactctctcagagaacacttttagtcagaaaaatgaagtcaagcaaacgtttagtttaaaaaaatgaagtgcctaaagccttttatttgtcattaccttttaagtaaatttttaaggcagactaatcatcatccccacaaaagaggcaaagattatctatctctccaaggcagttattcagttgattgtggatgaatttttgtctggctgttctaagcagtggataatgaaaaaaagcagagccttcttattgaacattttgacaagagaaattttgctgttactcaccaagatgtaggagggatgcagagtcctggcttgggtgagggacgaggttgctgaatagacgaacataaaaggaatccattaatgatttagaggactgcttaatttccctacttctgtaaccaagaaacagagcttgatcaatactctcaaggtcactgttgctatttgctatgcctgctggtcttttttagagttttgaaaaccatcctatgcatccatcctgataaatatgctcagttttggtacagggagatatggttttaagtgtggggcagatgagatgcagaaggaagaagtgtagcctttctttgtgggaatctgtagggaaatctaccacaaaattttcagttcaagatagaacctggggacacaagagagaaactctccttgtgatagccaatctgttctgataaggcagttattattactaaaaggatccctggctataacgtggattttaaagaacattattcaatgtgtttcctcttcaattacttctgtgtcataatttagctagctgtttgccttcaaatgtggcattggccctgtgggcttgcctagtagttcacatcatattctgtttgttcacttttgtatttgttggctaagttgacttttttagaataaagattctctaacttactaatgtcagagctttttaacgctgatactgaccaaaataagtgaaatgttcttttggtaacttatgcaaaaagttttaatgactgcacaacatgacattcaaaatggcaaccaagacatgaaagggggcctgtcctgtgacccccatccctccaaaaaatggatttccaaagtcctctcattatttgaggactttgaccagaacacctagattaactcttggagttaattgcctttgcaattatatgtataattgcaggtatatataatatacttatattttcttatgtctggattaattaaaaaggaaaaaaatgagtcaactgactattgtctctgtagcattctaaagcaagccttggttccatgcagcctcagaagctaacagaacccgcagtggtaagggccattttaaaaagttcatctgcatagagttctcctagatgtgggcacaaggtgtttgggggtggggggcacagacaccctgaaaagttccagagaacacatgtggtttccagtcaaaatatcatgcaaatattttgaaatattttcttgaccacagtatttcttctttatacattgctcgtagaagtaatgttttgttatttatttagaaaaaaagcaaatggagaaattcctctttctgattggattttatggtcctatgtggcaacaccctagagattagaatctcatagtttagtgagaaagacttttttagaatgatctctgaatttgaaagacatctaaaacacaactcaagcttgaaaaatgtctagacttttttttaacagacgaggccactgggaatatggtaaaacaacaagagatggtttagtttcagatgggaatttatttcttttaagcttgtcaatgagcagacaggcatttgagggggagtctctttgtcctgtgattccccagcctgggaagagaaagttatttttattcccagttttcatcatggaatgttaaagaaaatctgactgttctttcattgagtgttgctgaattatcctcctggtttcaagtgtgaactacagcagcaattccactgtggaatattatgaacagagttaattataactgtttaatgaggcagatcccaattttcagtagatcatgacccttaatacattaaagaagagagacagttcacatttttattcaactgacatttgattaatatgcttcaaacaagttttggatatactgagataataatgaaatggactttatcctgttcataaaatgcctgtaataaaataaaaagtatcagtgttgttcttgttgttgactagctttctgatgtcagtttcaggttattaagggaaacttcagttaaaaatatcattggatttccctgaaggtcacaaagttagaacaaacactagccttcaccatcagtcaaattcagatgaaaattccttctctgccacctacttttgtccttgtacaataacaacaagaataatactaataataccatttactgagcaattatgagtttgagccatatgaacttgtcatttctgtaagctaagacagtggtcaaacgtagacattttcatatggttcagcctaatacatatactgaggcactgtactaaggctgtgtagatgtcatctcaattgattctttcaacacagttttaaggcaaatataataatcaccatttaaaaataagaatatctggccttacacaagattaagaaagttgcccaaggtcacaaattagtaaaatgaagacttaaaactgagctatcttaggacctcaattttctctagtcacactataaaatagatattatataacttcccctagtcttaatttcctctgattgggaggtgcttctcatggtgaccaagatgtagtggttgctacataatgtgtagctgtaactaccatcagtatcatcaccatcatcaccatcattatcatcagggcctaaagtttcacttgctcaaggctgtgtacagagcgtgcacagttagagaatgaagagatgcaactggtgtgtacgtgtgtgttggtgggggtggttgctgagaggtcttttctctatttgcagtcacttcttgcaaaagccattgtgtttgagctgaacacttgcacatgcattttgcccactttgctattttcaaaacaaaagagaaattggaagaaaataccatattgagaacagaggtgcctgtgacaaattggattaattgaaaacaatccaaaaaaaaaaattgccccagttagtaggagagtggagatcaaattagccatggagaatctaagtagaggattttattgattgctgtcggcataacctaaattgcagaatgtgagtcatcatgaaagcactactatgtctgcactgataattgagaggctgcatttttcatatggtcaagttggagatagtgagtgtggccacctggaatcttcccaaccgagtcccacaaacacctcactgcctcagccacctgccccatgcattcgcttcccaaggcacaaacacagatgataattttacaaaatatagtttttaaatggttgttttcctggatttgatttgatgtgcagcatacatgtagacttacactatgcagactgagctattttaatgagaaagaatgaagcatttccattttgttctatttcagagggagggaagaacaaataattctgttgttgctcgcagaaatgactataagacaggggtcagtacactgcagcccatgggccaaatatagttctataaataaagttttattggaatacagccacgtccatttgtttacatattgtcgatgcctgctcttgctctaaaacagcagagttgagtgactgctatggagcacatatcgaaggcagaactggaaatcctaattatctggccctttgcagaaaaaactgtgctgacctcttctatgcaaaatggagtggttttagacaactaagttgactttgtataagctcaagctgcctttgttttgtgtctagtgttgcaagtttggcagtgaggtttggggatctcaggtgttgacatgtatatctgccaggacgctgaaaatgtctacatccaggagtattttagccttcacctacagcatttggcagtagatacgaaccacatgttcagagagagagatttaatctatgaaaatacaaaattacaaggagattaggaagaagttgcctagaaataggcaggagccatcacccgaaaatgggggcatccttgtccgtggccgttggtgcatttgcttatatggacaggggcataggttgcaggttgctcttcattttcctttctgggagacagagaggaaataggattaaaaggcagttcagatgagttaacatcatggcatagccaaaaaaccccagtgtaatgcaatactctttatacttagatatagctgagtttttattggctgtttggaattgggcatgttacttatcatctcagcggttttctcatctccaatatggaaataaaatacactttaaatgagctatgtataaaatgtgccttgcgcaatacagaatatagttagatgcataaaaatgttagttactctccctttttattgtctttcctctgtcacacacagagctttataattatggtagaggggcatatagtcaaaggaggggaaattcttgcatataaagggactttgggagtctaggacagaggttgaacctaatgctaagtaggttggaatttttttctccatgtcttgatctaaaaagaaatcacagaaatctcacctttatgtgtttccacctctctatatttggtaagaagataacatctcagtaaaatgaaatggtagacagaagcacaatctcatcaaagctgtgactgggaaaaatactgaaactcctccctagcctgggacttggaaacatctactgtcttaattccccctgtgccctccaccccccaaattaatgtctaccttgagctctcagctctgtccacgacagagagcttcatgtagtcgtttccaggtgaattggtcaaaactgggattatattccgactgcaagcataggcaagttcagggatctatctgttctctccaaagacagagggaagtgggaggacctcctgaggggtggtggcagctttcctgcatctactgaaacctactttgtcctgctgccaggtctttgctgttggcctctgccctaggtgcctccactgctgacactttcagacctgccgtgacccccaacactaagaccacataggctgtcccgtgtacccctcatcccaacacgcccagggacagtcttggccacgtctgtgcctcttttggggacagaggaactatggatgttctaacttactgccctgggctcttgggaaacgcgagggctgagtgaggtccctgcacatgctggtgcaggccgagcacagtgcagtctttcttctttcactggcactgagaagaggggacctatgtgtggctgctgcttcccagaggtctttatgggaagcagccccaggtctcttcaactctcaatcttcaaatgtcaagggggttctattgtttctcactgaccccaggagttagcctgagggttcgggcccccacagtgcctcatcctcagcgtctaactcactaaggtatctgctcacagtatagcttttctctgtgcagagctctcctctcccggaccccaaagtattttggctccttgctcatgcacctgagtacatcctccctctcttggccactgccatggccctttaagggaggtttggctgctctcctatggctctgttgggctgcaagtatgtaatatggacccttgcaccttgcatagagttccaggtgctatatagatgtcacaatgtcacttcaaagctgattacttttcttttttttttttttggtagtagctaagattctttaatttatagttgaccacatccctgctccctatctcacagaactgacgccaaggcctccatgaattgtgtcacatgggattgcattagctactgcaaccaacaaataaaaacagcaaccacttaaacagataggtttttttcgcacagcaagaattctgggatccagggttattaaggtggcttaatgttatcagggacattctggctctttccacctttcatatctgctatcctcagcatctaggccttctcctcttgtttgtgacctagtggtctcaaaaaggctgctttgcctcaagaccttaaaactatatcccaactagaaagaatgaagaaggataaggaggctttttcttttaattcaagattagaagatccttcccccttaccttctagctatatctcagtggccagagttatgtcacgagcccacacttagtttcaagaggtgctgggaaaaagtatattggatcctttccatccagggtagaggaagacaaaggaaagggggtttgtgaatggattttgaacagccaatctacaatatctgccaaaggtcagacagaggtccttagacagagagcagtaaagctatttcaaaagatggtattaatctatgatgtcataggattacaatttatttagcttttctgaaagttcaaaaactcttgctgattcagatcattaatttagtgaggaattgggttggtggaatattagggtatctttcatgaacaaaggaatttctaaattaatgactagtggaaacaagatgggtggtaggaatcatatatcaccatcttaggaaacaaactttttaagcattttcaaaggaatctcatgaaaacaattgatgaatcatataatcttaaattatttttttcttttgggtaaggctgaattaccccctacttgccaaaacatgctggaaatgttttattggcttaattttgattcctttatatatatgaaagtaataaagctgcatttctttaaatatatttcctaacttagagctttcataaattcacactggcttttatttctagtcttaataaattagattctaccgcatattgaatataccctgttaagtatattgaaacagtacgatgttcactgaaggaggaagcttaacatgggaaaaattaaagaaataaagagagcatcaggcaggtggttgcattacccaaaggtgagcaaattacagcccctgggccagatctcacctgctatctatttttcataaatttaagttttactggaacacaccgactcatttctcacatgttgtctatgttgctttcatactacaatggcagaatgagcagttgtggcagaaatggaatgacctgaaaatttgaaaattatttactatttgtccctttgcagaaaaagtttggtgatacctgcataactagttatgggggattccgtgaaagctgaacacagtgactggatccctcttctcttcatgtggaaattactttaatgtttaagtaaagtaacataataattactattattattactataataatgtatatataatatatatattatatatactatatattatatatattatatatactatatatactatatattatatataatatatatactatatattatatattatatatactataataatatatatattatatattatatattatatatactataatatatatattatatatactataataatatatatattatatattatatatactataatatatattatatatactataataatatatatattatatattatatatactataataatatatatattatatattatatatactataataacatatataatatagtaataattattattactataataattactaattactattaatatttactattagtaaaatatataaagtaaaatgtagcagtagtgtgttcaggactcctgggtatgagccattgggactgtcttagtcttgccgctataacaaagtatcacagactgggtggttgataaacaacagaaatttatttttcacagtcctggaggctgggaagtccgagatcaaggcaccagcagattcattgtcaggtgagggcccattttctggttcgtagatggcaccttctcattgtgtcttcatctggtggaaggagcgcatgagctcccttgggcctcttttgtgaggacattaatttcattcatgagggctccaccctcatgacctagttattatacctcccaaatgccccacctgttaatatcatcacactgggaattaggtttcagcatatgaattttaggaggacacacacattcagaccataggaggggtattaattttcatatcaaaacaatgggttctgtttctgtcttcagctttagcctgtcatgaaagatggtctcaccatattgtatttcattctagcactgagtctgctgctgacacaatgacaggggccctgagtctgcccttggctggccctgtgccctggagcaagttacttaacctctcagaaacttaccttccttatgtcctaagtgaaagggtgatattgactgaagaaaatgggctatagggtctccaaatttcctttcttcacaaaagttcccggatacagtgataagacagcctatttcttatctgacacagatgattatttttatttacaatctcaacctgaattgtcttttccgtttggtgcgtatgttgaccagtgtgtcctaacaaagtagatctgtttcattcatttgcaactctttgtgaacataaagcatttgccacttcaaggacaaaagctgagacctaggtctgcagataatggaaacagctgatatttactgaacacctgctatatgccagacacttctaagtgctatatatatatatgcttatttaatctgcacattagccccaaattaagtattatcattagctccattttataggcaagaaaactgaggcaacttgcccaaggtcacacagtcatttgggtattccaccttcagggcccattctttcaaccactcttctttctgcctctcagtgggtcaggctttagcacagtggctgttctccatcttcacatcaatcaaggggaaaaacaggtatgagagatgcaggttggcattcctagaaattatgacacttgaaaattagaacaagactttcattcaccaaagatctactctgtgccttcaagatcatgcttcaaggctccttttctcagcctgctgttctcctaagtcagataaaaaaaaaattaggatgatagtggcaatgcaggttggaaactgggtcatttttctgaaatcatctttctttgccaatgccatttttgaattctttctgagaattaaaaaacaaacaagcaaacaaccgatgtggaacaatctgtggcagatggttatttcagctctaggtgagtttttgtcattatattctgggaagtggaaattattactttagataatcatctgttattttagtgaactgccagctaggaactattgtagctatacgggtttaggatggggatttttttttttcctagagattaggacataaattattttcatttgaattctgtggaatttttgatgttcagcatgggagggcattttcactatagttccttgctatgagaatgatctctggcatagaagaattggtattccgtgccattctactgaatataaacaagaaatctaacagttcagttgggggtgggagaggtgagatgaaattaggcttaaagaacaagttagcccacttttcaaggtttagcttcccctggaaaatacagcaataaacatctaaaccatggtattcattaccaacgcaagtccctaattaatttattttatgttaattaagtttataattatatagtaaaacatttactttctccctcaagaaattgactgaatcttctgaaggggctttgtgactgtaatttaggtgcaattagccagttaaatttagttagggtttggttcatttagctgctgccggaagatggaaacaggcactgtctcagaagcaagcctggatagagagtatgtgttcctggaggcactcctctcgcctttggacagctagttctgttgtctagaacaactggaagccgaagctctatcaagatatagtttctttcttttttttttttgagacggagtctcgctctgtcgcccaggctggagtgcaatggcatgatttaggcccactgcaacctgtgcctcctgggttcaagtgattcttccggcctcagtctccggagtagctgggattacaggcacctgccatcacaccagctaattttgtatttttgtagagatggggttttaccatgttggccaggctggtcttgaactcctgacctcaggtgatctgcctgcctcggcctcccaaagtgctgggattacagatgtgggccaccgtgcctggccaagatgtagttttataattaccacctatgtgtatattcctcagtcgaggaatgcagagtcaattccacaataaaggatagaggcaaaccccttttgcaaaacatttccttgtggtcccagaattggaactaaagccatggaacagttctcagaccctttctaccatgggtgtgaaatcactggcatttgccagcattcagacacagagtgatatcagcagccaggacccaccatttggctggaaggacatcttacctcccgagaggggtcaagagggcatgagcccaccctgtaggtctctcaagctggggttctggggccttcctccaggaacctaaagacttctttcagtttgggccacccttttccaggaggaaattggaattttggggccactctttcagtttgggccacccttttccatggggaattggaatttttgagcaaagttcctttccatgactttttgcttcataactcatgacaaagaatgtgttttggcccatgatttacaatgcaattgatgtgatcatttgcagtggctgctgagctactgcaggcagggttggtgttcactgctcgtgcctgcgaatggaaagctggaaggcactgaggtactcacattagttctggttatcagaacctgttagattttttttcatctctattgtaaagttggataactgaggttcagagaggtcccctcacttggccagcatcacatagctcaggagggaaagggataggatccaaacgggtgtttctggttttagactgcttcttgctgcctaaccagcggcaggtgggtttctttcaggcatcactgtagaaatgaatcctttagcacgaaatgcgtggaatgactgtactttttaaaattcaaattccagtggtactagttagtacagacagtccctgacttaggatggttcaacttagaattttttaactttatgatcatgcagtggtgatgagcattcagtagaaagtggttcggtattctcctgtgacgctgagcaggggcagcaagccacatctctcagtcagccacaggattcagagggtaaacaactgagaccctacaaggttttgtgttgccgggtgattttgcccggttgtaggcaaatataagtgtctgagcagttttaaggcaggccaggctatgctatgatgtttggtaggctaggtgtattaaatacattttcaacgtactatattttcagctcatgatgggtttattaggacataatcccatcatcaattaaagagcttctgtttagttctgggatcttggacagttaaatgatggatggtaaatggccataattgtgatgaatgaaaggaaaattaatatataatccagtcattcctgctatacccatgtaattacactgtgtcttttcatctatgtgacattttaaattttttactgctttcgcagaaggaaatgcatttgtccatcacatgtttttcaaggcctcttgttctttaaggagatgatgattccttttttaagctaagaatttgcatcgggttatgaagtagatcgccttttccttttaatcactttgacttagccaacaacttcctgtaagttttggaaaacatctcttaaaataatgtcagatgttttgggtacattaaatttttattttaaaaaatctaaaatgcattttttttccagtgtcttaggtctggttgatttttagcatggtcaccataatttctaaccaagctgttatatttggaatgccttagctggccctccatactttaaaaagaaaaataaactgcgaaatctggtgtgtgtatatagaaatttatgccctttagaatccagggttttcctcatatataaattccacttgaaccaaagaattatgaagggacttcctgcgctccaacatgaaggagtcgaggagaagagagaatccttcagaaagaggtgttgctgtgtaaaaccactgaggttggcacacgccccgctgctgtaagacattgttgagcattaggaaagacagtgaggtgggatgacttagcagcatgggcttattccaaaatgagctctttgagcaaataaaaatgtccctgacagcagaggcttctagaactgtgggttaatttaactcaagtgaggggttctgttggctgcctcagtcggaacatatataaggctgtgaccctgggattggctttgcacttttcaagtttcctattgagaatctgctttcagatagagtaagctctctgttttaatggggctttttgaaatgggtcacctgctaagcttaaggagtgtgcatagtgatctgccgttgacagtatcctgagggtgccaccagatgtggaaaagctttaggagcgtggattctgtgctcatgacgtgaatgagtgggttctcttgaagactgatgaacaattcagggatctgcccttataaaccttgctgggataagacacgatcactggggtttaagttgggtatgcctcccaggatctgatctatgactttcaatttctcttacagagaaatgtcaattaatgccccaggtggactgacaaagggcaggatgatcaccatttcaacctaagcttccccagataccaacagagtgccaaatgagtctgtgcccaccctgctgtggaggagaggcacattttaattctcactgtagctaggtaatgtctgagatgatggaagttctactaatggttgctcctgggaacaggcactagagaaaaaggggatgtctgggtaaagaaccttctttcttcctcataatcctcctctgttttcaagtttgggcacatccatttctttggtaaaaagctgaagccagagaagtgtctttgaagcctggaagctccctgctctgtggccaccctccccatcaggggtcacacatctgcctgcagcagcgtcagaagcagatatgcggccctaccttggtctgggagcaggagctggagcagtgggctgttaatgtcctcacttgtgggggtgggcagtgaggaggaggcaataaggcagcagcacatggggagagggataccctccgtgggtctggggatgaccacttgaactaggttccttgaaaagccacagttcagtcctctgaatgaggacttcagcagtttcaccttgtgggctccagatcataggatgttggcctaccttccaagaagtccctggccaaacggaacccaggccttgcattttatcccactctcaggcagagttgggtaattcatgttttttgtagtcagttcatggggattattagccccacatatgtatgtttcgcattccggaatacttgctgcttagctgaggtttcattatcttttgctcttagctaatttaaatggagatgggatttatcaggtacctgtattcaagtgagggtaatttgtttgaccctcttctagcttaattggtactgctggtggatttgacttttgggacttgcagcaataggcagagacatcggccacacataagcccccctgattgttgctatcttaacacgaatactaaatgttaaagatctccaaactctatttctgaagtattgcttgggatgcctgatgaaaaagtgttgcttcatgacaaattttattttcacctacactctttcttctagggtcagcttaaacttggacctggatttatcttcctgttttggaggcttattatctctgtttttactcttcaataattgtgttcagtctctgaacatgcttgaggggtctgaggcgcatcaataccaaccactttaaaaaaaaatttctcctcctcctcttcctctttctatctcttgattttcatctcccccacaatcattatcgtcatcctcacacaggcactggctgacctatgtgtacttcttttatgtgttttgttgtacattatttactttgtacaaattgattcccagatccactttggtcaatggcctacagtttcagccaaaattgggcagagccaagcaactcacattgtgtatatctgaggttcttgcagattttatatagttataggttgaattgggtaatggatttatatcattaacctcttgtttggactctgcaagtttcagcactctggcttcatatactataaagaactggctagagtattttgacgaaaataaattgaggcacaagatctatggtggcagcagcaactgcatactcttctgtgatgacatatattgcttatctgtactgactatttgaatcactgataagcccctctagacttagaattgtggaatgacatctttaagaaaatgtcatttcactctacagatatcgaccctatagatttttcaatatatgtttattgaagcaagacagaaaggctagacacagcccaggagaacaatagattaatttgggtgtctccatgtggtagtagtaaagccttttgagcatctgagtacctctcaaaccacaaattcttctttctttttctctactccacttaaagcaattttaggtgattctgtggatggggcaatggtatcagtctttggatgcattccccatcctctgtgaagtctctgaaatggtagttgttgagtcctcggacacttgtcatcagagcctgctgattagagcacattccccttagaattgttgagttttaactgtgcaataactttggctttccttacaaattccagctttgccaagtgtgctttctactttcattttcagctcataatgaaacttcattttgcaacatcagaccagagcttttcctttaaaagccttcctgaccatctcagtaattttagtttttcacctccagctaataaatggaccacgtttttttccctttgtcccgcatacactactgtaattttgatcaaagtgagaattagaataaaccaagtctagcaccttttccccagtagattaaaatgctccaggaagtactcactgtgtgtccacgtgtctaactctgcagccttcactatacttctgagaaaaatgtgatttcgtactggaagctttggaatgcctggactcacccagttgccaatgagaagcagtagatcctgcattgtgttgcatccttcattctccttcaattcagttgggttgttgagtacactgaagtttgctatggtttgaatgtttgtcccctctgaaactcatgttgaaacttaacccccaatgtggcagtatagagagttgaggcctttaagaaataattgggtcatgaggcctctgccctcatgaatagatgggttcattcatggctcagtggattaatggattgtcacaggagtgggactggtggctttatacaaagagtaagagacagctgtactagcacactcagcctcctgggcatgtcatgccctgtactgcctttgaactctgcaaagatttcccaccagcaagaaggccctcacaagatacagccccttgaccttggacttgtcagcctccataactgtaagaaataaattccttttctttataaattacccagtttcagatattctgttataagcaacagaaaacagactaagacaaataaaactcaacatttagaccttactattgtgaaaccaaaaatgccttcagctcttggtatttgtgtgaggccatgttgagcatagaaaatgtatagatgtgctccctctgtcctcctgtgggatgaagtctgagatggagggaaatcaaaataaaataaacacaagttttaaaaggtacaaaagaaggtccatgagtggaagtgaatgcttcagaagtttagaggagggtgaagtaggtacttgcaggagaaggcttttgcactggatcttgaagaatagtctgagcgtctcaaaggagagctcatttggtgggaggagatccaggagaagggataatatgtggacaaagtaaatccttgggaagcaaaaggggtgttttagggatgtttaagcaacttctggattgagcacagagaagaaaggaccaggaccaagaccaggacctaaatttatatatggggagatttctgctacaggtgcagatgatacctttgccaaagagggactgacaattccgaggctctgagtttagatttcagctctctcattcattcttgggtgaccttggacaattcatattcaccatgtgagttgagccagttatctataaaatagaaaaagcgacaacagcaagggatagttggtgcagcaaccaacagatataaagtgctccacaaatatcaaattaagacaataggtgtttaagcccagatgctgaacaaagcacaactgtaccttgctcacatctcactttgtgatggaaagtttttgaacccactgtattctagacacacgatgttatgagaacataggagtttattatttcattttacctagtaaacattttccagaagacttaaaaggcatttgttttgctttccaatgaaggtgagctgctaccttggtgccccatccaccagatcatctccaatggcaccatgccacgcagatgctcaagttggcagttttctgcttgaactctcccaatgacaaatgtgataagatttgcttttttagatagcagctgcatctttcttccgttcccttcacttcctttgggctcagcagttttcctttttgctccagataaattgctgttaatttaaatgtactgcagatccttgccattttatggctgattgcttctgagtaataggaggaaaatgtgtgcatgcttgaatgtaaataaatttaaatgggttgtgagccaatgataaaaaagcagagcacttcgctgaccttcaactcccttcccttcccagtctttccctttgaaaaggtcaatgagtagatcctaaatcagcaaatagcagaggttgagtttcaggccacatccagtttcttccttctctgttttcaactttacatcccatttctcagatagcacctgctttatccttgttcctatatagctcagctagtgcgtgcaatggtggcaaagtttctctaaagttgtttttgataaaggagctggtctcacggtaactaccatgcaccatcggaatgctacaaatgcttcagaatgtcacattgtcaaaatatctatatttcaggctcataagctagacagctcgtttggctgctaaacccacaagatgttcagccatttgttgtggtctaaaaactttccccctcacaaggagaaaataatcttctattgttttgtatcattttgtggtcttttgagttttttataatatgagagggcaaaagttatgagatcctgataggtaaatcgtggcctggattgaattttgctatcagtctctcttgaaatcaaattaatttttcaatatgtagtgaaatatctttagtctgtccacagtatgggaagatcaagggtatgaaagagtagggtgacttgccttctttgaggtgaagggggtggaagtgatagtttgaatgcatattgcttacaattgcaacaggctggcttttcctcagaagaaaaatgccgtatgtgtttttatggcggcttcacttgtttttattgcatgggcgtgtggagctgagatctacttctttgggaaggatggatcacaaaaggcaagcacaagaaggttgcagagggacacttgacatcaattgaaataagggccagggcagttgcatcctgagtggatggcaatggtccagtagaaccgtcatctggcaaagttagctgtgtttccaactgtaataattagtgagcctggaggggcttgtggcaggaaaatagcagatagaaacaaagaaagagaagcctggttaagttcctgctgtaaacatgctgggattagtaaactcttggagttcctgtgccataaacccattggaaataagcctttataccagcaggttaatcgtgttattgagtcaacaaatctttttattctggggtcatgctgtctctatcactaagtttctcctgtttttattgacaaagttgacatccttatattaatactcatattgtttcagtgggaaagaatttgagctccaccctcttaaaagctaagaagtttgatttgttaatttggcatgctcattttacatgccatagtgcactgttaaactagctcagcttctgtttgcctggaggcaaaacttttagaaggagactggagacagatatgaaggagaattaatcagtgctactgagtacttcctaaattcttagggcttttgtgggtgattaaatccataaatgatgtttggcatctgtactgagttcttttggaagggcaggagggagaaatgccatggaaattaagctccatagactcttttagcattgttgtaaatgatgacacagattggtggtggtacttacggttctggaggcagatgacactagcacttggcagaccagacaccaggtggaggaagatggagagtctacatggttgggcttagaggcgtcttccaaagttgaacttgaaaatgtctcggagatttctattaccacatggtctattttgccacttatggatctaataaagattcatgcaaattaaacacagtattatgtatactagaaccttcactgatccactgggtttccatgggcaagttcagtgaaagctcactgtcttcttcttgcagaacttatctcatagggttattgtaaaaataaaaaagaatagtttgggtgcaatgctaagtagagaacctggtgcaaagtagattcactgtcatttattgagcaaattatttactcatctttctccttctatgggccaatgaagtatttgaggtcaaggaactgtgttttctttatttttgtaacatttatcacagcgtctactgtttggttggtgcttaacaaatgtaggattacttaatgttagatattatacatcatattatttatatattattatatataatatatacatatactatatgtcttatagatataatatatacatatacaatgtactgcatgttgtatgctatataagttatataatgaatactacatctccatatgtgtcatatatttgctataatacttaaagttaagcaactaattaattattttatattaggattcttagaaaagaatagctgggcttggtggctcacgcctgtaatcccagcactttgggaggccgaggtgggtagattgcttgaggtcaggagtttcagaccagcctgggcaacatggtgaaaccctgccgctactaaaaatacaaaaattagccgcgcgtggtggcacatgcctataatcccagctacttgggaggctgaggcaagagaattgcttgaacctgggaggcagaggttgcagtgagccgagatctcaccactgcactctggcctgggcaacagagcaatactctgtctggaaaaaaaaaaaaaaaaaaaagaaagaagagagaagaatctaactatttgtattgtctagtatttcaccagttaaagttagccagttctctgggccagttgctgagtaactaatcagttcttttagaaaagatttgctaaaattagctggggaaagaaaatcaggatttgggtagataggtattgttgaaactaattccccccacccataaagacaaatattaggttggtgcaaaagtaatcatggtttttgccattgaaagtagtggcattacttttgcatgaacctatatataaaaattcttcaagggtcatttgtattgtacacagatgtttcctccttaaagtaagctgctaacagctgacacagttgtggatggagctgtatgcagaaatccttcgcatttcttttccttgtttcatgtaccatgtaaaatcagttttaagtttaaaactaagttgctcaataatgagatgcccatttcccccaacttctgttctgttattatatattgctctatggtttaaagtgtattccatgttgtgtctcatttttgatgtttatttattatgttcatttgaaagttattgtacttgtatgttaattttcattgatttttcttttgagcatgacttatgttttattttgtgtttcttttaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtatgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatccccaccccaccccaccccaccctgttccttttttatcaggaggacttcagagccaggcctgcagcattttgtttgaaaacacaatcagctctgacagttagacatgcacacagacgccatagctggattggaaacattgatgttttaaaaatttattttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtgggctgccagtttattacttttgtcttaaaacatgatcattgttctctcacggtatccttctgtcttcccgttgcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccactgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcgtaatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgtttttttttttttttttcctataatgttctgggtttaaaagccatcttttccacattttctgtaaataatggataatcattttaaaaaattttatttttagtgctgttttaacaatgtagatagatcataaatgtacttgctgaattcaatcatttttaacaagccaataaagtttgataattcatctccatgtgtcttgcattctctgtagatcttgtgtacttcctcacacttcctcaagtgtgtgctgtcacctgagtgcccttggttgtgttcagaactgaagactttagaagaaacagtgtgagaaatgtcacggagagtttcaggggagtaccaggcccatttcagattctgtgataaattatccccccaaaaaggtcttttaaaattcctgtcagtatgaattgtccattcattgtttactgattcttgcatcagaaatattttatttggctaaaaggcaatccttaaaaaaaaaaaaaaaacttatgcgaattttttttaaaaaccctaaattctatggcaaagccctttggtattttaaaaatttgaaatgacccaggtcacaataagagagtatactcaatgctctgtttctctattctaaatgactttgtggacatataaacataatgacttgtacttgaaagcgagagagaggggaatatgttggatgtagagggaagataccatgagaccataactgttagcatggtgcccacacttcatgtcccttttgtctctatcctcaggtcagctgcatggttcctgccccatttttcccattgaaaacaggatgtaaaagtgaggtttgtaggacctcaggctccaattcatttgagcctgccattcccttctgttgacacccaaagggttttgctctaaatcagacttagggattggaaaaactaatctagtgtgacctcatgctttatcaagtcaagtatactgcccctcttataaaagcccagtgttgggctgggcgtggcggctcacacctataatcccagtactttgggaggctgaggcgggcggatcatgaggtcgagagttcaagaccagcctggccaatgtggtgaaaccctgtctctactaaaaatacaaaaattagctgggcgtggtggcgggcgcctgtaatctcacctattcaggaggctgaggcaggagaatcatttgaacccaggaggtggagtttgcagtgagccaaggttgcgccattgcactccagcctggatgacacagcaagactccatctcaaaaaaaaaaaaaaaaaaaagaaaagaaaaaagcccaaacttcagtgttagtgacttgtgctttttccaaactcccttctccatttgttgaacgaagaacaggttgcatctaacatctgaaggtcatatgataatttggagtggcaggcatttgtcacagactatgcaggtttgaatcccagctatgctcacgaacaatataatcttgggaaagttctttcactgctccgtgcttcaatttcttcctttgcagaatgagatgatggtaataagaatagtacaatatttacctcactgggctcttataagagttaaatgagatggctcaggtaaagcccttggcacattgcctggcaagtgggacactcggtattgctaataactaatacttcaaaggagctttggttggcgagtcgttgggtgtacctcggtaaatgtccacgaattacaaacccactcgcatatcttggtcatatgcagattgtgtggttgcaaataatggaaaccaaatgaaaggaaacttcactcactgggtcatcctgggtgtggcccaacctgtgaaggccactttggaattgtttcaggagttattaggattctgctcttgaattcttctctttatccaagccaattcttacacactgattctgcctcaggtttgattttgataaaataagaggatctgatttatttggccaatattctaatagttccatgagtttgaatgatggtctgttatttgcaaattcttggagaaatagctctgaatgtcttacactgaatacagctggcctcactagttctcattttgttaattcagatttctttttatcatttcaacagggaatgcattaactttactttttgaattatctatttaaaaatctttggctaagaatgtaagtaacaacttagccaaaagattgtttcaaagaaaagacagtttcaagttccctcaagacttagaaacgagtattcacaggcaatgagttatgaataactagattattcttttccttcctgaagttgtttctggtaatagctctagaaggccacacatgattggcctagttggaactacttcatgtttgaagtcataaatttcatgttattaaaaatacttcataatttgcacttttttcctatcattaaatcattttaaatgagtggcgttgatgtatttctagcacttaatttaggacaattttactattgctaccacctttcctaatacatcctttagtgagctctaccacaggacctaagagataatgataggtaacaggtattgacttcaaacttaagtgtttcatgatcctcccaacaaccttatgaggccaaagctaatattgcctgtattgtaacgattaggaaactgaggaatggagccatgagggacgtgcctcaggttaccgagctaacaagttaacactaggatttgagttcaagcaggctggctgtaaagctggtgctccgtatgtgaactggattcttgaactgggctggggctagagcgaggccagccaggtgtctagggcacaatttgaaagacggtggtaactcttaggttcatgcaagtgcccagtggccactcctactagcactggcagttgtgttattgttgcactaaagtagaattctaaagttaactgaagtcactggagaggcaccccttgatcccagcaagtcttcaggtatttgtgccatgaacaaatccttttcagatcttgacttgcaagtatgtggcacagtagtgaaattggcacatacattttaaatttcaccttgtgaaaaagagaagttgcatcaagtctgtaattcagcgctaattagttaaccccagagcacgtttgctttgtccgttataactgaagatggatttgctgttttttattgccttcaggtgaattttctcatcactcttgaactttagtacttcccattcttttggagtagtccctactctctggtgagtgaacttgagggaaaccttgcgagtggaaagggcctggtgggaaggggtgtggaggacacgtcctgccatctccatgaacagaatccagacatcagaacaaggtggtgaaaaatgcctgcgctgttccttgcctttcgaacacccacaggcagagcagcgtcggagctgcttggtcacttcaatgtgcctgtcctcgaatgtcccgtctggcagccagtgattgagagagactgctgagggcacatgctaattttccagtcatttggtcaagccccatctcacacgctacaagaccctggagcctgtgtttactgagttaaaatctctgcctgaccataaattaatgaacagtaagttccctccctctctcttttagaaatgtttatcctgttgccaagaaggaaaggagaaacctcttttgtgtttattaaccacgcttccatctctttttaaaaattatcatcatgctgtaatcagtcttgctgaattattatatagaaacataggccacggctgtttgctttaaggattttaattcagcctcaagtaaattcatgcaatttcacctcaagccccttgagtcggggtaggaagtacagagtcgccagcactgttttaccttacctgtggagagttctaggtttgtcacctgaactaggacacagcctctgagggtgcttccaggcttttcaaagactgctctcaaggcagattttcctctttgcgtttactccaggctcctgggtcttggggaggttgattgattacctctccatcacgcttcactcaacgctgttgaattgaatgccacgtctaattacatgcaggtctcctgctggcttctcagggtgtctgacccatggggtgcactggcaggtctcaggcagaggaggcgttcagggtatgtctgttgtgttccccctgtggaggcgccagccttaaacaggctcagccctccctatctggagtcctgcagaatggcgccttctctgtggctccagctctgtctgggatccagcaaagctattttcccttcctgatccctggagttggtaagggcttcccactgttgtcagttcctgagtgcctatttcctgtttgtttctttaccccgcccgcatctctctgtgtggccctacaatatatctcttcatttgaaccatatggggtgagttatttttccttgacaaaaccctgagacatatgttatattctttaatgtatgatctcattttatcttccatcaaatctcttccaactccagtaaatatttattaagtgtcaattatagttgaccctttaacaatgtgggggttaagggcaccaatcccctgcacatttgaaaatatgagtataatttttgactgccccaaaacttaactactaatagcttactttttttctttctttctttctttttttttttttttttggtgacagcgtcttgctctgttgcccaggctggagtgcagtggtgcgatctctgctcattgcaacctccgcatcccaggttcaagtgattctcctgcctcagcctccctagtagctgggactacaggcgtgcaccaccacgcccagctaatttttgtatttgtaagagagatcgggtttcaccatgttggccaggctgatcttgaactcccgacctcgagtgatttgcctgcctcggcctcccaaagtgttggaattacaggtgtgagccaccgtgcccagccaatagcttacttttgaccagaagtcttactaattccgtgaacagttggttaatacatagactagtatctacatgtattttacgcattcatgacatatttaacttttcgttaattttttcaatatttctatgttacaaggttcatctgttaattttttcaaattgtttcaaatctcctaaaaatttcgaatatattcattgaaaaaaatttgtgtataagcggacctaagcagttccaacctgcgttgttcaaggatcaagtgtgtatgtcggccagtgagctaggtgctgggaggtacctccacaaaccaagcaactccatctttggccttatgggctatggcctaatggtagtgtgtataatattgatactatcactgcccataataagagaacaatggcttaaaaagttaaatgacttttccaagggcacacacatcagatttgtctgcctataaaatctctgcttctggcattgtttctctgaggccaatgattttcctttgtctcttgggtgtctctaggctgcaagttctgagctagccataagatctctgctcttcattttggtggctgtaattcttcttgacttggtgtaaatgcatgaagtatccctgcccttgtaacctgttttcttttttttatttctcttttatctttttttaaaaaaatcattttcttctcttttctttcagttctctttttactcaagacaaacaccataaatatgctttgtcttttctttaattttcacactttaaaattttcaaattggttgggcggaatgtacttagcttgcatgtttatgtgtgtgtgcgagagagagagagcaaggaaagggcacaagaatttacacacacaaacacacacacacacacctatggaataggaataccatgtattttcagttctatttgatcaaatgggaatgtaatcccagtacatacaccatttaccattatcacctcctcagtgcttactgtgctgtaacactcccagctcttcttaaaaaactttccatgttgtattttttgctctttgtttttacttccttataaatagcaagaagttttgctgagaagaaataattacaaatcccaaaaggttggtgttccgttctgagctccaagatgtaaggattgagtggatttcaaacttggcaaaatttctgacttggcaaatgcttccatccttatttatgacagcttggaaacttccattttccagggtttataaatgatgctgctgattttgtctcctttttttattttgctgtgaattataaaataaccagcctgaaggtttccttataatattaaccctcttagcagagagggagagaagtagagagagagagagagagagagagagagaagagagaatgtgtgtaaattgctgtgttctttcttttcttggttatgaggtgcattttacatatttcataagcccatttacttccctttttctgcctttcaacaaaatgaaaatctagaaatgttgaggtttgggatacagagagtgacaacctgtgtttgtcattttcaccataaaggacttcttggccagcagtcctctaagggatgatacatttcatctccaaattgcaatttagcatttggaattctggagcaagataggtaatgcataaagtatcagagagtctttttctagtggtgtgaataggctatttcagggggtctccatgcccatattcttagaaaattgtccaagtggaggaaaaacaaagaagttgtcaccttcttttcccttgacactcctcccccactgaagccttcttctttttctttttcactttcttacttctatactcaattcctcaaagcccactcatcttaggtttcctttgtaagtgctttttcctttcgattcatgggaatatgaagaaattaggagccttcatttattgggtagagtagatagattttaccaaatgtgggcaataggaattttgcagtgcagaatgtgtcctctcagaagcagacaccaagatggaattaaagctgcaaagatttttatcctgagaaactcttgggtgagagaaactgggaagggaatccgagagcaaggatctgtaagagcatcagactgcaatgcaagcaggactgtgggtgaataagagagggatggaggcttaggtcaagcaccctcgactgccgttcactctagggagttactggcgaggctgctggggagtatttgagccaaatcagccatcagaagacttccttgtctcccaggagggttctgcctttatatttccaccactctcactcattggctctggagcttggcctctgtgcaaatgaggcgataaattcctgagttcagcatttggtacccttggtcaactatgttccctgtccttgaaggtctacgaggtgcattctcaacagtagacactgtcttatctgagctccacttaacagatatgctcattaattgctgcttgccatctctctgtaaaacacaatgaccaacctacaccctggacactcctggctgaacatctgggttgagtgctttcggaaactccacttccttaaatgacctactgtcagtttcattggttaaaagggcttctactacaatcattttttttttttaaaagtacccaggctgggcaagtcaacattttgaaatgtttaaaaaatgtaatttttgagctgtagctacccttttatttatggcaacataaaacaacatctgaaactaagacctgtttttgtttttctcgcctacatactaaaaccacgagtgatttttatttcatttcattttgtgttccccatcaaacaaatttcctatcatgacagctcttgttattgattcatattctttcagaagagtgtttatggaagtgtacatcaatgccttgccaggcatgaggaccaagtcggagtggtacagagcgatgcatcctcttacacaattactcactcctggacttcagcagcccttgcattgaattgttttcaaggaaaatgagaccttattcagatgcaaccaactttattgagtactttctatgtggtagaccataggttcctgattcaaatgactacaggttgggacagtcctgggcgtcagtagctggggtggaggagaatgccccatgcacaggatagggctgcccctagcccagcccatgttggcgtgcaggaatgaaagcctagcgtacccaaatcttctgatttttttaagacaaggggagatccgggtttttatgtgaaattttctagtttttaaatgttggcaagacccttcacattttttaaggtctctatgagccaaacataacaagtgttgatgccaaatgttgccgtttgtgactttctggctggacattctgctcgtggctttcagacgtggttcctttacaacagccctgagtagatacttgtcttaagtcaggcttcctggaaacagatgctgagatgaggattcatgtgcaagtaatttattaagggtgtgcctgggaccggtatggggaagcaggacagtgggggaggagctaagcaggagtatgatttgagccaaagccttgtggaggtggtttcagccatttagtttcagtggtttaagttgcccttcagagttgtcccaccctgagcttagggagctgggctttcatatgtgtacacctgtcagtcattagctgcaggttgcaacaggcaaaaatgggctccaatagctcaagggaaggcctccagaaaagtgacacaggtgctggctgttggcactgcagggcacacaatggcagtaacagtggttctgagagaaccctcacgacccaccaccagcaatctgtggctctccctagtcgacaggctgagccagaattcagaaactgatcttttgactctgtggccagtgcttgttggcaccctttccacctgcttcttactgagatcagcatgcagaattcagatcatcttagaccctggcaaattggtatgttggccctgggctactagctcttcttttcctctagtaatgcatggagagagggtggcatggctattcagaggtggggcagcccaacaggagcaagaaaggggctctggagcccccaaccctgtaggcagccctaaatgggctcccaagagaggctgaggcagctctcagttctaaatttttcttgctaagtttggcaatttcttccctgagatgcagacagtgtttctgggtgctctgtgtcctggtgagttctgggcctatgagacacacttgtccgctgctggaaaggtggaccttttggggaaataggccagcagcttctacatcttgcatcacagtgccacagtatgtaggctgtttcctttggagagcttaaagctattcatggttttaatttggagatacaccctctaaaatccaaccaatttcccttgaaggaaatctatcagatctgaggagagaagacagaagctacagcaccatctgctaaccaaacacctctggattttgtgggttccagaggcaaaaagatcagtttttttttttttttaactgagttcatcacgtgttcccagacacacctgccccgtgccttctgctgtagtggacaatttgctcatccttccaactcctggattacccaggacagctttcctctccctgggctcttgaatgtggttccaaaatcaagccaagtcttcctcacccaaatctttcaaacctgtccattttgtgtacccccaccctgtctaccatcctccaggccctttgtaattgagagggccaagctggtcttctctctccccttctcaccatgcttccaccccctgagccccacattatcttcccaagatgcaggcttgagccttaggcaacttgcgcagctgagtagattaagtccaagcttctcaaaagagcatcccaagttcaggacattgtcactccagccatgcttccccacccaccacctctggtccacttccttaagctgcctactccacttggtttgaccctcttcctcccaccaccctcaacttattgattgggtgaccttgaacttggcacttaactctccaagtcttagatttgtcctcattaaaacaagggtggggtgactaggagatttaagtggaaaaaaagtctggcaagtcattcagacagcatggcatgcagtaacagaagcaatgaccataacaatgattatcatgattgttacctatcttcccaccctcctagaagctggcacagaattctgcacacagagtggcaccttctttcctatacccccatattaataattgtgccatagtgttcatctggtgagaggagcttgggtctgctgttgctgcattaaactggattgctccaaagcattagaccacatgccactcctgtcaaaggtgctactgggctttcaaagaaacagatgaaaaagatgtgattctcagttgagttcacttttgttgagatgtgtgaatgtttctgagtaaagctatgtgggacctcatagctgaaaggctgaatcagaaatagggagcttctgaggcacggaagatcagtaaagctttaggattctgaatgaaactaaattccaccccccacccgccatggacagcagaagcaaagatctctggggaacttcttcaggatgtgaaccaggggctgccataacaagttaccacaaacgtgatggtttacaacaacagaaatttattctcatcattgtggagtctggaagtttgaaagtgaggtgttgacagggttggttccttttggaggacctgagggtctctcttagtttccaggggcaattatcggcatcctttggcttgtagctgtatcactccagtcactgcagctgccttcagctcgccttctccctgagtctctgtgtcctctcttcctcttatagaaattctcattagatttaaagcctaccctaaatccacgataatctcatcttagtaatttttaataacatttgcaaaggcccttatttccaagtaagatcactgtcacaggtttcagggctcaggattggacatatctttttttacaggccaccatgtaacccactacctggagaacagagttgaactgagaggttgatagcacaatggaaggtacaggatgtagatgccaagaagatctgagttccaatccctgtttggcccatgatgtggacgtatcccctaacctcactaaatctcagtttttccttttctgtaaaagggggatactcatttccaccacgtagattgtgagaataagttaacaatgcatgtatctagtacttagtagattcacaatatagttattgtctatagctattaccaccactcattcattcatttaataaaaatttaaatctctggacatcaaggtgaaagagacatatcatatggcttttagtcataaaaacactttgaaggagttttgtgtttgttgaatgaataaacaggtgttcagatctgaagcctatcagaagtatttgctttgttccaagcgaaagaagggggtttggcaggtcctcttatgcactgtgctgcctgcagggtgaatgatgatgatggtgatgccagactttaaaggaagctcctattttagactagtgtttataatccttaaagaatatcattacattatcattcacttcaatggtccacataggtggtcatcagagtgaattctatggggaactaatatcaagaggcaatgtgaggtgtcttaactaaagaaaaaaacttacagcacagagcaaggtggggccaggcaagtaacagttaaagggaggagagaggggcagccccttggagagtgtgtgtcttatttaaacagggcagctgatactcactcgttcattcaaccatgcatttaacccttctccttgccttggactgtgccaagtgctggggccacagggtgagaaaggcaaagtactgtcttcagggagcttatgttctctgagcgcaactccagctctgggtgccacgtgggaatctagggctttttgctgccaaatcatctgctttttaaagagaagaagccagaggttatgtgaaatctcctgatttttaaatgttggcaaacaatgtacatttttaaagaacactgtgcaggccagacaaaacttgtcttttgactcaattgggcctggcctgtaggctgccaatctgtaacccttggggtggaatctcatgacttttgccttaagaaacatttttcaaatgtctgattttacgctaattctcatttttcctgacttcattgcaagctgccaatgcttactgcttgttgtctatgtcctcctggatttaacgattcctaggtgcttcacctctgcgttttcagctgagctaacctcagtctatcagtttctcccttgcaaacctaagccccatatctttgattacagtttcgtgttctctcaagcttccagaaaggctctgagcattgcccatttttccctcaacatttcttctcttgagaattggaatctagtccaaacccttaactaaacagcttatagattagagctgcttttaagcctttcttttgaaacttgcccttccaattttcatacccattgagttgcattgactcccaaccttaggtgtgatattaatttctctcagagggacatggatttaatagactttttaattaacattttgcagaatcggagctgtcattctttatggcagactgatacaaatgtctataattacatttttggcattacatctggggaaaagtctagagatgtttgttttaaccccttcctaaaacatactgatttatgggcaggcctctttgtgcacacctctaacaggcccagttgccatgacaacgcagaacatcatttgtcaaagagctataacttcattatatgttgaagctgaaaatttatcttttagaatttatttttatgacagggaaattttgcatttccatagatatgcttcttctccctaattctgcttgtctttagggagattcaggattcaggtgaatactttctagagaacaagacaaacctcctacctttcattctctccccctacccccagatgaattattgtattcattccaaagagaactcagatggcctcattagtacaacaacacaacaaaggtgaaattgtatgccaagtgtgtctaactaaatatgatttttgtttcttttaaaagattaaaattttattggttgattatttttggcagtaaagttcaaagaaagggaagaaagaaaatgtctgtaaatccttcctacaagctggagaaagtgaaatatttagttattatatttccttgtgtgatgtgtgattcatggattgaaaagtcaaagccgattaaaggggcaggcaaatatataaattagtgcagtaggctcctggggactgtgtcaaatggaatgctacatgccttctctgaagatagtagcttgttagtgtttactgacaaatgtggacccttgtacaggattgtttgttttgttttttttttaaagaagccagaaatctatggtgttttttttttgttgtttgtttgtttgttttgagatggggtcttactcttgtcacccaggctggagtgcagtggcacgatctcagttcactgcaacatctgcctcccaggtttaagcaattctcatgcctcagcctctccagtagctgggattacaggcgggtgccaccacacctggctaatttttgcatttttagtagagatggggtttcgccatattgtccaggctggtcttgaactcctgacctcaagtgatccgcctgccttggcctcccaaaatgctgggattacaggtgcaagccacagcgcctggcccagagatcaattttcacatgaaattttctaattttaaaatgtcttcaggtcatatgaattttgtttgtttgtttgtttgttttttgttcttttttaagcaggtaatagtcaaacaaagcacatctgagggcaggttcactctatggactcctagatttggtttctgccctaatgaatgctacacaacagcttagaatggctttgtttctctaaacgaaatagccaaatcaatcattgtgctctccaggccttctcaggatctggtgtgttgagtgttctgtctgttggcctcttaaggggcgatgttccgcctgtttgcatgctgggccgttgttggactctgcaccacccgggagaggacacagtgagagaatcccacctgctcctcgccgacatgccaagatggatggcgggggtccatcagatgccttctgggattgttcagggatttatgatgctcactttttgttcttgatggatggggtcatttaatcctctgcactaaaccccatctttttcttttgtattgagaactcctggactgctgctgcctttccacaagggatagcaaagattttctttcctcttactgcatttgagagtgttttgttactcattcatcaatgagggaaaaacactagtaattcttgggaataaaccatcaaaaacatctggggcaaagcttccctgtgggtattactgcaccagagtaggagcagtttagggaacacccccttctctccaaatcatcctatggtggacatctatcacctatcatctcgctggttgaaagttagatttaagacatgttggcattcatgtagacttatgctaagtatggaagcctcacagtggctctggcaacgacagcaggtcaagacatgcttcatgcttcttcccacctttcccaggccctcccatgatgcctttcacacaccctaggcacaagtctgtccttgtttaccctcacgttcttgtatacagtttcctgtacacagaatgttgtgcaccatcgtatctcattttaacccaggcagggctttattgatcctttatgggcatttaaatattagcaccactggttagaagtgtgatagaaacagtttcccaataagtagctgttagaaactggcacaggtttgggttccttattattttcctgtctccttatgctttagagcagcctaagggtgtgtgtgtatgtgtgtgagcatgcgtgtatgtgtatgagcatgcatgcgtgtgtgtgtgtgtgtgtgtgtgtgattttggcttaatttttctttctttgaactgttcttagcctataagagagaaaggagatgttatagattattgaacaaaatatgctcataccctatgccaggtagaggcagtttaatctccaaagcttttctcaatatttttttaaaaaagtattttgaaataaccatagaatggtaatgaactaattatgatcccatattctgtgtttacttcttccctcaagtgatttttaaaaatcctactggcattgtattttttaaacaatatatgaattacaaagtagtaaagatttcctataatcctgccacccagaaatatttcatttagttttcctaatgcttttctgtgcctataattgttctgtgcttgaatcatattgtatataaatatttttatttcctattacatgtactgaacagtatatttacaaggatttcttcatggagttaacatttgtcataaataaacttttccatcgctctgtaatattctatcctttgaataaaccataatgtgtttgatattttcctagtattggatgtttaagtaatttccaatttcattgttaaaagtaacactgtaatgggcatctctgtccatatctctggattttttcctaggattgatttccagatataacatttctaaattatgaggttttgatattaagacccttataatatattgccaatttactttccagaaatattggcacagtcacaccagaagagtatacaaatgcccatttgttagcaaccttgttaacattgttttgctaatttctcccctcatctttgctttagtgtttatatgctgttttatatacaagtctaaccgaagggagggggtcagggaaagggagagagagagaggatcactgcctaataagaaaaaattctagttttctatgcccgtggtacattggtggtcagttacccaggagaggcactttagcatataccagacagtactttaagtgttttccatatgccaactcctgtaatcctcacaacattcctgtgaggtagataccaccattatccccatccagagaaagaaagtgaggcccaaggaggctaaatgacttactcgaggtgacggagctaataaatgtcacagcaagaattcagacagggcctttgggatccagagtctgcattcttgtaagagaaaagaagagacttcagggcctaggccacatgatggataatcaacagaaggggtggtcagcacaggtgatcacaggatgtaagtacacttaggagattctcacagttctcttttcttagtgactggaagagtaggttctgattcaaagtaagataaacctctaaaaaaggcaagatattttagctcagacggaaagatctttcactgccactgaaataaaatttgtaaattattcttcatgatcatacccagttaactccaaaataattcagaaattgcatttgttttatgcctaaaaaacatagttgttttctaaatacgaagaggtgttagggttttctttccaccttgaccttcagaacatggaatctgatgaagcttaatattcttgtattctcttgttacccgtttctctccatataactggaaacctagtggctttcttagattcttaataagttacatgcctgtgatgttaagttaacaatcacaatttaattcaatacacaagcaattggcacccacacagggatgctaggcattttaaagaggttcagagatatgagacataccttcaaaggtttacgtcctcacagggaattttaagttcacaagaaaaatataacaaggtagagcaagataaagatattaaagaaccaagtgctacagtgatcagagaagctatttcttgctgcagagatccagggaaggattcctgggaagctgacatttctgctggtcctgaaaggagcagtaagaggataaaagcagagacggaggtgaggagcaacctggtggaagtgtcagggcgagggaggtgtagaagcagcacaggcccagctgtaatcacatgatgcagcatcgttgttgcgtgtgataaacatgcattaatgtctatggctccagctgtgtattacgcaatctttaacctagatagaaaaccccaaaccccttgaaccagctgcgaaaacataaagaggacctgccttctccttcatttcactgtcttcattcacctcagtatgatttgctgtagtctttttcaataaaagtctgttttacggaagtgctcctgagctggcccagtgtgtttgaatcgcagggaggaggacgatgcgggagaaattggcttgaatccttggttttcttatttgggccatagataatatcggcagccacccccgcacctggatagattggatgcgggcactcctgcacactctatggagccttgagaaggccgtgctgggctgagtggggacttctgtgtcagaggagcccacagctgaggctgcccttcttcaagtgtggcctgtctcagaatcatccagttaaaggtgcatattcttgggcctcattggtggtggtggtggtggtggtggtgggtgggtagggagggcaagagactgcatgttcaaaaagctccctacagggttctgatgcacactaaggtctgacagccattgttctgtgaagtgcttctcagcttgggctgcacactaaaaatcacctggagagatttttaaaatatccatgcctgggatccacactagaggaactaagtaagaatatctgggcatggggtcttgacagcagtctctttttaaaataccttaggtgattctaaggtgcagacaggtttgagaataacttgaattggatgagagtaacctaatgcttttagtgatttgcatgagaaaaagaaaggaaagaaaaaaaggaaggaaggaaggaaaaaaggaaggaacaggaaagaaagaaagagggaaggaaggaaggaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagagggaaggaaggaaggaagggatcactctagtagatactaagaaaggaaagaaaaaagaaggaagaataaaagaggagagacagaaggaaagaaagagaaaaagaaagaaaagaaagagagagagaaagaaaggcaggaaggaaggagggaggcaggggagggagggggcagggatcactcctatagatactaagatgagtgtccaatccattcttactcttgtattttaggactacatataaatctttggagcttcatagcagcttcccttgataacccaaatcaagtaactcactgacactttatttcttacctggagcactttttaaaaacccaggctatatcccagacctaagtaaggatttctgggggcaggaccatcaatgttgttaaagttccctgggtgattccactgtgcagcaagggtgagaattgcaggaggatgcccgggtgaggatgggcacagaggtgtctccatgtcttagttcatttgactttcatcttccacttgggtagctcactacaatcgccatagccactgtgtctgtggtgttatactgtcacctgcctaaaattctagcttagctggagaggtgggcattttcatacagaactttacaaaatacaaacggagaacctatcaaaagcctatcaataaggttgccagatttagcaaataaatacaggattcccagctaaatttgaattttagataaacaagaaatgatttttagtataattatgtttcatgcacaaaataaaaaattatttcttctttgatgaaatttaaatttagctgggaattctctatttaatcctacctataaaggaagttaaatcaaatcaatttaaaatagcaggtgtctgattctacagttaataacaggtctccaggattgctgtgccctggaggctgcccccaggataattaggcctgagccccaaagtgttagtccccctttcttaagtcactgttaacaaggagggagttgaccactaattacattttttcccttgatgatctaggtcaacacttagtctggagcatctaggaacccctagaagcattgttctagtcactttccatttcaaatcggaggggtgtgtctcatgttgagccagtataacaattgacttcatctttcctggctcgggttactacctctgcgcacatgttgagagttctagttcaagcccactgactgcaggcaacaggaaaggcatctgtaacattacgcacaaaccattactcatacacagggccaccttcatgggactgagatctgtgctgtcatatagcttagcagggctgcctgcttggtttaatgctctgttgtcaagattttgaaattcttaatattttataaatgaggggtctgcattttatttagcaatggacactgaaaattatgtagctggtccagctcatgcaacaaaacatgggcaatatagactaaaagcagtggcatttttgcacagctgataatttacattcctggtagtgggtatggccttagtcttctctcttgggtaggtgatattcctttggcggggaaaaccataacaactgcctacccatgccttctagctatttcagggatgcctgccttaacaaagacttctgccatccaaatccagacgttttatctgggagcttgaattcacctacatatcatttcaagtgtggctatctttcagagtggcatttagtaggtgtcgccattcatcaatcagcaattattgagtatctggccctgtgcaagacatctttcctcgcttgccccttcatcattatcaatcatcacagtagatgtatccagtgcccatctgtgcatgaccctttgtttcaagatggtgtgtgctaagctgtattctgtcagcgaaatgagcccccactccaaaaggcagtcagggttgtctttggaacagagagtttctcctcagctaaaaaaggatgtgtctatcaagtgctaaagccacgggatatgttttctggccactactagatttagacagagataacaacaacaagaacaacaagaacaacaacaacaacaacaaaaatgcacaaaactccaaagatggcccattgggttggcagaaaaccaaagctgcccctccccccttctttgtaatggtcaggttgtaaaatcaggcagttgtctctcaaaatcattgctgaagatagccgcatgggtaacagcagcgtgaggctgacccagggaagccagctgatggaaaactattctgaaatcctgtgtgtgaaagtaacctgaaaaataaaatgtgtgagagcaacgtaaggcatttcttttcttatttatggctcatagagcttgcttgaggcatttcggcatttcccctgcaatgccagcaaatcctaatctaatataaaactcaaaacaattgacaagacagaacagctccagaaacataaggaggccctcgtggttgaagagtaagacaggatttactggcatggctcgtgtattgtgccaaggcataatgctagatcccatcacattgtggggccgtcttagaacagaaatctcagggaaacagagcttcttaccattctagcaaacaccatagttctgttctttgccaaaatgtttttaagttagccttatggcagaagtaaaattgttaaaatatgctgacatattgtgaacattttattaatcaaagagttactattcaggtatttaaggccgtgcatgttgatatggggcaaaaaaatcactgctaggtttagagaaatgcaagaagagggcagctcttcctatgatctgccctgttcttttgccctagttggttgggaaatgatggctatgttggtgcttttaagtaagagaagtagccctgcaaggaactgaaacatcttgaatgagggaggatgctcctgagttgaattaaatggagtggaatgatgggcaagaacccaccaggtacttggagcatgtgagttgcagtagggaaagtgggatgagcaagtacagtcaatgcccttgggggacttgcatcctcattgagagaataaattattatcctattagattacactctaatgtaatgttattgttttctagcataatctaatattatcatctagtatgcaggaccacagtttcttgtccaaaactcatggaacaggatgccttggatttgggggatttggaaattttggaaatgctcactatggttcatacagtgattatcactaccacctccgctggggccttggggagctctccacagtcaatgatatttctgcggtggcactgaggctggtcccagtaactgggatcagtaaagtctacaaagaaccttacaacaattcaagtcagattttcctgccaagcgagtgtaactttgggttttcagaacatcttggatttcaaaagtgcagataatagattgagagcttgtcgtagagtataatataatataatataatataatataatataatataataatactggaatatactataacagaaattcaatgagggcattatttcccaaatacccagaacaattcctggcacagagtaggcattcagtaaatatttgttaactaaataacaaaagtaataagaagaaatgttacttgttattttattgagtgtctataccatgtcaggcatagagaagcttcatactaatcctttcaggtaggtgttgttattcctattgttattcttattttagagatgaggaaactgtttctgagagaagttaagtgaccaaagctaccagggtggcagttgataaagctgtgattgaaactagggggtttggctatggggatcaagagcccacttggaaatgtcaggctgcctgggatctaagtcctaattctgccgctcactggccaggtaaacttacactaatggtctgactttgctgtgcctcaatatcttcacatgtaaaatgagaataataagttctatgttatagaattatttacagatatatataaagtgcttacaaactgtgtttggaacttagatagaccctcaatgaatgttagcttaaactgatgctttcgagggaggctttgtagcaaagaattttgtctgattgaatagagaataaaaagataaaactttagataacctcatatataacccactaatcaaagaataatcacatgctactatgataaactcaggatccagtaactaagtctaagtcacaaaagaaagtctatttggttgtctcaagtgatttaggtgttgctaaaactaaataacttttcttttaaaaattggtagactaagaatagaagaatgcttcctttatatgctaaagatgccatgtcatataccaacagtcaccatcatacttactgataaaatctaagaaattttcccattaatatctgaagcaacacaagaatgcctatattattaccattattttatcacatcctggaagttctggctaatggcataagacatgaaatggttataaaaggtttgcttatggaaaaggcaaatatattaataattatagatattatgctttcttcaaaaatagtggagaatcaaattacaaatccaataataaaactagaggtcctataatctggctggataccatatacaatatttagtggctttcccatatgttagcaataatgttagacaatataatggcaaacgtgtcactcagaataggaaaacaacaacagcagcaggaacagctatagtacatccagaagaaaatagcgacagagatggggaggaagttatgtggacaagattgttagtctccacagaacttacaatagcaaaaaaaaggaaaaagaaaatagtgtgcagtaataccagaataattaaccgaattcattgagtgatggtaaaattgcagagataataaaataaagtacatgctcgccatacaatgttaagaaaaaatgtacaatattacactattttcagtgtatattgtatatgcattatgatcccaaacttattttttatgcagtaaaaatgatgagatcaagatgttattatcagacatggggttgtaggtgatttttattttcttctttatacttaccgcattttccaaattttctacaaaaagcaagcacacagtcatagaatacaacatgttactcaaaagtatttaagaaaaaataataccagaggaatcaatgtacctactattacttttcttccgatatagtatattgtaattcactattataatagttcactattttgtgaagttttattgccaatatataatttaaagcaaaataaatggtggcttatttaccaaaaatagataattctggactttaaaatataaaataacactacataccttctgcttcattgatttaaaaaattgaaattctgtacagaagccttaatgattttttttttttacaatgttttgctatgcaacttggattcaatttctggagtagagggaatgccaagatgtgcacaaaggccttgggaggtgaaataacatccatttcattaattctttgaaaaataaatgacctcactttctttatgactatagtaattaacactcacatttgcactgattcagaacgatgctttgtattatttattaccacccatttgtggtttggtggtcaacctaatgggtatctttgtcagaaagtttctgtttgtgaaacacattgaagttgttctcatctgcttgtccaataatttctcatcagaagagtcaaatacactttaaaaaacttgaaataatgcagaccacagatgagggcagattttaattctgacttttaattggcctgtcttgtatcctgttcactctggtaaaatgcaatattgattaatttccatgaatcccttagtcccttgcacaaagcttagtatgtaacagttgttcaggaaatgtatgtggactggatagaaatgagaataaaaaccagaggcttcaaactcttggacccgtcctcccatttcactgtgacgggtcttagtacattttgattctcatctaaagacattaatccttggggtcactcttactctgtaaagagcagtgaccatcttgctgcattaggtcaacaccagatatttatggagcgcgtacaggccatgtgctgaatcgggctgagcgttagtttttatgatgtggagctgatttcagagcctctagcagatgcagagcaatctgtgcattcttcaggccaggccccagcgtgcctgtgggttttctctgctttgctgcccgggagctatgctgccgccttctccctaatccctgcaaacaggcagcgtgtgaggagtctgccagcacatcaagtgtgtctgcaaaatgcagacaaattgctgctctttattagaggtacggatgaaggactctgggaagctctgaaactacagggctttgggtttcttggctacttttttctcaagctctactttcagaaatacgatgttagtaagtggtacatttcactgccaacatccctcccttcctcctttcattcctcgttctttccctttcttcctcctcctcctcctccctcctttcttaaaaatttagaaataaaataagaccttcttattgctttttcttgctgattaggaaaaatagccagccagttctaagtttggtcctttgtgagaaatgtgtcctctgcctggcgtcagtcatgctctcatgtgaacattcccttgaatttgtcctgtttccagctcatcctctgctaccttgatgcattccaggaccacaatcattgacaattctttttttttttttttttttttttaactctttctcactctgctcttgtcttcgctttgtctaactttgattctgtggtcgctggttataaggtcactgtttttttgagaaaatcaaagctgtctgaagaaaacacccacaagcctccccagaccatatgccacctttgtatgcatggccatggctctgccttctctcctgatacaaggcttctccccaggaccgccctccccatgtgcactggctggactctgacctcttttgcctgttgaaagacatcaccccagccattgtccactctctttcctgcagcgttacattttcttctgaaccggatcattcccatcagtttacaaatctggaagctcatattcctctattcctcatgtctgaaaaaacacactgctcttgacttcccatgcaccatgccccaatctagcgcgctgttctcctttgcctccaacaaccttctctcgaaagggttctttctttctccaattcctctctttctcctttctctttaattccctcaaatcaagctttcattccaaatgctgcaccagagtgtccccttcagaggtcgttgcattgctaagtcccatagcccctcccagttcttatcctacttggcctgttggaggcacccagcgcagcttcttgtttccttcttcactgacttcactttcttcactggctccaggctgctgcattctctcttttccttctacatgggtagtagaaggaaactaccaagtgggactgttgctgagccctgaagctcagtctttgagaccctctcctctccagctgctctccctcatatggggattttatccagtctcatgggtagaaacctcagatgcattttgaatccgtctccatgctggcattgcccacctctcgtttccaatggagacctgtcttccgaactgtaggctcgtatgccacctatctgctcagcagctccacttggatgccaggtgagcatcttacacttggcatgaccaacacagagcgctgagctgtcccatgagatgtgaccctcccacaatcaaacccaactcaataaatggacacccaggctgaaacctgtgagtccttgtgacccctctcttcacttacacccccagcctatattagctctgccttcaaagtatagctagactccaactgctttgcttcaccttcacagctactaacctggtgcagtcttctctaatctctcctagaatatctggccacattggccagagtgcaccctgggcaccgtactctctccctacagcatttgtatctgtggctccctctttctggaatgtttttctcctctccttcaggtctttgttcaaatatcactgtctcccggaggccttccctaaccattgttttcaattgcagcccttatacctgctagactgtcccggtccctcctcccaccttacttatggtcagagcacttgccactctcagatgtgctgcagatttccttgttgtcgttggtaattctctgtctgcccccacaaaatataagctacattcacggcagaaattttggtccatttcttcacttgtcctaaaacagttcattgtaataaatatttgttgaataaatgaatgaaagaatgaacatcccaggttgaatctagggcacagcaaggttcagagccatgtgatgagacgcatcccaagaaaagtgtcactgttagtggcccagatgtttccacatgtgcagatatgttcaatcccatagacaaaacattgaagcaaccagtggaactattcaccctttctccagaagtttgatgacacaagcagtgtgaatgactctggaatccctgctaatcccctgttttcatgtccagccagtcttgcataccattacatttcttctgctcaggaaaaggctgactgagctttgtctgggtataggacgtactttgggatgcaactccgttcctcgtgaagaggctctgacctctctatctgcacttccttctttactcttcaccctcctgatctaagtcttgccctcctgcaaatcatactccccatggctgccagcgttatcatcataaatctgtgttttcttatctgagggaaagaacgtttttaaggcactatgtgagaatctcattctggttctggatagctcaacagccagctctgaacccagaggaatgccgttggctgaagttactgatctgcttcaggattttacctccactgcaggctcacaggtatctgactgctccagggttgggactctggccgtggctctgcctctcctcgttttccacccatagtgctgcttccctggcctcactctgggttctccagcagaaaccggcatgctcatgggtgctcccatctccctggggctgatttcagtgatggttggggcttccctccgtatgaccattggaacctcacctcatccacagtctggcaccactacttggctacattaattattcaaaccctcagttttttaatgccacatttggagagaactagatctgagtgaacatttgggaaaactagacccactgttagagccaatgcaaaggccttagaagaccttagactgggggaacccagttttccagaagtttatgaatgaccaggagtgtctctaaggagaggaatgaggcagagtatgtacctagaggacctcataatctattcccatgatccagtctttttgaataattcttggcatctaagagcaagaactacatattcactttgcttcatttgctgtctgtgtggctgaatgaattccccagcacctcagttccctcctgtaggaatggggggtcatagcatctactggatggtattacggtgaggagctaataaaatgcctcatgcgtataaagaactcagtaggtgctaattcttcctactatatggcacacagtaggttttcaatctcaacattttaagttagtgggttggttccctgggtctacagtagatgagtagttattatgcctgcaggtgctctggatgccttgtaaagtgaatgaggcatgcgacctgtgtttctgctcttctctcagtagcctcccctcccagcacagcattctctcagttcccaggaagtcccctgagctgcaggcctttctcacctttcactttccttccgttagaggtggctcccactgcccttcactcccaggacccgactgagaggtgagccagctgcccaccagcagtgcttggtttgaatggttgtgatggtttgatgtgttctttttaccagggaaagttgcattttccctggagatttttgagggcagtgttagaactcaaaggtgtggctctccaaaggtgggtcacgtgcagcttggccctgccctcagtcagagaactgtagggggcacaagtcagggagtgttgcaacgcctcagccctgtgcagacctgctgtaggggtagaggctttatgctatgcactatgtagaataaagagttgaaaaactagaagctttcttttaaggagtttacaatctagctgaggacatagatgagtaaacagattgttataatccatggctatcaagatctgcaaacagttttatgtgagcagacaggagaaacatttagcccagtctgaagtggtcaggaaggcatcctgaaagagctgatttttgagggaaaaggattttaagggggaaggattggcattgacaagacatagaggcaagacacagcacaatatgaacattgagctaccaatcactactgcagttgctagggtgtaagaggggagatacgagaagaaagttggggccaaggcctaggtgaggagtttggattctaaggcagtaatgtgaagccattgatccattctaagtaacaatgaggggaggaagaggatcctagtggcaatttagaaaggtcttttcagctgcagcatggcggatggaccagaggagggaaagagggaggcaagaggctagaataggccatagctgcagctgcctgagagctggagaggcctgggccagagtgctggctgctgccttttcagccaaccttagtccagccatggatggttcactgttttgaataaattaatgggctttatatttataaacatattacagactcctcccacattcagaataagtcagagaatttttgtaaggggagggaggtcaaatttttgtaaggggaggggaaaaatgactccctattcttctcttgttatatttgctgatgtttctgggtaactttcataaatctgtggtcttttcctgcccttctgttataaacagctgacatttctgaaggggaactgagaagcacagtaactgtaagaagctataaagtgttaatcatgagggaaatgcaaatgaaaactacaatgtaatacctcactcacacacacacacacacacacacacacacacacacacacacggctatcactatttgtttctatttattcgtggctattgctattggcttctattcgtttctgcccattacagaaaggaaagtcttctcaaaaatggctgttataatttcttgggttgaataaacccaaagaggaagagtaaatactaaagaattcatccatgtaaccaaaaaacacctgtactccaaaaactattaaaatttgaaaaaaaaaataccaccttgctcctcaagaatggccataatttaaaagtcaaaaaacaatagatgttggtgtggatgcggtgaaaaaggaacaacacttttacactgctggtaggaatgtaaactagtacaacctctatgaaaaacagtatggcgattctttaaagaactaaaagtagaactaccattcgatccagcactaccactaccaggtatctgcccaaaggaaaagaagttatttgaaaaagacacatgcataggcatgtttataacagcagaatttgcagttgcaaagatatgaaaccagcctaagtgcccattgaccaatgagtggataaagaaaaatgtggtgtatacacacacacacacacacacacacacacacacacggctatcactatttgtttctatttatttgtggctatcgctattggcttctatttgtttctgcccattacagaaaggaaagtcttctcaaaaatggctgttataatttcttgggttgaataaacccaaagaggaagagtaaatacagatgtctcatttcatacaattctcagtttaattgaaagactttaatcttgctaacttctgaatttgacaacgcttaattgtgtagattcaagcttccaagctcaaagattcttggctaatgataagtataaatatatgccatggaatactactcagccataaaaacgaatgaaatgatgtcttttgctgcaacttggatggaactggaggccattattctaagtgaagtaacataggaatgaaaaaccaaacactatatattctcatgtataagtgggagctaagccatgaggatgcgaaaacatacagagtgatataatagactgtggggacttggtggggtgtcaattgagaagtgggtgagggataaaagacagcatattgggtacagtgtacactgcttgggtgatgggtgcactaaaatctcggcaatccccactaaagaattcatccatgtaaccaaaaaacacctgtactccaaaaactattaaaatttgaaaaaaaaaaaagaagccataaagtgttacagaatgctaaggaatgtgcttctatttgtttctgcccattacagaaagggaacccttcccaaaaatggctcttataatttcttgggttgaataagcccaaggacataaatagagatatctcatttcatacaagcctccatttcattgcaagactttaatctggctaacttccaaatttgacaatgcttagttgtgtggattcaagcttccaagctcaaggattcttggctaacaataatttatttggttgggttaacagttaaacctgatgtgaacatttaccctttgaaagtacatattttcgtattatagtttccaaagggatctgagaaattgtccttcctggacagacctctcatcgtcccctccatgtgatcaatagaatgcagttttccaagcaaaagctatatttctaaatcatttaagaagaaacaagtggaaatttaattttaagctggacactattttttccttttacagtcagctcatttttcatgattctttatttttcccaccagcatctttcacgttagtgttttaaggaaggagtgttttattgccaaagtcttcacaacatgaaggcctacaagcagttataaagattgggcttagatgatgtatattaaaagtgataaatcattttccagcctttcattacattttgttttctctggatccttacctcctctgactcatgtacctgggctgatgaatgcccgtctctccagttacactgtaatccagggcctgtgtttcatttgcctgccaatagtgatagccaataaattaatcatgcaaccacacaagccttgccatgcaggctgctgccagcgtaaaactgcccatcaaaagcctgcaactctgaatctccatttatctagtaccctcaagactcgcatcgttcccagcaactggagctgcaaatgctcatttcttcataggcatgggctgggaaaatgagagaaggctaattaatgcattcaagagatcctactgaatcagcaagccccttaaaggcacaacagacacaaacaggcagctgcagctccttgggattcaaaacaacaacaaaagagctagttaaatatttgaatagctaaagtatatgtctattcattcccatggaaattgctaaaataggctgtcctcccatctccagaggagtcaaagtcattgaaatcccaaagccttttatcctgtcaaacatgcctttgaagagcaggacatttacatctccataacaggccaattcaacattagtggtaataaaacttgggtgcatgaaaggactccagaatgtggtacccattcactctggcctctggggatgcagaagtaactttttgaaaataagactactattgcccaatccctgtgttagtttggcattttatagttgcaaatggtttgaacaatagtggagatttattgtttcacataaatataccatccaggagtaaatacaagcttgtatgtggcttgatgcaaggcccaaacactgtggccaggatccatcttttggctcttttccatttgggtggctcaacttgaagacaaacatttgtcttatggttgcaggacagatgactttcatccactcttgatgctatatcctccagatgcccatccagcagaaaagaaaattacggcttatgtcaaccttcgaacacacatcatagacttcgttttgatcaggccagctttatggtcacatgctcatccttgaacaaatcagtgtgggcagggattggaattatgttgatttatttatgtctgagccattggttccaccttgaatcacataggttgcctgggagttgggtgaataaccaaaggaaaatcattaccagttgaggaggaggaggaggaggtggatactggttggcagtgaaaacaatagacaaataaactatattagtctgctcaggctgccatgacaaaaacagactgggtggcttaaacaacagacatttattttctcatagttctggaggctacaagtccatgatcaagatgctggttagttgggttcctggtgagggctctcttcttggtttgccaatggccaccttcttgctgtgtcctcacatggccttttctctgtggctccagtagagaggggcagagagagagagagagagagagagagagagctcaagcatatgctctggtgtccattcttataaggaccccagccctactggattagggacctacccttgtgaactcatttaccttaattacttccttaaaggccctatctccaaatatagtcacactgaagatttcaacatatgaattctatgtgcacacaatttagtccccaatacaaacaaaaatgataatccgcagctgtgcatctctgattaatcctggtttaggtgtgattttatccactaggagtccagttgtagttgtttctatggagtctgagaataaatgtacccaggtagcttcaaatgtacactgtgaagatcacctagttatgtacccaatcatgttgtttctatttaccaactatgaatttagggaccaagaagattcctggagactgacatttagttacgattctagaactatgaaaaaatttgacaatcatcaggcaagagacctttatggaactcatctttcagtagtgcctttaatgaaaacttatgagatccacaagaaagccggaagtctgagactgtagaatcagaccctctgacgttttgaattatggtgatgtggcccagcttaatcactcatgtattccaacatacccggcgccaaatgatctttgagcacgaaaaaaatcaaattttctctccaataataaagatttgcataattggtaaactctagtacattaattcaaagataattccccaaggggagctttgaaaatatggcaaaaatatgagacatcatctttggaataaaggtgtggccttctaaggagatggcttgtcaatatgagttagagtgactttttataaacttcttgcttccctttgttgtaaacatttatatattacatattgacatacacacctacatatgctttagagactacatatgtactttcttaggcatacatattggagtctttttataagataaaaggcctatatttttatagatgaggctgctttgcaataagattcacttggaacttcactattacagaaaaagataacccttaaaacagaaaagatgatttctcctcctgctgcacatacaacacagtttggcaggggggactctattcatttcagtctctcaggaacccagaacctcatgatgctgccttctaaacaccaggcttcatagttcactgtggcaggatgaagaggaagcgaaaaacccaggactgactattcaattttctgcctagaagtgctgggtcatttctgcttactttttcattggcaaaagcaagcaccatggatcggtgggtgggggagtccaattatcttctgggcaaggaaggagaggcaagaagagcaacatctaacgtaatcatggatccgtgctataccaaatttggttctcaattgaagaatgcaatggtgaaaagttgcaatccatccaagatttattcatttattcattcagctctttagtatctacaatgaaccaggcactgtactcaatgctagaaatacagtggggagacaagacagaaatatgtattgcttttaaagaacttacagtttaggaggaggttacaagtaagtagatagctaaaaattcagagtgggatggaactatgacagagaaagaacagggtgccttggaaatacagagaatgggagacacgactaatgaatgttcctacggttgtctatctctgagctttacaattcagtctctactattttgtgggcattttatgtcctatttataaaacctttcaattagaaattgagacatctattgagtacctaccatgtgggaagtgccctgcttgatgctgttgtatcttatgaagcttgcggaagagagtacggagttgaataagacacttttctttttcccacacagagtgcttaaaatctaataggagaaataagattacataaataatgaatgcagtgcagaatgtggtgtttatcataagagacaaaaagcccaaatgtcaatggaggtatttctgatttggggaataaataaatgcttcatgataagagtaacttttaatgtgaattttgttgaataaatgagtttaatggtcaaagacaaagcatgggggttacatgtctggtggggaaaaaaaaaacaaaaaaacaaaaacaaaacatcaaacgcaaagacaccaaatctgaaagctgcctataggcagagaatgtgattattttattctactctcattacatccccagcatttatcacactgtcttgcatccatcaggtgatcaatgaatagttttcgaatgaattaataggaaaatttgaggcatctttattaaaggtatgcaaactaatagtttaactggaatcttaaggtgaaattaaggtgataaagctggagccaggtcatggggccaggtaaagattttgaatgttattgaagagtttggaccttattattcccttacccctatatttacataaaccattatgttcaccaaagctcacatgacctcaagacggtccaatcaggtggtcaggacagtaattattgccccacccaatagagaggaactcagagacagactaagtaattatggaggttatgtcaggaaataacgaatctaagactcaacacccaaggtagtgcaaactctgtttctgttcctttgtactgcattacccctctgttctgaggcagaaacgcccttttggtgttgggagcagtagaaagaaatgacgctgtcagagctgtttctaagataaactgggagagaaaggggctggcagccaggtcactagggaggagaacattaaaataatgtgggagaagaccaaactgctgtagtgaccatgagcataggcaggctaggatttctttttagcagggataaaaggttttagcataaattctacccttgttggtcaatacctaggtcagggtttcgcaatctcagtactgttgacatttggggccttgaattcattgttgtggagactgtcctatgcattgtccctgacctctgcctgttagatgctcctagcacacactctccacccaccccaccattgtgacagccccaaaatatccccctggccaaatttcccctgggaggcaaaaatcgcccccgtttgagaaccactgacctaggcaatcaattttgattagtttccagaaaatcagtggaccctaaagagcacattgggcatttagtgggaaaacatcaaggaaagaaatgcagtctcatctgatgggtttagtttccttccactgacagtgtgcatgatggcccatagttaattcgtttgaccagcattgcattttaaataatgggttttcattttgtcctatttatggtcattttatccaattatttttattcagcacccagctttataagtgtgtataatcctgttatgttctattccattatgggaacttcctaacagaagagtacacagtaatacaattaaataaacattttggctattgtgttggcctcacacatttcctgactttggctggattcgaatgtggttatgggatgggaagggagacaatgggtcactaaaaagaaagacaaaggtgctgaaaggtgacatgaaacaggtcaccatggttcccagattggtgggaagaattcaggtaccacttaaaatggaaaatatcctgtaatgagaatggagctaaaaaccttaccattttcttcctcccttcaaaattccataatacaatggcaaaaagtttcctgtgcggtgctttgcatgagctacaacaaatgttggtctagaaggactaaaaaaagaatttgcatgttttatatatgtgaatataaataatgtaagtataaatatgaatataactataaatacgtagcagaaattgcaaaggcgtttctaaacacatttaatgtggtaacaaagcttatgcaagaaagaatggagagcacggccttccttcacgctgggctcacttggtgactgggcataatggacaggtctgggcaagtcagccaagacgtgagtcattgtttaggttttccttggaaacaaaagctcctgggaatttgacatcaagtgtttgccagactctgcggacttgttagtctcctgcagggccactaacatcgcttctaagatgattccctgagaatcagccagcttcctccgcaaagacttgccctgagtgctaaccagcatggctttgcagagagaagggaatttgggacatgtctcagggagtcattcatccaacattaagacagtgttaacagggaaattgtgtgtgtgtgcaaccagacatcacctgccttccctgcagggagcttcgacagctgagaaaatgtttataaagcattttgagctctcactggggtggtactgtagaaaggcaaatctttgatatgactttctcacgtctgtcaactcttattattaagcagaggttgcccctgcctttctcaaagttccaatcatggaaactaattattaggagttgcaggttccatttttcacctacccagtgaagattgtgaccacctctgttaaagaaaaaatctttctggaatctacaagagatgtaaaaaactcagtgttgtatgtagtttaattgggaatgaataaaatgtagactcactaaactgcttttgaaatagtccacatgtacaaaacaaaagagagaaatagttggcaagtttcttctcaaaactaaatgtttgaaatatgtgatcaagacagcttgctatgttccaggcaagtctaatttcatctattcccacttgaggcttctgaactttatgggatgtaaggcttttatttttaaaatgctgcaacagaagctgattaattttcaaattaaagcaatatctgacctctagtaagtttcctggcatatagcaagcattcaataaatactgttttttttttttaattgcttttgcagagcactggccttttctcttaagatgaggatatagtggccccaaagcctctgagtattatttagcaggagaaaatctaggccggttgactgagtgcttttccttatattgcacatgatctcacattcccaaaatacccaggctcaggaaagctatataaggccatgtgtcaatcttctcagtcatatatgcctaatgtttagtcctatagactttgagaacttgaataggcctcagatgccatttctcaaattttcttttatggagtaggaaacagagtccatgaagggggaagtggctcactcaaggtcatgccgttcacttctggcagtgtctagagagggcccacatcttctgacattctagtccagctctttattccacactactgcctggagtgctggattctaagaattgctcagctttaaatactgtcttcagtcatgttccattggagagccacaaatcaggagagtagcaaatatatttgcaaaatacataatggtttttatgttgtatgtataatttgcatattggcattttcattacatttgctatatttaatattgttacgctttttcaaaattgttgttctcatccattccacaagtgtttattgagtgtttatgcaaagcattggagatagtggtaaattacacagacaagatccctgtagcaaatgctgttggcgtcaccccctgcccgtgtcctctcagctctcaccaccccagcacttgactgcagagtcttgctgcaaccactcatgactctgcataaggaccttctctgggctgggggtggtggctcatgcctataattccagcactttgggaggccaaggtgggtggatcatgaggtcaggagatcaagaccatcctggctaacacagtaaaacctcgtctctactaaaaatacaaaaattagccaggtgtggtggcacatgcctgtagtcctagctactggggaggctgaggcaggagaattgctggaggcagaggttgcagtgagctgagatcgcaccactgcactccagcctgggcaacagagtgagactctgtctcaaaaaaaaaaaaagaaaagaaaagaaaaaagaaaaaaaaaagaaacaaacaaaaaaaggagcttctcttagctggaagccttcagtcaatgacaggtgggagttggagggtaaatgacccagcttcctcagctttgggatgggataactctaaggttcattctactccatcactccaagttccccaggcatttgaactccagttgtccacagtgtaacccactggataatgtatccattacagacttcctacctctttttgtttcacttcttgactactccttttgtgcttcctgggatctcttcttagtaaactacttttgcttgaatccttagtcagggtctgtttctaggggagctggtctaagtcgctggcttcttgaggctcaaattctagaaaaggatgcagataataaacaacaaatcaataaaaaaggtcacatatgggtacctattgaaaagaatgagatgatagagagtggaaaggggttcagagaaattctgattgaagtgtgaagttggggtccctctgatagtgtgatatttgacctgaaacctgaaaaacaagaagtagttataaaaaaagagcctgagggccgggcgcggtggctcacgactgtaatcccagcactttaagaggccgaggctggcggatcacttgaggtcaggagttcaagaccagcctggccaacatggtgaaaccccatctctactaaaaatacaaaaattagccgggcatgatggcatgtgcctgtaatcccagctactctagaggctgaggcaggagaattgcttaaacccaggaggcagaaattacagtgggctgagattgcaccactgcactccagcctggccaacagagcgagactccgtctcaaaaaaaaaaaaaaaaaaaaaaaaaaaagcttgagaagaagattctgggaagaggcatgaaaaaatgcaaagtgagcaggaataggaaagagaacactgggctgtttcatggggaatgaggcagggagggggaagaccgagtaggttggccttgtcatgagagactctgtagtaaggatcagaagtttatactaaatgcaaggagaaaccgttggaggatgttaagcaggtgaatgcaataatctgatttatacttgaaaatggttactctggcagctcatgggaaacagattgggggaggaaagaatgaagcagtgagctaagttagaaggctactgaagaaatctaggtgagagatgatggatgcttttcagtttccagactcaactgttgatagagaacagaagtaaatagaatacaaacacagaggacatacatgtttatgtcttcgtctctgtgggtatttatatgtattgaagtggttcttagcatttgggggtgagaactctttgaaaatctgatgaaatctgtggatctcctctccaggaaaatgcaaatgtgcaccgacacacaattttaaatttgtgctgacaggttgggaagtcatggagtcagttaataaaacctcaagcatatttttttttttttttttgtctacatctgttagtagggataggctctctataatggtaagtaagtgccaaagtggatcacagttcaaacacatatttttgtttatggataagaattgaaggaaagatagctcagcatcattggccctctggtagaaagactctgagatgcattctactctgtctacgcccacataacaataccaagagaattcgttgttccttgaaattgccctgtgctatcttcaagccataacttccaagcttgccctaggtgttatcttaattctggccaggtagaagggagtacacagaggaagtcttaataggcaaggcctggaagtgggacccattgctctgctccccttcattgactagaatttagccatctggccacaactaaccacaagggaagctgggaaatatcgtgtagctattagcccagcagggtggggaaaaagggaaatacgaatttcagagaacagttaggaggttcagccaaatacacacatttttctttatatttgtcacataggagttgctcagtgttacatttttagagaccagtggaaatacctcacattgtaagtttgatgaaggacaagggatggagccaagtgaaagttggtcaggaggatacaataccctttgtgtcatgatttccagaaccagtttaactcaaagcaagctctcttcctacactgtggagatggggctttcttttattaaggatatgtccttaagtaaaagattaagatcaaattgaagtggaaacttggccccaaactacactgttctgtgcccggagggactggaattaatttgaagcaaactattactcaccccgattatgtgccagtaggaaagggagatgatgatactgtcaacaaggcgaacttttgcattcattttttctcactccaatgagcagtcattctagatctcagatgtgacagttcattggctactcaggcaagcacttggcctgtctactctggactcaactctggtccattctctccctgaagcaaagcagcccggggactcctctttcaaatgtcctttagggagtgggtgtgggcctaagaagttggaggtgaagtccatttttattagtaaatcatattttaccgtttgattccatattccatgacaatggtaaagtcatttttcttggggatggagggtggtgagtcttaccttaaaacataaagaaattacatttgagaacatggcaaattttaatttcttcagcgttaaaagagaggaaagctgattttctcttaacatagtaaaatgatttttctgaaacttaaaaatatccagaagctgttctctcttgagatcagaacctttctaagcctcatatttaatgtttgctcaattcagtacctacagggaaggtcaggtttcttccacgttgcctgttcccagctccttcctctgattctctcatttacatcataaatcttccttttcaaccccctatgttttagctctttcctttaagagaaatttgaaaaagtgttttttttttgccatttattttatttaatttgaattccatcttagagttgttaatgtgtttacatgctattttttcctacattccttctctccggtcagggaaaatgttgagctttcttcaacatgagatggatttaattggttaatttcataatttagagtctttcttggtctacattccaaaaggaggggattctttaagctcagtacagctacatttacttttgaaggagccctttattttgcagtgaataaagtgtctcttattaaacagaaaataaaagaaggtttggcaggactctactccccatggatgaaacatcacaggaaattgagaaattgtttctttttggccttgtgggaaaattttgcttgtgaaatttagtgttaaagttttaagacgactgcttaaatccatcaagaaagagctgttgaatgaataacagcttctagggaagaggtgccaacctgacctttctatatctggtcttttaagtgtttgaggaagtgtgcggtatgatcaagaagattgtattctctcctacataatgactgagttaattttaaacagaacttagacatagttcatcaatttaagaataattttgtcaaaagttggcctcagctgggtgctccttcatttgtgcctataagacagggcattgtacaggcccaaatgagaaacgaatcctaggtagagagtccagtttccattctcagattgatctatgggctctagaattttgatacgaagcctgtgtcttgagcttcagaccatcctgccaactgagggtgttgccttccattttcttcacataggcaccttgtttgaaatttgtggctaaaacccatgttcttggtttgactcctaaatctgttttccttctaagttccttagggactctgtgggcagcataaccacatacttagttgtccaaatctgaaaccttcattgttttctctccacactcccctcaatttgcaatcaatcaccaagttctgctactgtccctaaatatgcctgcagtcatctcctttctttcaccttccccttccccaatacccagttcaggccacaattctctcatgccttgatttctctaaaaacctccttaaccaatctcttgccttaatttttttcctcccataatcctgatttcaccctgcagccaaaatgatttctctaaaattaatctttacaatgttacttcctggcctgagtgttttttttgtttgtttgtttgttgtttttttgcctaactgtgcgattttcactataatatccaaactcttgacttggcccttacttgtacttcccatttccctcccccaaccccccttccagctgcatcagcctctggacacattcagcacttctcaccttagccagagctgtattctgagtgcagtcagtgttccttcctctgctctttcccattcttggctaattctaatctattttctagaaatcctctgagccctctttctcgagccgcctcccaaccctccgttggaatagaggcttcttttctgtgctcacacaccctggactgacttcttggatggctcatcctccaccgagagcttctcaagtgccgctttgcagctcatttctctttgaagactgttctgcctgataaataaataaatgagaatgaataactacttagtgtttttctatatttaaaattgaatcctaattatactgttttaaaattcagttaattttggtgattttggagcatgggaaatgcaactaaaaaagaatgaaaaaaaaacccactatgatttgacatcagaagatatgaatcctggctcagtgaccacgagctgaaagatttgctaagtgtatcagcctccctgaatctcagttcctcgtcaataagcataggataatttctcatgtaaacaaaggttggctgaggaccaaggaagaagtgcccggtgggtaggtggaggcactcagtgaactataatgacttcacaagtgagaggaattcttatttgctttgtatctgcaattctcattgtacctgtgcaaaactccagcttgggagaagcggggtgtgaatggtttcatggggcacacgatgggaggggaatatttgtgaggtctcttcccagttaggtggagccacaccaatggtggggaattcagcaattcctgtaaggggaaattggaaattgtgcgtctttagttttcccgttgggtagagctcaaaaacacacttctaccctctcaaatactgttggtgaaagtgagacctggcatagtgttgtagcaatttgataacctgtattgagaaccttcacaatattcattccttttgaatgagtaattcaatttctagaatttatctaagggaattatttttaacaagagaaggggagcacttaaggtgtgtaaagatgttcattgcagttgtttattatagttaatgatcaaaaataatctgaaatgtgcaatcagtgagggaccatgatcacattgcccttcagtgagttctctaaaatgggaatgtaacattgaaaaacatcttaagtgaaaaaaacaggcttaaaaaattcaatctatggtttaattaaaagtgtttaaatcaaacaaatttaagaaaacaaaagatgaccagtgggaaaatacactttgttttaaatggggttagttgtaactaagaaatccataggcaggactctgcctccctagactaacagctccaatgactgaagttcactgtcttctgtgcaaaggaatctttatttggctttggctcaaggctaggccttcatctcatcttctaaaacctagaaggaagctttcagaggaaaatatagatcagaagtaaaattcggattagaagttggggggctgaagttgtaggatacgagggagggaaagcctacctttacccttgaacaatcatcatgacaacaacctcctaagtcatcttgagtgtgcaaagtgcttttctgtacattgttcatttaaattgattcctcttcagtttagctagctaattatccaaaatgtctgtaaaaattatgacagaggagggaaacacagttactgatttggggtccattccctttacccttctcatattcaggtatttccccactgtgcagaattcactttgaatccagcggaaattacctaggaggaaagagctgggctcaggaaggaagcagacatttcactgtggctttattcacgggaggctctccagacgtttggcaggtcttttcttacatgtgcctactggaccttgtgttctaagaggcacagaacagctgtacacagcccagtgtcacacagcaagtcaggagcgagaatccatgtagaattaagatctttttttccctccctcctgaatctctatctagcccgtgtctactctcccacgggattttgtgttgctttttttaccgtctgtctcagcttcaaaaaggatctgttttctcttattattttcccacattgctgcggttcagaaccgtagtgcatttgtcaaatgcattgtgtgtgtcttcacccctgcagcttccctgtcagatgattcaatacaaggcaatgatctctccactaagggggaagaaagaaagtgagaaagaaagaaaacagctcagagcccttaaccctgggttgtggctatttttctcatagacaggctgctctctcttatctgattggagcctccgtgttctctgaataggaaataaatctctacacaaaaatccaagggttagtttccaggtgtttgataggaagctttcatcccaagtggtttgtttatttatttatttatttatttatttatttatttatttttgtcggggggagtttgttgcattatttgaccaaggacagtgttgaccacctccggtttctacttctctttcgaagtttattttatgttttgttgtggttttcagatttctcatggtttggatttgggaaagtaaaatcaagacaaggtgttggtaagtagttaactcactccttctttggataagtaatgagtctatgtttttattcggatgaaaatgcttagaccctctttacattccacggtctttgattcattttctgtgttcctggtttttgatttgttgaagaagtaggtctagaatttttccagaaaaggcattactgttgttaattgagtttagtacatggttttacatttttagatttgactcgtttttatcctgtgggggaagtgttaactgtcgttccagttctagtttgtgatgcatttttaagaaggttaaggaaataaatacaactacatttcagctacatgtacagggaatagctgactgaatagtcaagctggacaagtttaggtcttaactttcttccattggccaagatgtaatagagttctgaattggtaaatcagtttccatttatgaccattcctctttcaaaacagattctaacgtccagacgctgtgatttctgcttgattgcattctattccctgcattcagactatgtgctgacaattgaaaagcagtttgtagcttaccaagtgaatgcagatgatgtagctcctcattagaattgaaatcaggtgtgatctcttgggacctctaatttgttcagaattttctatgggtacagagacaatgaacaggaattgcttagaaggcatgaaaagacggcattcttacatctttcatgtgggtttccaagatccgaccatcttgggcatctgttggttagttattcttttggtagcaaggttggccataggtaaaatggcaaagtaggggaaatgtaccaatgtcaggaggctgctcaattccaaaccatccaccctatgcttgttcatcctggccatataaggagctgtttcctgtcactttccatcctgacgtcagaccttgtcttgttgggcagtctctatcactgtctgtccagtgatccaaaaatgaccagccggctgaggcagcctggccagatggggcctggagggggaaaagtcaccttgactctcgctagctccatggattccaaggttaaagttcttaaccagcaaaggggaagtggagacttggcaaagttagaacatgaagctcaagtagtcagggcttctaggcagctccctaggggcaaatttcagacacagctgatcatagtcactttgccaagatatcagagggatgatcctgcctgggcagtcttaaaggtgttctgttttacgggtttgatgtgtatgcgtgcgtaggtgtatcccgtgtgtttttggggaaggtggtaataaactctcccatgacagtcctataagacagggtcttgcttctgctaaatagcaagtcattgcaaccacttaaatatttttccaagccaatttgcactgcagaagggtgcttgttcccggaaagctgcaaaaatgtggttttactgttttaggccacagcagagagctcttcagaattattcttccggctgcagtccagcagaggtgctgctcttataaaacataggtttcattatttttcaagtttggtgagaccaacaatttaggagatgattgccattgagaagatagtgtgtcactcgtggttcccaaaagaaaggggcacaccatggcatgcagagccacgtggggaagtgctgggatccattaaaaggcagaggagggaagggagaacttgggcaggagcttttagtgtgtttccaggtaaggaactggggagggagggtaaacaggtttaggactggctagtctgagtaacttcaacaggctctagggtacaggagctatctagagttgtcaagtacttggccctggggtggggagggcaggtggatagtggcctagagtgtgagcctcacatctggaaggtggttggggtgttgtctctggattggttggtttgcatttgaaaggcatgctcccaggcagggtatttaccatctgtaggaactgactcaccaggggtgggaggggccattcctccaggattagcacggccccagatgtcaaagcaccagaatccagaatataaaaaggcttgcttagtacagctgctcaagagtactaacccttcccctcaccttgaaggcactgttggtattgagagaagaaaactcccccagatgaacttcgtgattcttatcacaggaaattaagtctacatgaggcttagaaatgtctgtaaagtcatagtacaggatgtgtgaccaagcagacatattaaaataaaaatgggctaaaaatgtttccagacttaactcatgtttttcagctgagtaattagaactatttaccctaaatcagccaagtgtgcacctacctcgccatttaaaactttatatgaatattataatacattttttcaagtcctcatatgaatttcgtttaacacacggtgatgtgcccctttattcttctgtctttttcatggtgcctgctcaaacacatgcatagacatacaaagacacatcctgtgatatgcacagacaggctgctgtcaaattatgtagacattcattgtcccgctgagagcttcttctgccttctcaactttgctgtgctttgcattccattatatcaaaatgttcacagaaaaatgggcttaaaccctgcaaccttgccagccatatcaatcttctaggttttggaacatcaataatgaagaaaacagcacttgaattaatatcccccttgatgaattgttgaggtttatgtgttactcacatttgtcaacagtgatttttctggcaaagtgaaaaggcttttgaaaaattacctgtggtgctttttactgcttctacgcttaatcctcccctcgctccccaaacaagagctcattcccttgcaatctgttacattggagttggggggtttaattggagaggtttaggaaaggaaagggtatcccttagtgaggaaggagaagcagagagcaaatcacttggttggactctttaagtgagggcttcgctgtgtacttggcagaagattcaaagtctgaatttgggaatctcaagttgtcttctaggtatcagcctcctcaaaaatgattgaatgctgctctgatgttcatgaacttcagagcatcctgggccagaggagagtcagagaagaaagcaactggggtcaatgcatttctaatggttccaggggctccagaaggaaatattgctggatctctgacagcacgtggagtcttttaaaatgaaactcctgtacaaaggcataagaatgataccaaggacttccgggactgtggggaaagggtgggaggggggtgagggataaaaggctacacattgggtacggtgttgctgcttgggtgatgaatgcaccaaaatctcagaaaccactaaagaacatattcatgtaaccaaacatcacctgttccccaaacaactattgaaataaaaagaaattttaagaaaaagaaactcctgcatttctgggggtaaaggtggtgcctggaatctactgagaaacatgcagccttggctgcagtccttcagggagcgcaggcagtagcatgttttagtaatcttgcaggagggaacagccatgccgggaaccaaggaagggagtcagtggtgagaaggttttgttgacaagatgcggaaaccttagcataacacatcttaattttcttttttttttttttttttttttgaaactgagtctcactctgtcacccaggctggagtgcagtggtgtgatctcagctcaccacaacttctgcctcccaggttcaagtgattctcctgtttcagccccccgagtagttgggattacaggtgcacgccaccacacctggctaatttttggacttctagttgagacagggtttcaccatggcggccaggctggtctcaaactcctaacctcgtgatctgcctgcctcggcctcccaaagtgctgggattacagatgtgagccaccatgcccggccaacacatcttcatttttaattgatggccagaagctggatgatctaggcctgtcagggagcaagtagcagaacagggatgattaggagtattggaaagaacttgtctttgtagttattcttggcaggatttctgctgtatcctaatgcaggtgaactaggcacaagacgaacacaactgatgggtttgcctttgcttttgagtgttctgtggcttctaaattggctgtgtgaggacttgtttgcagaattgagccggagcgcatcattaaaggcagcttcaatgcacatccccttgagagaatgcttcaaaaattacctataataagagttggctgtctcctgcatagtttgtttaagacactgcttagctggggaatgtccaactgttatcactacaaactgtgataatctccatatgagggggaaaaatggatcttggaggttgggggatgagatattattatatttcataggggattcaagactggatgacaaaacaacttttgttttcagaattgctgtgcttctcactaaaatagttaagtgtgagggaaaaggtaaaggatggaagtgctgaaacatgcatttagtagggggggttggaagaaagcacatttccttgcgtaggaagtagcaattcagacatttccctggcatggcatttgccttggctgggcatttgattctgccttttcactccctattgtcttttctctttattctttctctgggcttgtgccagtagtcgggtcagtggtctgcttccatgggaccctgcctgtgtaatacatatcttgtgcacctcccacgtagacagtgcctgtcatgagccactgccgtcttcgttggtttgaagctttcacgtagacctttatctttgtgcatctaattttggttgcaaacagtatgagtttagtggctaatgggtaaattgtttagacaagatacagtagactgtatgtgtgagcatatacattctgagactttgggctagaaaatttgtcttgtacaaaaaatgctatgattattaatttagtataaagacaccaagttatgactataaatagtattacagctaacaacaaagcaggtaactttgccatgggattgatccattattgttataaaagtattttgtagacaaaagtggtgcagatactcacagaatatgaagaaagaggaatgtagtcataggacagtcaaatgtatatctggtctaccagttaaagttcatttagtaatacctagtattaatacatactcatgaagcatatttaaatttataatacattttcctgttactaatctcgttctagtgtcataaaataagcaaatattattttgcatataagtcgatgtagaggtccaaagaaagtaagtgacttgtccaaagggtagagaaaggaaactcagatcctgaaattcccagaacaactttcaatgctctgtgaaatagggatcccagattcatgttgacagtttcaatgacagagtgttctagagacaatcatagaacagagaggaaagctacgtattatcttacaggagaaggaagtgaagaaattggagctctcatacactgctggtgggaatataaaatggtgcagccactttggaaaacagtttggcagttcctcaaaatgttaaatatagagctaccatatgacccagtaattccacccaagagaaattaaaacacgtgtccacataaaaattcgtatatgaatgttcatagtagcattattcataatagccaaaaagccagaacaacccaaatgtccaccaacagatgaatggataaataacatgcaacatatccacacaatggagtattattaggcaatacaaagaaaggaagtactaatacatactacaatgtggatgaatcttaaaaacatgatgttaagtgaaggaagccagttacaaaagaccacgtgttatatggttccattcatatgaaatgccagagagatagagtgtaaatctgtgaatgtctacggctgaaagtggagagaatggggagtgagtgctaactgggtgatgaaaatgtcctacaagtagattatagtgattattgtactactctgtgaatatactaaaacccactgaattgtatactttaaatgggtaaattttatgtatgtgaattacagctcaataaagccattgattacaggagaatatatatatttttccatctccaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatgtaagtacagctgtttgtacttattgtcccatttgctgcatagctgtatcaaccagagtgtttatcagagcccctgatagggatgactggcggggaacagggtgcagtgaaatgtttgaggattcttgcagcttttggcccaggaatagatcctttagtttgttgcttatggaattctccgggtgtgtctcctgctgggaagggaactgtgggcagatactgactctcttgggatctattttccaaaaccatttgtcaatgtgaagttggaatcaaggcatgcttatcttgaaaaagagagacagaaaccagaagtgtcatttgaatgcacatatatcagttatagatgacaagcaatgaatgtaatttaaatttagcctatagaaagtaattgaaatatgcactctaggtagttgggaaggcactgtgttgcccacaggtggtatcagtttggggagtcctgtattctttgctcagtccgagttcccagcatgaggccttgttgtgttgccacaatagcaaagagacatggcagcagatgatttgcatattaagtacacttactttcatttttcaaaaacaaattaacccattaatctctgttagcaagcttgagatttttctaagggccttttgtgctatcttctgcaccactgctccaatattaaatgtgtagcacagccttaaagacaacaaaaaataaacccacagtggacaaacaggcttatggcattgcttccaggccttccttcatatgtgaataaggggccgtgagggctatgatgtcagatcccagagattccctgccactaaggagtgggtatcatgcatgttcctatcctgtcttaaataccattctcctaccttgtcatagaggtaaggtagaggattactgcaagattaggctttgggggctgcctctctgttgagagctttcatgggatgaagggccttagcaatgagtatcagatctgtgcatatataaggaaatatctgtaacttcatcctattcactcaaatttatcccaaggcatgtttaaggttggatatgagtttaaatgttaggaagaacagtattatgagcttttaatgtgtgagactggaatccaccagagattttggttgactctgtaacatgacaagataaatagaataatgtgtgaagaatattgagctccttgaaataaaaggtattagttgaaattaaggtattattaatcttaatactgtcattgtggtgtgaacaaggtgagtagaggcattgcttaaaatgtgccttctttgatggggtgagcctcctccaaagatccttggaatgccctgtacacagaactgtcaaataaggagtaagactaagcaggatactgtgatgggagcatctgtcatcattttgattgttctccctaggaatagagtactttgacattgacacctcagtcaccacccgaaccaggcctatgatgcatttcaattagcctgaggctgtagtataattgaggctgataaaatcaacataccctcaaaaagttgctttcctttgtggagggaggaaagataaagctgcataattaagtagacccgatcagcccaacaagtccagtaagagaaatcgaacaaacgagcaagagagcaaacaaacaaaataacaaatgagatcctctagtcaaaagtgggctacatgtctggaagtgctttcttcccttagaaattcagaaagaaagatttcaaaggttatttccttaatctggagtctgtggagattttttgcaaaggtttgggttccttttggagcagtcttgattgtgtggctcagtcattctgtgcctcctgtcagtttctggcctctacccaaatggccaacctccatttggtcactccttctgtataaagtcttgctaggccctgcacccaaccgcaatgtcccagcttagtgtcctcagtcactccacaccatatatcaaacgagattttcatttttccaggcaacaagtcactatactctttcatgattttaagaacacttaaaataacaaatcttccatgaatcctttttcaaataaatgagaatgaagaagcgatttacttctttccttcccttcacccttttgtaaatgtcattttttatctcataattttttttcctttatcttcggtgtatctgtggccttttgttaagtagtgagtatgagcactctcatgtgtttctgcagtctcttttaggttagactgtaagctcttggagagcaggatctttatctgttgaaccattccttcatagcacaggacgtggtgtacctttgatgtcggccacatgttgaccagatgtagctttatattactgaaatattaatttctagcagatatgtaacaagaaagatgactcataatcattttcattggttttattcctatcaaacttgcctacatagttgtttatttattagacatgtttttaacaatatattagccaatttaaacagatttagataacaattttagcagaaatagactttggacaaaaaaatcttttctttgaacattctaattgtagtcgtgcagaaattaaaatatttcaaaatgtatagacctgacatgtagatgaatctgttggtgtaggcccatgaaatgttgagaacttagatttcaattagataattcccattgactatatatatatatatatatatatatatatacacacacacacacatatatatacacacacatacatgtactgtatatatacacacatatataagtatatgtacatatacctatatgcacacatataggtatgtgtacatatataagtatatgtacacatacctatatgcacacatataggtatgtgtacatatacatatacatgtacatatacatatatgtggggtgtgtgtgtgtatatatatatatatatatatatatatatatataaaactctgtcacccaggctggagtgcaatggcacaatcatagctcactataaccttgacctcctgggctcaagtaatcctcttgacatagcctcctgagtagctaggactctaggtacacaccgtcatgtctggctaatttttttttatttttcgttttcattttttgtagagatatggttctcattatgttgcccaggctggtcttgaactcctggactcaagtgatccttcacaccttggcctcccaagggagggaatgcaggcatgagccccattgaatattttttacaaatgagcttttaaagaacctccaaagaagggctctttcaagaagttgcaatgataaaaacatttgagaagatctcagagagagtttagaacactttcaatgtgcttacagcataatatcacatggacagtacaatatcgctattcttatggatccaacagagacttgagccaaaacctggcctatttacttctctttcctaaaactgcatgctattcaaagatgttgactttagaatatacatatggtcttacgaagatcgctgaattgtaagaatctaatatatgtaagatctatatgtatgatcttactcatctcactgaattttaagaatctgacttatataataaagacgattcattacatatttatttataacactcttttaatactaggaacgagagatctcttgaaaatgatggcttgttccctgctctcaaggagtctcactggcaaggccaatggttagatcatcatataatcataatgcaatgtgatagacattacaacaggataggttagagcacgggtccaaaaccccaattaccaacaacgatcaggcacgtcaatgcaagaaacaggctgaaggaaaaatgatatgggctagtgagggccatgctggagtatgggcctggtattgacagatactataatttttccagagaaaacaggtgtttattattttatgtggattccccaagatttaagacaccgggtgagataaataaaaatatatcagtgtgagtcaggtttggctcacagtctaccacctgggtgtgatactctgagttagacttgaaggatcaatgaataaaaacaccttattttataaatgatgctcaaaagtggtttgtccagagtgacacaagctcaatacttgcatagtttggctttaaaaacaaaacaataaacaaacatgatcaaattcgacttcttaaaatgatgcataaaatcatttaagtgaaagatggtgatcaattatatcccttgaagtatgttttcactatctggagtgatatgagggtttcatttacaaagtccagagatggtttgcaggattgtagagcaatctgaacagggctgaattcctcccgagcactttccaatagcaagtctgtctactttattgcagggcccagaggttcccccaagaccgcctgataataatttggtatttggaggctcctgtgtcactgcaggaactaaaggaggctaaatccatgcctgatggaggagaagagttctatggttatctgcaaattctggccagacaacatcttgacgtcactccttagcttccataacctagccaagcaagaagttgcctttccaagacaaagcagtgtgctctaatgactaacccctcaaagtactatgccactttaactatagacccatctcctcgatcaatcaggatggcaagatggagctgaggagctcagcaacatcaagtctggagttggtctttaactcaactagctcgtttagacgtgtctgaacaccacatcacctgacagcacggggtggtttcccagtaaaatttacaaactcagctcaagggcagctgtgttgctttcctttccttgactgctgagaaactttttgacagggaacaatggaaacacaccttctgagctgaaacaaacaaacagaaacaaaacatactaaccagcaaaatccccaaatcatcaatcttgggttctcttgaagggcaggagtgtgttttatcttctcccgtcggagcaaacactatagatgtcctccctaaaattctgtcttccctagagcagccttgtaaattagctagggtcctagggttgaggcctaaatcaacttaaaattgtctctaaatatgtacctggatgtgtttgtacttgcagagcatgccctcttcatgtgcctagggctagtaactccctgtggcagaggcatgtaaagtattctgactttttttttttcaacttaattccatttccaatgaaatggatttttaaaaattttctccagagtgtgccatacttctccagctattatagttaatgtgtgtgtatccttgtgtatatgtgtgtttgtgtgtgcatatgtgttttcctagtggttacatgcttactaggcaattatgtaaataagcacagattcataggccagctaggcctgaggaaagaagacattataaagggagggagtattttaacattagctaaagctatcacacaaggcacccattctgctcccctcaacagccacagcccacttcgtccttgtcttaccaataaggggaaaggctggaggtgatatttttcacagaaccgcagaggttttgaacatatttgcaacattactttgagtacacatgagcaaaaattctgaattacatccaggaccccagaagctcattagatcaaagagtgcggggcccctcagagttaccagagattatctgcagacttcagtgcaatcgaatgaccatggtccattttgatggtcagaggtaggactgaaaaacgggtagaaacaattgctttagcgcttccttctgtactttgcctattaatgttttgtctttcaaaaatatattttctcctaattgtttaattggccaaataatggctgctttgggagttgtttgtatgccttggaaggccatggcctgcactttaaaaataagctaagtccattctgcccagcacgagcattaggacagagaatgcacttattttaggatccttaaaaattgcttcttttatggcacactgggttgacgactcatctcgtgggagccttcatggcacattgctgctgttctgcaggtcccaatacaattccttccccctctcagtgccacggcccccccattgctagctacaacaatttgatatcatattcccttttcaactccaaaggagatgataagaagctatcaaataatgctttaaaaaagcaacttgagtttcttaaaagaaaggaaatgaatacatgctgcataattacatttaaaatgtaagccatgttattataagccgcactgagatgaagatttgttagcaaaccagtttcaagcacactcacagtgaagtaaaatcatgtttttagcatctgaccattgggtaatattattctttgttatcaaaagagaaatatcacccaagtatagtatacttagacctcctagaggaaacactccagtcctaagcttggtgtctgaaaagaaaaacaaaaataaagattatggatttaggtcagggagacagagtgatattctgaagactgtgtttactccctcatcatcggccaaccaagatggagttctgcatcctgcacatatcagacatttcagtccaatttcaccaaagcatcagtgatgttctagaagcatcccagcagatggaggatcctaatgtatttgttctgggtatttcccaaggcccagcctgactggagtgtgtgtaccaacaggatgaatccaatcaagctacgcccccattttggtttcggattggccactcttgcatgtgctagtagattgtggaccaggaccagctgagcaaacacagttgcagagtagcctcctatgttgctaagaagctcctgctacccaggtgctttgaacaattgagtgctccctctggttaagtagagatggcaccaccggagtttttcttggatgtgaggctcaatcctttacggcagctattataacaaagtgaaggttttctccctgggaaatgcagcttttctctgtctttactaattctgccagcctgtgagagtaaccaccgtagctgggcttcttctcagattaattgtcatgccaggtctccttcctggggagctgtgatgctgctctgaggttgattgctgaggttgtagtgggtttttgtttgtttttgtttagtttttcttgattgttcttctttctcttgaatggcaagagaagaaacactttctctaacccacggccaggaaggaaatggggagagagctacttcttagttcaacctggttgccacataaaggaatctctctccttggactcagcccctaactggaagcaagagccactgccctctgagactgagagagcagcccgaggaggagatgaatccattctgccctttgtttgggtttgcttcctgtcagtgagagaatgctgaggcagttcctgttatgtgaaactttcatttttaaaaccaggacagtcctaaacagactggaatgagttggtcaatcccagttggtataggcccaatgatttttgctagtaagataggattgtcttcctcacccaaaatgccttcaagtgccctaaaatgggtattttaaaataagaataaataatgtagatttagtagaaaacctggaaaacataagaaacaaagatgaaacgaaaagtcccatgtaattccaccagttagagttaaccactgatatcgtttggatatatggctttctagtcttgtggatatccttttaatctcttgtaatataaagtctgaccatatgtgtccttgcatttgtttgtactggactctgttaatatttctatagtaatggctcactttggggagattgtgctgcacagtgtgtaggaagcacattgggtgtattattcccagttttgtattttgtatttccttggagatgtgcaggggttaagagcgggggtctggccatagctggccacgtcagactctcatatggtaagtatcacagagcacatgaggcctgtgttatgcgctggaaagactcaggaaatgagaggctctcttgttctgacaaggcaggctgagagctctcatttagggtcatcactccagataactccaaatgcagtttattgctcaactgaagcagatgatcactttttgcctccaagttcttcaccctagctagctcctttcaaagagccgagtatgctggatcttaaagggccaaactagttacatctcatacatttcctgatgtttagggatgccttcacttccatcaaggataccttggctgtgcaaggacctctgatagctggagtctccttttggtcactcccagctttgcttaaacttgatggagtttgctgtccagtgatccccggatctttcatcatgaaagccttccttcctctcctgatgtctcaggcctctagacctagactggggttctggcaaggaggcctctatcaatagtatgacatccaataatatgttagtgttgatattttgcacagtaatattaagtttaagagattataaaaatgagttcaaatgaataagttcctgtgatgtaagagattagatatgtgtgatttcagaaccaaaggcaggggggaatcccagaaagaaaacaataatataatcctagtttctatatattatttttattcattactgtatatgggtagagatcaatattctttcttatgctgttactattaattaacacattttttaaccatgccattgaacttttgggtgcattaaagtggaacccaagctcctcattagataataatggcatttggactgagtgccatattcctaaatttccaataaagtggttgatatagagaggacaggataaagccctatagtgtgcagttatatcaaaacagctagtctccactttagggaatgcctttactagagattacatgaaatgtctgcttataaaataagcagagatggtaccactaagcagccacctgaattgttttcctacaggaatgattacttttcagatccatttatgttttcatgctcaatacttactccccttccctgcaacacccaaagagtttacttttgcaagtcatttggtcttcagtctactactgaggaatagagaggcactaactgctttacccaggatcagaactcatgttcttaccttctattaatagagtacttgagccagatggactaactggtctcacattttctctatcttggttttacttccataaacatcaatatctttacccacatgatttttccatcctcccatttttttccatatgtattagggttcaggaactatgatgctaatgatcacatttcttcctagttcctaatttcattagtgccatttcctgatatctacagaaacaattatcaatacatgtagctgcttgagccttatttagaaggctagcctttcttttccaagtgctgtcagaatgtatacatttagtctgtctttttcccttttaggagtctttgttctgggttgatggcaaaattcctctttttacatgtgagatttttgatttcactgaattctacctagatttttatggacattggattttaaagaggaaaacactcattttcttagtaagatattggtgatacatagctatgccattgatttccatactcctgagctttggggagggagacagtggccaagtagcaggcagaataagatcatcactcatgtcctgaatcaatcacactttccttctcggattgtgtatatgctctgccacttcctacatattacatcctgagtttttaagtaaagtggatcttagccagatttgagtctaatggctgattcatcggcatagttcttggcgttaacatctcagtgtcctctttagttctctttgaggattcatgtcattgagggcctttgtgcctccacttgtctcagtatgaggaagaactttggtgtgagggcggagctatgtgaagggttgctgggttgggggattagttcatatggtccccatgccatctatttacttttggagagaggggactttgagtgggtgggtatggatagatgttcctcaaggaaaccctgctggctaatgggcactacatctgtgtattactgtgattctctctgtaagctccccatgtggccaaggacccccctcctaccagggcacttcctgccacctcattgcactggtctcaaccattcagcctgctgctgctgcaccatgttgggctgcggtaggatagggaaggggttctgttgattgctaaatgttgcctaactttatttccctctcccacatttcatgcaagggagcggacctaacacatgacttgcattctcttcctatgttcagaaactccagggcttgcccacgtgtatgtatgagtgaccaatggagcttggaattctttatctatatgatctgtccgaaaatgagatcttttgtactggaatttgtgatgtagttgatcattcagagccaaacgcatataccaataaagacaagactgtcatatatgtggtctctgttgcctactttcgtcacctgctaatactttttcttacatagacttgagaatataattcaacattgggattcctcaaggcaccacgaacagagctctagaagttgtccgcattggttccccagttgcccccacatagcctctctgggttttctcgaagcaactccttcactcaggtaggccagcactagggtgaggcaagaatgtcacttgcttaaggcacagaatttaaagtgacaccagaagtgtcagtactcaagataaataatatactcatgcaacattttaaaagataaaaaagaatgcaaaagatctatgaagaaaatatcaaaattttaaataaagccagcataatcccaggagggctgggatgagtgtaaggtgagtgagcttagtcctacaagttcagggtcagatcctgtctttccttaaaattctgatatttttggctgggcatggtggctcgcgtctgtaatcccagcactttgggaggctgaggtgggcagatcacgaagtcaagagatcaagaccctcctggccaacatggtgaaaccccatctctactaaaaatacaaaaattagctgggcatggtggctcatgccagtagtcccagctacttgggaggctgaggcaggagaatcgcttgaacccaggaggcgggggttgcagtgagccgagatcatgccactgcactccagcctggcgacagaaagagactatgtctaaaaaaaaaaaaaaaaaaattctgatattttttaagcgcaaatatttgcattcaattttatcaagaactattgcattacacttaatataatttatctcaataactggatttttagcatttccttaattgtgtgcacaaagcaagaatctcactccctttagccttgaccttggcctcagggctccttctggcctggatcttgtgtaaacttctggcctttgcaaagctgttatgtgtacataaacttctcagtggattgtctgtcagtcttcggatacttcctgagttcctggcctaattgtccttcctcactgcctcgtcttcccttggagatgcagtcccctgtctcccttttgttcagccagcctcagcatctccagcagtaaccatcctgtgctatctactgaaatagcagataagtgcatgctcatcttctcactacatttttaaaatttttatttgttgtatgtgactctccagagtgaggaaatgaatgaggctgccaaagagagagagagagagagacagagagagagtgagagagagacggagagtgaggcagagacagagacaaagagagatagattctttggaaaaggacaggagggaggatcaggggactttctcagtaagtctgagaaataatctaggggaaaaatggataaaatttttaaaaaataagggaaattctttaaaaaacctatattgcttttgtcccccacatttggaggtgtatgatacatttgctaagctgaagatacagtatttgagatttaaaatattccattttcactcagccagtttcttaatgccatgcgctctttttgtaatatttgcattctctatttttatataatttctacctaatgctttttatgggccaggccccatggattgtattttcacattaaaaaaatcttaataattgctgcagtatagatattactctgttttacagatgggaaaagtgaggctcagaaaagttaggaggaaaaggaaaatgcaaattccatcctgaacaaggggttgttattgaagcccaggtggatgtcctggaagtgaggactctttctagcccagtgctgctcatcctttccaaattaatacccagcaattttctaactcagcaagaggaattgtagtgttggcattgcccctttcatgtgggtgatcaagtatgctggggtgtattaacctttggatctgaagggtgaggagtgtccacatggtgggtgctgaacttactgataaaggaggaacctgccagtgggcagagcccaggccatctatggtacaatgattgatataggctcactggcctgtgatgttttctctctcagtagtgtctttaagaaatattaaatgatcatgaatataaagccgttatttttatttttttgccaattaaaattatgtaaaattccactttttcttttgccaagccctctctgaaaagtttacatttttagttttagttcagaaaatcctagaaaaagcaagctataccatagatctcagactctttcttgagtgggttcactcctcggagattagcatatctgatttcctaggtgaacttgatatccaagaaaagaattcaaagtgtgccaactgtgtttgggagcatgttgaggtgcatatatttgctgagtttctgtaggcaatgctgggaggagtgagaacccacagctcctgggcagggtcaccctgtacaaggaggccaagggaacacagtgtctagtaaagccttcttttcagcatcctatggggaaccagccttgatgcgaatcttatgagcatcgcagaggacagacaagtactcctctggctcaccttctacaactcgttccttcattttccattcaaaggtccatgtttccaaactggctaattgaatggagtcaaaatttctatagatctttatgctttagagagccgttttaaaaacaagagttggcattcatacgtggcattcttccaagcctgcatctacgtgcttcataaagtcaggagatatcaaggagctgatattcttgagcactttgtgacagacacacatgttgaccaatatctcatataagtcttttaatggagagagtaacacatgttctttaaaaacatcatacagcacttctttactgggcttggtaagtgcagatgagttagaacggcaaggttagccaaaatgaataattattttctgactcaatgtttattctcttaattatcttgataactttgaaaaaaccatagtttggagtatgaattattcaaatgtagttcaaagtccattgtgacaagtaataaaatacattcaaaatattgtttactagagtgttccaagcccgctgaacctctatgcattatcagctacaaagctgcagagcatggccagccctttggggtggagatgcagccagagagtggtttggagaaactaattagaatgtgacttcagagaaaaggggctgaaatatttccaaacagagaatttgatgagtcctttgctttccctggggtgggggttatgtatgtttctgcatgaatctcgaaatatttgccagtatggaaaattttcccaatgagaggagataaaacaaatctctgactaataagactgtctgggacctttaacaataaaactccaggatggggaggggacaacaagggtaggaatgaaagttcagattaggcttagggtatatgtcgtatgtctctgttggatgatgaacgtgtaatcaggaagtcacgtctcaccaggaattcagtggcagtagtcaatgactgatataaaaaattgcagatggaaataaatacttattggcaattttgtaagttctgaatcatagtctgttcaacgaacaaacaagtgctttggcatctccggctcctagaacagtgcccaagacattgtaggtttataataaataggtagtaaactgaatgaacaaaagaatggatgatcttatctactttgcctgtcatcttactgtagctttgggaagaaaatacatctctacttcattgagcttcaggcatctctagtatttgcctatgattctggtaggagcaaaaggttggttatctttccttttgaattgcatattagctatgcccattgccatgtctgttcagtgttgggtttgaagctttttctcttgctctttctgtcccacctcctaagtaatttgtgttttgagaattctcctgtctggttttgtaacttgggtttcaggtatgctaaagctttatgttttgtattatgagagaataatttctcacaaggcctaatgctgaagttttaatggaaatatacatatttctctcattgaatttacacaatagtcatatggtgggtattcttgttactttaatcacacagaaggaaaacagtaaggcactgagaagttaggcaacttgcccaagaacatacaactactaggcaggagagctaggagttgaacctagatacccaaaccctagcatcggcttttaatgcacacactgaattcgtgcccgtctctctgtctagccatcaagccaggcttctttcatgctcccaccaacacacacacacacacactgacccacaatggatttgaggcagtttacgttggaaatgcagccagtttaactgatgagatgggtatctgcaactttctcattttccctgtcatttaaatcctgaaatttctttccatactataaaacactgtttagattcaaaattgacaacaagggagagtatgattccaaatggtaaaggccaggccagagtctcaagtccttcatctttgatggagagccaccccttggccactgccaagggccaaggtgatttggaaggtgatggtagcaagttaccaggcggtcttttatttgtggctttgctcagcttagtttttctcaaatatgcaagaaagctggaggacaccactgttggaggagatctgtatctatttatccttaaccccatgtccggtagcaagccacttggctgttggcagttgtcagcaagcaaaagctcttggacctgtgtttttcactgtgtcatctcttttgttctagtgtgtgtgtgtgtgtgtgtgtgcgcgcgcgcgcgcatgtgtgcattataataactagaaatactttcttttatttatttatttttccgagtcggagttttcgctcttgtcgcccaggctggagttcgcgatctcggctcactgaaacctccgcctcctgggttcaagcgattttcctgccttagcctcctgagtagctgagactacagacaggcactaccacacccggctaattttttgtgtgtttttagtagagatggggtttcaccatgttgtccaggctggtcttgaactcctaacctcaggtgatctgcccgcctcagcctctcaaagtgctgggattacaggcatgagccaccacacctggcctgctagaaacactttctaagaatcaaatccctgcatccaaactggtatctatcaaatctgagtggctagaggtgaggccaaataatctgcattgttaaaaagtccccagacgattaggataaatgtaagagtttggggatcactgttccaggttagacccattgtggaaggttctcatccagaaggaccatgaagctgggtaaggtgacgtgaggtggcaagctccctgaggacaggcttgtaccttggttgctggtaagtttttttcctagccttcccagctttgctgatacatggttacccttcctggttgcagtacaattcttttaggttttaaaacatggaactgtttcactcatgcgggtttagggcacagggattgtggttttgagggtatagtagcacaggagttgaaaaggcatttaagggatagtcttgtcattctaatgacaagcgcaatgtctccatgaggccatggttcttgtttttgcataatcaacatggaacttgatccattcatgagtttaggattctctgtgcaccaacaatacacctgacatgggtcaccaaatagcggatgagaagaatctactgattgatattttcacaaacacttcataaagttgctaaaatgccaaaactcctaagcttaactatttgaaaaggattggcaatttttttaatctatataatcagcaaaatgcagaaatgcccaaagtgggtgagattaggctcaatccttctaataattcggtatcaaaataattagaaactggagttgcatcaaaagttttctcaaaattcaagttcactaacctagttgacttttctcaagagaaaatatgctataataatgtcaaattatcagaatgttagttgtataatttagtacttagtataaggaattattgggagatcattttattcctccttgcaaattctaaagtttcttttggaatttcattttatgtgatttgatctgtacaaaataatgtaagaagagaatgggacagatggagagaaatgattgaatcaccgtgtttcaatgaaaagtattcaaattgcatttcactacataatgaattctgcttcaacttactttgacataaataagattgggtaagagaaaccagaagtaaatcaaataaattaataaaactatcagagctgcttcaattttggtcctcagacattgtctgctttatttgtataatataacctgctcttataaataaaaactcttgcatataactcagttgaaaacaaaaatttaaggaagagttagaaaatttggaggcctgattagggcaccttctaattttacaaatatcaatttttttgaaagttgaaaaactgaaatttgcaacctagaagagtgaccttcaactttcaactagacttttttaaaaaaagaagatgggagatacagacatgcatgcaacatcgacgattagctgttcttcatattttcctaattatacacatttactgaacatgaggacatttttgcattttgtctagacgaaggctgtgtctccactggcataatatatcacgacgtttgtgagtcttgtgcaaaattgaatttgcatctctgccgccgcttgtagagttcattatcttgcaatacaaccactgggaaaaatacaattttctgtgtttaataaaactgttgtcttctcatagtgcttatgatgcttgaacaatttgtcaggcactatttatcacagatgctgaacactaattatactgtgtgtagtgcctgtaagagtgattttaaatattttctttatttaatatgtatcagtgcaaccagggttttttgcaaccacactattatttgcatttctgagaatcaatgtgtcttttcacaatattaaacataaaagaaaagccactaaactaagagtagaacatgtaaaatatgtactggatatagtcaggaggcaaggaaacggatggaaaactcagtctctttgctccctagttagcctagggctgtagaaagaagtagggcattggccagtctgaaatatgtctccaggtctaattaatactttataactttctaggatagagatgatcactgaggtccctccaggctactcagttctgcaatctgtgatttaagtaaatcagaagttatttagcatggcttcactaatcagaaacctgaaagaccagaggcctgttttcagatgatcccttgaaaatgagattcaaatgaccaaccactaaaagaatcaagtgctaaatcacgagatcgagaccctgaaacatagtctccagctattacgtgtttttttgaagaatggctatcatacaaacacaatttcagcgggtctttatattaaagacaccatttaaatgggaactgcatccggtgttctttgtatggtaataaactgagcacataaaatgaatgtgtagcagaatagaagttatcttttttttttcttttaataatcctgagaagcatcatgtcgaacacatggaaaacccttagactgaaacaataaacagagttagtttgggcaactttgaaagaaaagaaggtaaggaagggttatttcctatgagacttattggaacccagtattcaaaatggttttcctactgacatcttgaagaattctgtgctttgttactatcatgttttcaccaacaaaagaattagctggttgggcctggtggctcacgcctgtaatctcagcactttgggaggccgaggcaggcggattatgaggtcgaggtcaggagttcaagaccagcctgaccaacatggtgaaatcccctctctactaaaaatacaaaaattagcctggtgtggtggtggcgcctgtaatcccagctactcaggaggctgaggcaggagaatcgcttgaacctgggaggcagaggttgcagtgagctgagattgcgccactgcactccagcctgggtgacagagcaagacttcgtctgaaaaaaaaaaagaattagctgaaagagaactttagagaatacagaacacctgtagatgggaaatgggatttctaactctctaggtcaagactatatactttcataggtatatgaaatgtgtgaccagtataaatatatgtgaccaatgagaccactatgaagaatttgttgtggactcaggtaaagcagtgccacacaaagaaattcacccaaagaggaagtaatggttataactcttcatgaggttgatgttgtcttcctgtattttttcctggaagacaacagtttagtttggaccatgatcccattggaagaagcttcgaaagcttttggagctgttggtcacctcgcctccttaatgcccaacatttgatggtttggagaaatgtaattgccacccaggcactgcctaggcttgggtgttcaagtctagccttaattatcaccgaagctcagggccactgccattctctgaagcccctgatctaacctggggcctccaactgtttcagatgagtctttgtcttagcgacacaggcacattctctttttctgttctgttgctgcaaagtggtatctgaggcctgccactggagtctgttcacctaatgccgttccttgaatatattgcatgagaagattcttttctgttttttatcccaccatctcctgttacctttatgtcaacactttctccttgagctgacccctcatcagcttaaaaccagttcttgcttctagattttgcttagcttgtgttttctgggccaccaaatacttttcactgggtaatgtaaaaggagacagagcaagccaggaagcagatgtctcttgggtggtgtgtgtctttgagaattggaatttgaaatctctgtatgaaaggagcagtgaatgggtgtaattagtcaggctgatgaaggagtaaaacctggtaagcagtttttcttgactggcttaatgaaaagcattagctatcagtttctgtctaaacgcgctgagggtaaaacaagtgtggggtttgaacaaaagataagattcagcgtgggcttggactccgttcccaagaataagttttgcttgggcggaaagtatgtggttcatccgaaaaaaaagaaatcaatgatttgtggcagttcttcgtgcattttatttcaggataatttataatatttcaggaaatgtaaggggttctcgcaaaggcccaaactggtgttttataaccaagtatgaatgtgttgctccttttcttctcatcccctcaagccagacactttctctaggtcagttttcagggccaaggaatcttttgggggttaacttacggttatcttccatcagcttttgtccttccctgtggcatggacctagcctaagaccttaagacctgctcacctcctagtgactagcaagaaattaagtaccccctggaggggaagatttcctgctctcaaagaaatttttaaaatatactctaacatcacttatgatgcctttaaaggcctcggagaaaaacgatgtgagtttctagaagaaaatgattttatatcattgcttgactatgctaagctgtagtaaggattcttcatgcagcaagaccaaataccccaatgatcagctcaagtccagagggtggcccaagatgctgtttccttttttgaccatctctgcctccagggacagcagatagacatctccagcaggaccagcggcatccattctcagcttgactttgttacatagatttcagctttctggcttggacccctgtgaaaaaatctcttaaactgggaaactacaaaagggctggatccacattttttttccttaaaggaaagattatttgttaacgttaattgaggttgcagattattttcttgatgttgtggggacaaaagtgacacatgatcttactttctgtcctatttgattaaaattcagataaatgttacaagggatgacaaaacccattttttttaaaggtacacaacgtctggataaactacagagtggaacagaaaacaaaacaaatccagcctcgtattttttttccacatagttaataatgcaagaaaaagccagccaggacaaagaaagcagaataaaaatgtggttcttgggttcagatgttagagatgagcattgagagaacttaaccagttctggaaagggaaggagaaagaaaactttttttgagacttgccatctgctaagtgtttccacatacgttatctcagctaaactccaccttcaggcaatttcttatagatgaggaaagggatgcttgaagagtttaaataacagactcatagctcaggcagaaagtggcagagaacacttcgggaggacatggcgggtggatcacaaggtcaagagaccgagaccatcctggccaacatggtgaaaccccgtttctactaaaaatacacaaaaaaattagctgggcatggtggcaggcacctgtagtcccagctactctggaggctgaggcaggagaatcgcttgaacccgggaggcagaggttgcagtgagccgagatagcgccactgcactccagcctggcgacagagcaacactccatctcaaaaaaaaaaaaaaaaaaaaaaaaaaaaaaaaaaaaaagtggcagagaagagactcaaacccaggttccctgccctcaaagccaccccagggacttctgtctttacctttttgtaaccaggcactgggcaccaatcctataaaaatccctaagaggttggacccagtgcttagagtactcaacatattataaagttcacctgaccccagagacctgcttcaacccataatagcaaaagcgttgagtccatgatcaggacaaatcacaagtcacacaacctgctttagtttaagtctctgggaagcccagccttcatttttggctaattgcctcattggcgaactttccccattatttattaatgacagaaattttttttttttttttttttttttttgagacggagtctcgctctgtcacccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccaatgacagcaattttttaaaaagtggctctttaaaaacgcttttaaaaaatctttctgtaattctaaaatacctttgatacttttaagtaagactcaaaaatacttttgtattttattttttatttattcatttatttttgatacagagtctcactctgttgcccaagctggaatgcaatggtgcaatctcagctctctgcaacctccacatcctgggttcaagtgattctcatgcctcagcctcctgagtagatgggattccaggtgtgcaccaccacacccagctcatttttgcatttttagtagagacgaggtttcaccctgttggccaggctggtctaaaactcctggcctcaaatggtcagccaaacttagcctcccaaagtgctaggattactggcataagccactgtgcccggccaatatttttgtattttaaatgtggacatcacatatcattggtggcatattctaaaagtataacttattcagtcttcactaggatttagttttcagaaaaaattgtcctgacaccaccatcattattaccagtatcgagacagttgcctcatacttgagttttaatcctagcctcacagcttgtactcttatgtgtccctgggcaagtcacataacctcaatcagcctcagcttccattctgaaaaatggtagtagcagcattataaagatataaatgtctgctgtttgggggccttattaagagccagctgctgcacttagcactttgcttacatgagtaaaatgaggataagtatgcccaacttctttagttcttttgcatcttcagggatttccaatacacatacatctagcatgaggcttggcatgttgtagtcagtagccatcagtcctgctctcctcccctttacttccccctccctcaccttaggtcacactaggtcactaataactcaggacctcttgttaaggtcttcaataaaacatggtggtgatgggtgacagcaggtccatgggtgtgactgatcagtgctaatggccgtgacccttaccgtcctcatgtgacaggctcagagccagactggggctaattgattctattacatttagagatttaacctgtagggggtactcagaatcttttttatgaaggggccatttgatgaactgctggggtaaggatccatttcttagccttggctttaggttgcttgtcccaggtagggaaaatgtacattggactttcttgatcttttctcatcctctaggatcagttatagctgaccatttgaatgaaatctcctagttacagaagcagtaatttgaaagaaaagtaattaagggatctagaggaaattgcgagatataaatgaaatttccatcttcctactgccataatatcttcaaaggatcccattagcaatccccttgggatgaatgccatgattaaaaaatgcttatctgtggtaatggaacaaagacgtaggacacaaggctacccttgatcatataacaacaaagaaatacacctgaatctgggagattatcttcttgtgaattataaggaaatgcttctcagtcatcttcattgaagtactgactggcagacagaagtctgagactataactctaaggtgctttcttcaattgtaatatatctttgaaatctcagattttattttaaacatatgctttgtgatctaattctgtgtgacaaaccaccccaccattagtggcttaaaataagaacaatttacttttcccatagtcccatgtgtcaacctggctgtttacttcaccgtgtgctgtcagtttgataggaaagtccaaaatggtttcttgcctgtggccgatagttggtgattgctggcagggaattcggctggaattgtcagccaagggccccagttctcatggatgcttgtgcttcttcacgtcatggaggactcaagatggtcaagcttttttttaaaaaaagtgccaggccttccgaaagcttaggttctagaatgagcactgtctcaccttccctgcattcttttggttaaaatagcctagattcaagtgaagagattatacgagagcatgaaaacaggaagacacggtgcattggaggccatcaaagcaatagtgcactacaacatgggaattttgcacactcttccagaatacatctcctatatgtgttataaaaatatattctcccaaatagtcaagtaaaacgaactcttgtataagctgtggcaatatgcattccatggttttgcttaccttggcacactactgtggacatgccactagggaagtaagtgccaggattttcttcttttctcagctgaaaggttaggtcttgggacccagtagggcggatctgggacgagagtagaatacagatggttagtccacatattaatctcacttagtgtgcatgtatgactgaatcccaaagctaaatacaagtgatttttattgacgttcatgtctatgttttcatcctttacccacagaattaagttataaattagaacctagagaagtatgggaaagaccctgttttattaagatgtccagggatgtaacttaatttgcttggctcagctaatatagtctgcttaataaaatctttaccagcatgtgtcacactaaaactggtttttttttttaaagaggtgaacttaggccggtatgatatcaagatggatataggctaggagagctgcagagtatggttttagtaacccagtctgatttatttccctaagggtggaggagttttttcactgcaatcagtaacaaggatactttgaaatagcacagcagctggaaaacaaatcatatatctaaatgtatctgcccttgtttcaggccaaagtctgcaaattatccaaaagacatttttcttgcttaagttatctgagctctgctgctacacaggattgtatattacactcactcctgtagggcccagagagaggccccaagcagtaggttccacataggcaaagtacagaaaatatgcactgccctgattgccttagctctgtctctcacatcttaaaccttctgtgtgagagattccatgtggcacatccccaaagctaacactgccaactctgaaacctgacttctaaagagtagtattgaatttctgcttcccactctccatattttattaacaaaaagcttcaaacatacagaagagttaaaagaattattcagtgggcacccatctacccacctggattctacaattaagatttccctgtcagtgcatcatcagtccatccatttctagaagcaattcagaataagctgaagaaaacaggacacttcaagtacaaactgcagttcaatatttactgtcctaggctgggcacagtggctcacgcctgcaatcccaacattttgggaggccaaggcaggtggaacacctgaggtccggagttcaggaccagcctggccaacatgatgaaactccatctctactaaaaaatacaaaaattagctgggtgtggtggcaggcacctgtaatcccagctactcgggaggttgaggcaggagaattgcttgaactggggaggcggaagtttcagtgagcagagattgcactactgcactctagcctgggcaacaagagcgaaactccatctcaaaaaaaaaaaaattactgtactttcttcttttctttttctttccttccttctttcctgcctccctcccttccttttttccttctttccttctctctgtctctggttataaaagttgcatgcaatgaaatacactagccttacatgtactattctatgagcttggtgaatacatgttcctgtgtaaccataacccctgtcaagatccagaacattagtattacctcacaaaggtctctcctatgtctttccagtcaatttcctccactcaccctccaccagaggcaatcactgttccgaattttttaaaccatagattcattttgcctgttctagggcttcaaataaatggcatcacacagtgtatactctgtgtgagaactgggcttctttaatacatcttaaaaatctgaaatcatgtaagtgcacctctttgtgctggatccagaggcagctatgctgagaccctctgctcctctccttgcctcgcaggagcaagaattatcccaggagtcagttctgactgcccagaaattttggagcacttgaccccatgctcttatttcagtgtccccaaaagcctgcagcagcttctcattggcagtgtagatgtggacgtgcagggcagcgtgtgacagagataggaagagccggcacacccatgcaggcactcacgaaccccagacgctgtgtgtttattaggaggtctgcctttgtgtctgtgaatcggactctgtatcactgattttactctgattgttccatgagacaaaggaggaaatagtttgcttcaaagcatgcaatgtgacccagaggggagaatggtgtgtatcgctggggatgaagcttcttggccaactaggcagacactgctcattctgccttcaatgtagtaaaagagccacctgtgggagctgaagttatctttaagaggcttttccacacctacagagttcttttgacaacaagaaacaggtcaccctactttccaagatagaaacagtacattcaggaacaaagagagggtaacacagatggaatgtgccccacgaggcctgtcaaaccgagtgttgcaaggagatatcatcaggctgttcaatccggggggcgcggactgagtatgttcccaagtctgggtctctcagtgttatttggctaaatgaaaagtctaacaggtgcctggcaattgcatgcactggtgagacccacacttgggggtgtttgggtgttacttgactatttgggggggtatatttttataacacattgaatagtcctcattgcacacccacattaagaagctgcagccccatagtcttgaatgtattccagctgtgagctggttctcttttgcatctcacacgtgtagtttaacgcgacacagttcgtataagcagactagcagcaattatctcctctaatggattattttatttagctttgtgcgttattgggacatggactgctgaactaaggcaaagttgagcgactcctttgacttcttgcagtccagctatcccaactttttgttctgtctcattttgtggcatggacccatcagatactactcagcaaataacaggaagattcccccaccataccccacaacctccacctaaatattctatctaaacttcatgctgctcaaggttggctaagagcaaggggcttctttgagttttacagcctggaaatattgtagtcttgtaaaattattatccaagcaatagtttgcctacaaaaatcttactgtgaggactaacttacaaatatatctgagtgatgacagacatcagattaataaattgccatatgcatctctaaacaacagataactatcagtcatttctaatattgtgtaggatgacttcaaaacaccatacaggaccagggacacaattcataagccttttcctctaattagctacagacaaagctcaatagatagagggaaattggacaggcatcagagaggataagacagatgccactgggctcagctggaacaaaatcacaagaaaacatacaggtttatgattcaagcttatctaagcaataatggaaaaaaatataacccttagataatagggcaacctgaaacaataacctatacagcttaccatattcaggacaaagagaaggaagtgaagggtggggagacagcaggatattgacaataagagaaacaaaagcacaggaggctcgtggacttcgtactcttaaaaagtcttttaaaaaatgtcttctaaagtaaagacatactttgcaactttccaggcctcacttttaagcaattatttgggtacagagatttctactttctctgaatctggagatgctgcttggatgtgattttagaaatcaataggtttagaagtccctggcacttttgatccattagctggttcacagaagcagcctttcataaaagtctttgtaaactgcttttccctaaaatgattctccctaagcagctcttctcttctcctatacttcatcccggcagccagataatcaaatcctagaggagagacagggaattctcttcacatttctctggagcccatgaccaggcacccataaccacaattaagaagagaggccagaaaggcagggcctggctgtggggctcctttagcttcttggtaaagggttttaaaccggttcttattatctttttaaatgttaaagagggaagtcctgttgaacccctgatggcattcaattatgggcatgattataaaatgtctcagctctttggggagtgtgagcaaatcgatagagtgttgagagagtgcaaagctgtgaggcttgccttcgcaggatctcctcccttctcccacctcacttctgcagtggaagtttgtagtagaaggggcttgcttgctgcatggagggggtttagggaattattacctagcaacgcagggcaaataaatggtgctccgagacctttaactcatttgataaaatttttaaagggtgccatggggcattcctccatattattcacttgcagaggcctatgttaattcgtaaataaataacatggttctaggatctttggccaccccacttttgagtaagcctctcaccctctcttttctcccactctgtcatacatttttgttgttgttctgttttagatgagttctctgtgaaatgaacctaggtgtgtttgtttatgtgtttttctgaacaaggcaactttggttaatgcacgtggctccatgtttcaaagaaattatatggctactctaaatatagcaggataatttcatcattagggtgaacaagcatgcatgcattcattgagcagtgatttgtgacatacgccctgtgtgccaggcactgtgcaagaatggaagctccatgaggatagagatattggtcttctttgcccactgctgtatctttgatgcctgaaacactgcccagcacagagctggggctcaggagcatgaggacagcctgcacatacaatgagggaaattggaagcacattttttcctccctaaggctgtaacccagttctaatcacttgtgaaacccacagattggaaagaaagaagtaatttcatgatgttaggcctcagtggtgtgtctctaaagtgatttagtgtcctgaaggattctgggctatctcactactttagacaactctgaaatggaactggcagagtgtaagtgcattggaaggacctgctttttaaaaataaatcaaaattttaacaaaatgcttttttcccctatggcttacgactgtacttatacataaatgacctcgtaccatatgctttaggagggattaaactttaatagtgagatattctaaagccctgtcaggacatctccacaaaatgcttgttcttctgcctctccctaggagtggctcctgataagaggaatggtgaggatgaggatgaagaccaggacgaatgagagtaaatggggaagcccgtggcagtagctgagagttaggagcaagaggagtaggcataatttggggaggtagaccaccttcccttcctagaattgtttgtctgacctctcctggaatcatagccctgctctgagagatgttcttgttattcctgtcatgactccattcaacatatgaggcaaccaaagcccagggattgttgtggctcctcgtggctagacagctggcaaatggaggggctaagctgaaccttgagaggacccttctgagcccccatttttttttctgtctgagacggagtctcactctgttgccagggtagagtgcagtggcacaatctccactcactgcaacgtccgactccctatttcaagtgattctcctgcctcagcctcccgagtagctgggattacaggcacgcaccaccacacccagctaatttttgtatttttagtagagacagaggttcaacatgttggccaggatggtctcgatctcctgaactcgtgatctgcctgcctcagcctcccaaagtgttggaattacaggcgtgagccactgcacctggccttgagcccccgttcttaatcaccatgccctacttcccccaggggttccccctgtggtgttgctgtgacatttttatgccatagttcggactcctgctgcctatttcagcagtcatgatggtcccctgcctgttgtggtgcaggattcccttgagtgctggcacctcttgttctgtccctggacaaaagtagcatgaggctgagaatgatgcctgagccaggtgtgattagtgccttaggacccagaagtgcagagtgtggaagcaagcccttcctccacaccctcacaaaccacttcttcagggctgctctgcctggtcgtgcatgtgtccctcattactcactttggccggagcattggtgaactccttgttgcacctgccacatggggttctgaagaagatgaaagaaatatcaactgaaaaggcctgtgagcaagggacccagggctctataaaaccaagggtcattcttgtcttcgtagccatggcaaccacagcttagcccagggtgggcagagggccaggcccactgatttgcacagaacccccttgatgtgcaaggaaatctggaggcagaaaagcccatgggataagaaaaagatgaaaggtcttatctgccactgtttttttttttttttctatgatatctgtagttggctttgaaaaccatctttataagacagattcacttctgtctttttgggaaatgattgtagctgatgagattcattataaccacacaggagcagcctagcaacatctgacttctgggcttgcagaagtctctgcttctctgtcaggacagtccttccatggtgccatcactttttcagaagtcaactccagtttactagctattagtggtttttcaagtgatactgtgatatcctgtctgtccgtggctggctacaatgcacttaggtgaagtagatctttgtgtttgaacaagcagaccttgttcttactatgtacatactcagacttgaagaattacacagtggcttaaaacactgttgaagaaagagggttatctagtgttttcagtttctttctttctttctttctttttctttcttttttttctcgttcttatttcttattatttttatttcttattattcctgtcatgactccattcaacatatgaggcaaccaaagcccagggattgttgtggctccttgtggctagacagctggcaaatggaggggctaagctgaaccttgggaagacccttctgagcccccatttttttttttctaagacagagtctcgctctttttttctcttttttttcctcgctctgttgcccaggctggagtgcaatggtgcaatcttggctcactgcaatctctgcctcctggcttcaagtgattctcctgcctcagccaaccaagtagctggaattacaggcatgcaccaccacgcccggctagttttgtatttttagtagagatggggtttcaccatgttggtcaggctggtctcgaactcctgaccttaggtgatccaccacctcagcctcccaaagtgctgggattacaggcgtcttcagtttatttctgaacaaaggcttgcttaataagaggcttgccttcagtgacaacaaagtctagtataacacaaatatgcttttccttgagtgatttgagcactgaaatatgggagctgagggggttgataattctccaacctaacatacagctcctcttagaaggatgtcagcatgaatgtctccttagccatattgggaaacatgaaatatgtgtttatttaaagacaaacaggagtattaatttgcttcagaaaatttgaatgactttgaaattaaaaacaaaattatcttatctaattagaaaacaacaccccatcaaaagttaaatgtgtatttcaggacaaaacatagacagggtgtgtttaaaatatctgaaagggtgcccagaggaatgggttttatatttgtacctccaatctcagttgaatttttaacagttctgttacaccactaatccttatcctttactttttttctctctctctggaaagtcaggagggcacctgccctcccaccagccatgacctacttcccagtctggtgttcccatccctctgcaactatatcagtgaaggccaaaacccacagtttgagtaacatatttaaatataggtcaagaattggaaccagctgagcttagagaatagcacgtcatacgattctatattgtttaggtgaaaattgtgtttcctgttcctgttgttcatattggggtgatagagggaagaagagagacaggaagaaaaagggaaaagagagttagagtcagaacagagacaagagtgaagaatgaaaaacgtgtctggatgtgaacagagcagtggagcagagtggactccccacagaacccaaagacctggatactacaggatactagttccctatggggtggacaccaagcttctcaaattctttgtcccttggtctgtggaaagaaaattcctgccctacccaagtcttagggtcctttagaaaatacgaagggatgcaactgaacaatatctgtcagggtggtgtaaaggaagcaggccatgttacaggaacaacttactttttgggcatctcaagtaaaaggaacatggcataggtctatccttcccatgagacatgacaccaaatgcactgattctcttgctggaaatcagaccagtttcattagtgtcaggaaaggaagcgcgcacttccctatagccatgatcacgttcggaaaatgagtgctggttcgggtgttagaggtcctgtaattgtatctcttcacttaaaagacaactattcatagagtgactagttcaaggtctcacaggtagtaaagagcagacgtgggaccagacatcaagctacttgtttctgctcattgactctgtttctacccttaacctagctcctaagcttcctgaggctcagagtgtgtgaaggattctgtgtgcattcacagggttgaggctagtgaggaaaggatattcttcaagttttcatcctgaagtccagaaaccccatgaaaagtactgagaatactgtgggcacactgaagggctggcatctgtggtttcctgttcttggtacagcatccatatctctcagaggtcatgacagccacaccaattctaaagggacaaaagcaggctgcatttcagaggcacgccttgtaaaaatatgtgcacttgtgagtctaactgtaaattgcttagttttttcagtgattggatcatgaataccaccttctccagtaggaaaggaagacttgtgagcacttctcagataacagggacagtctggataagattaaaacacaaaggcctcattgtatcgattcatttaaaattcctctcccccaagtcttcaaattaaaaagttttcaacagctaaacccatctatcaatttcagtacagaaacttttttttctttgcaagcatcaagaagccacatattgatcaaaaaacaaatgagtggcaggaggtaaggagccggttgtgctaataaacggcatacagtcagctcccacttcgacctagaaataaaactacgaagtagaacattgtaaatagaatggtgttttctaaaggaaaatggataactacaggttacatattcaattaatgttttttccccagcagataactcacagatgagaaccctcaaaatgaggtgataaatgtaaattactatagctctgttacaactttcattttattttgttttgttttgttttgttttattttattttattttattttattttattttattttattttatttgagatggagtctctccttgtcacccagactgaagtgcagtggtgtgatcttggctcactgcaacctctgcctcctggcttcaagcaattctcctgcctcagcctcctgattagctgggactacaggcacgtgccaccacatccagctatttttgtgtgtgtgtgtgtatttttagtagagacagggtttcaccatcttagccaggatggtcttgatctcctgacctcgtgatctgcctgcctcagcctcccaaagtgctgggattacaggtgttagccaccgcgcccgaccataatttttaagacgtaaacagtgctttaagtccaataaaataagagcaaatgcattatgtataatacttatacaagaaacctcaagttattgtgaagagcatattgattttcatctgtctcttcataaccctctttttccaaaatactgcacctcctaaaatgcaataatgatggtggtgctaagagtgagctaaccccagtccagtccagggctagattcccccttccctcccctggcttcttctccatgtatgtctagaccataattccctctgtacagaatgctccaaaactcactagagtcaccttacattgaagtgtagatgcatgttattttagtaatattgcttcagtagtagttgaatgtgaagactatcatcaggctgggcacggtggctgacgcctgtaatcccagcactttgggagactggggtgggcggatcacttgaggccagttcaagaccagcctggccaacatggtgaaaccctgtctctactaaaaatacaaaaaaattagccaggcatggtggtgtgtgcctgtaattccagctgctcagaaggttgaggcaggagaattgtttgaacctgggagtcagaagctgcagggacctgagatcatgctactgcattccagcctgggcaacagaatgagattctgtctaaaaaaaaaaaaattaaaaattaaaaaaaaaaaagactgccatcaatactattggtgttttccactttagggatctttgtctttttcctacaatgagaaggcagaaaacttcaaaagattcttgtgtgttcttttttgaaagcctccaagagtccccatgcatgctgtaagaatgtgagaattagggtgagtgagtgtgcatctgtatttgtttcacaacacttcaggagaaggagaggggaggtgaaaatctttagaatcgggtgcaggattggggatgatttttcgttctctgcttttggtacttttgggagaaatcttcatttttgtaaataatgagtatacactggtttgcaaataaataaatacatacataaacatgtaaataaatctttaagttaccatgaaggaaagggaagcaggcaaacgaatccacaggactagtactacaaagagggataagtcattccggctaactctatcccctcaatctttgggtgtcttgtgtaggaatcctggcccttccttccctatgtctctaaggctttctatgtgataacagagacaccctgggctctgctggcagagagcgctggttcaaaactcatttctgcttctatgaactccatgattttagccaagttactcaaactgagccttagttatttcatctgtaaaatgggcacaatgaagccttctgtagcttccatgaggtctaaatgcaacaataattgtcaagtcattcacacagtttcacatgcttacaaacaagttatctcaatgattgttcattcctttctccaccctagcctgcctcattatagttaccatgtaatttgaagatgaaaggagtttttgatttttactgtactgctcgtttgaaaatctgtacacgtaactattttaatttaaattatttaaaattccataaacttaacattttattttcttgtttaaagtggctatgaaataatacagtgcagatggaacatttccatcactgcagaaaggtctgttggtgcttgtggtgctattggctctcttgcagctataggtgtgatacagttgtggtcaaggaaatgtcaacaaaagtctccaggtaaagcttttctggaaggcagcttttgctgccgggttgatgttatgaccatgaggtgatcttgaggatggaagccataggaaaggagtagagaattagtttagagctggtcatttggagatacttaacagctagccatttctcacaatctcatcatgttccatctttcccaatctccatgttatggtcatctcataactaaaatacttaatagctctttcttaaattgggcaaagtcttaatctcaatgcatcatgttcttttcaataggaaaggaggccagataggagaggtagtgtgttcttggaaggcagaaaaatctttccttctttcttctgatgtccaattgttctttcttgtctctattcttttcttttctcatttcttccttcttttcttttttccttccttccttccttccttctttccttccttgcctccctccctcccttctctctctctctctcagattatagaaaagacattcacctggcctgggaaactcttttactgtaatagggaaatgcttcatcagtgaacctgtagaaatccctccctcgagtatttttctaagcagatgcatccaccattactgatggcctgttttaggctgttcaaaactagtgaaactaaatggacagtacctacaatgccaaagaaagaaatgagaaaaaagctcacagatgctacaaaacagcttcaatatggaaatgtccctgcttctgaacaccttcttctttggcctctccttttaaatccgaagttattatagattattttttcctaccctgtatgctaggcacatgctgttccgaactaagaattcatgaattttaattctcattagtaaattggcttcttgcctaaccttgggcagaggacacaccatgtctttaatgcattcctctaggaatcacatacaatgctgtaaaaggtttaattattaatggaatttgcagagaacttgcctagctgtataactccagccaaccttaatttttaatctttataaatacctttgaattttaataaggcaagttcacagcaaggcaaccatttattcttcaagcatgacttttaatttatggtttcttcccattctttgctttatctcctcttcctccctcccctttggatggatttctctaccatcatacaccaacataatattttatcttcttataacaactgtgtttttaaaaatgtagttgagaaaatggaagctaattgttaaaaagggaatctcaaatttctgtgaatgtttttattcaagctctgtttctcctctgatgtagaaaataaaaatttagtgatatcccttcaaacaacagaatattctgtgaaggtgtatgggaggtatttctgtcatattacatatgcttgttgactataaagttggttttttgaaactcacattacccctatagtaacaatcttataaatggtggttagagtatgaagatagctcacataagtctgttttactcaaagtccaatctctggctttgaaatgaaaaatactgggaagcaatgctgttataatccaagtatttaaatagaacagaaaacatctccattttagtttttaaacctccagcttttcttctcctttatactaatatttttcttgccttacatatgttcgtcaactcttgaagatcattaaagattttttttcctttaacaaaaggagaaaagaaaaatgaatagtgaaatggtgctgatatgactatgtaagcatcagatgagagaagaaggcacacggtggcctgcagtggtggccacattcacgagaaagaatttgctaggtagagttatctttattctggaaggtgaaacacgagtggcaaatggagaaggatatggggacaaaatgtccctctgaaggggaagaaagacagtagtagaaatgttgagcagagcaaagagccttcaaggtgacactgttaccccaaacctactccatggtggggttttagagggtgtgtgtgtgtgtgtgtgtgtgtgtgtgactgacagaaaccaggcatgtgcaaggaaatgatgtggacacagaagcagggtttttaaagtgctaggcataactaaagaaggctgaaattttctgcttcacctgaaggatagagggaaggacagtcccaggagatgagacagggtaaaacaagtttcttccaagctatcttacaaaccagtgctttttaggctcattcatgggtcacaaacaatcaatatttttttagaaattaaaatcaaatgaaattgaattttaaaagtacattaccctttggagagaaaacatgaaattttaggtgtatactggctaatgtctactagattgctatgtaaaagtacttcttaatttggattacaatcaaagtcagggaatgacattgctatgtgtggtactttggggtaattaatctgggagtgtcaggtaggtggattctgtacgcagacttaaattaatatagatctgaaaggaggaagggtcttgtcagggtgatggcagtgattggaatgaatgaagatagacatggggaaacgataaatgtgaaaccaatagcatttggctgctgattggatgtataatatgaggacaaaggagaaatacaaattgtttctgttttaatctgggtacatgagtaaacggtgagagaagaggtataaagaacatgagtggaagctcaggcttggggcagcagaatgtgaattcgatttccaatactttgcatgtgtgaagcaaaagagacatcccaaaggaagctggaaatgggaactgagctcaggagagctgtggggctggagctgtgaattgagagaaatccctatggaagggagatttggctcttgagaaaatgtatagctgtagtgtgagggaatgtgtaaagaggaaaaaataagagaaaacaccaattctggaattccagacttgggaatgcctagaattcaggagcagcaaggagatgaggaaaaaggggaagaaatgagagaactagtgtcactgaagtggaaggacaagagcagctctgaggggcaggcaatgggatccaatgacagagaggtcagagaaggtggcatgtgagagaaaaagtgtatttgccagattgagcccagtagtgaccttgcagagcagcttcagcagagcagtgggagcgagctgactgctagggtatgggttgacctggttgggaggtctggtggcgaaggcccccatgcagtcagtttggcagggacagatggagagtgactgagaacacttgatttggttcttccagctgactgggtcttctctcttctgtccaaccactacgttgatgacccttgctggatttagtgtgttttccattaaaacagacccatcccctgtccctgcctctcagagctctagggttagtggatggtaatgattccagtcccataactcccagctccatgaagactgaggggattctgggactggcagggctgtaaaggcacttagagatgtttttggttggaagtgccttgctggctgtgcctgtcgatggacagctttgcttctttaagtattcctttgtaagttgtgtgtatcaatagacaaccttcccccatcatgtccatccttaatcactttttacttttgctttttgttaaagtaattttaaaaggagtgttcctttttcaaaaagaaaaattttaaccaattatgtaattcaaaagaatctactatgctgttggggaaatttgtgtaaattacagtgagggtcaccgcacttgtggcagttatggagtaaatgtggaatcaatatttcttggattgaaacatggaaatctactttaaaccacaccaaaaagatgtatttagaatcactgaccactaatattaagtgatgatgaaactaaactttactcctatagctttgtccatacctggcaggactgcttctaatgcaggtttctactagatcatgatatatgaaaggcaaagaaatacggtgaatccagtaagagagtcttcacctgggaagaatgtgttttatttggataagttgcatagccatttccatagcaaaggaatattttcagaaaatgaactgaaagatgtgttgcatatggaatctcacttggcattttggtaaaaatggagaatctttggttccctattattaccagcagcaacaataagcaaacagaaacgttctctctgagttcatttacttctttttcaaaatgtggaacaaaaaacagcacacatatttttgtgcctgcctggcaaaaatcccaaaagctctgcttaattctgttcagggtggggggataaattttacactagcaacaaatacctgggaattaaaataatgtgtgtctgttgataaagcaacattttgcctcttcggaggcattactcttcttctttttttttttttttttgagtaacactctttgcttttcctggttttacagatctgatataaataaaggtggttgtggactttagagtcttgtcctatgttgccttttgctttgttctattttagaatgcatttgaatatgttcaaatgccttgtccaagttgatagcttctgaattctcaaattcttacataaaggtcagacaataccctttggctgcctcttgtgttctctgttggttgtggttttggaccaggagatgtcccctgaagatgtcctctagaaacctttactgctcagggaaatactcagctgtgtttatcattgaccaaggagcaagtgtctttttaagatgtcagagcacagaaagctgaagttattctactactggctaccaaaacaaaacaaacaaacaaacaaacaaaaacaagctccctctagctggacccttcaaacaaaggagtctgtttcatttgtaggagaatgtgggaaacgacatttacctctgggtctgtatgactgcctttggcagattctcgacatacatctgatgaacaaatgactcaatgagcaagaaaactgaggtgaagcacttggaagcataccatgtcagagtagaagtgacttgtctggtcattaaaataggtaaataaaagtcctttatgcctttctagtctttaaaacttttctacaatgaacatctattacttttgtaatcagacacaaagaaagaaaaaacgaaaataataaacagaacactagttaaaaataaaacaaaacaaagagatctaattgcttttttaatgatggcattaatttacttgatgacacatttctttaatatttctctcatttgcagcaagccatgtgttaacagtgcacaatacacatactcaatgcatggctgataaaaacattaagtcaacaaacatttattgagcacttattaaatagcagggtgcttgctaggcacagtggggtatttatggataaataatacatgagccagaccctcaaggagctcacttatgatgcaggtgggaccaaatccataattgttaataatgaatggtagcttttagtggcaaactgttccttacaagcaagtaatgtcctttgtccgtattaaaaacttactcaatggcacaaggcacacctcttacaatttttaattaaacttctgctttgaaggaattgtagattcatatggtattgtaagaaataacacaaacagagcccatgtgccctttacccagtttcccccaatagtaacaccttgtaaaactatagtacaatatcacaaagctatgatattgacattcatacagtcaaaatacagatcatttccatttccacaaggatccctcatgctgttcttttatagctacacccactttcctccccattcataaacccctggaacccactattctattctccatttctataagtttatcataatgttatatatatggagtcattcaggatgtaaacttttggatttttaaaaattacactcaggacaattttctggaaatctatcaaggtggttgtgtgtatcagtagtttgtttctattgattgctgagtcgtattccatggtataaatgtatcacagtttgtttaaccatacgcctattgaaggacatctgggttgttttttggttttggctattatggataaaggtgctataaatatttgcatacattgtgtgaacataagttttcaatcctctgggataagtgcccaggagtgcaattactcggtggtagggtagttgcatctttagttttagttgttttttttttaagacattgccgaaacattttccagaatgactgtaccctttaacatttccaccagcaatgtatgagtgatcctgtttctccacatcctcactgtcatttggtgttgtcattgttttttgttttagccattctgataggtatgtaagatgtctcgttgtgctttcaccctgcatttccctcatctaattattttcaacatcttttcatgtgtttgtcttgccattgtttatatatggtgaaatgtcatctcttcatcccttttcttcatcttctaattggattgtttatctttaacaattcagttttgagagttctttatgtattctagatagtagtcctatgtcatttataggacttggaaatattttctcccagtgtgtagcttgtcttttcatcattttaacaggataaaaatgtaaagcaaaggttttgattttgagaaagtccaatttgttaatttttccttttaggttttgtgcttttggttgtcaagtctaggaatactgtgcttggttttagatcctgaaggttatctctatatttatttttttctacgaagttctgtagttttatgttttacatttaaggccatgattcatattttatttaatttttatacacaatgtgagacttaggagatttgatttttgcctatggatgtccaattgctctgtcaccatttattggaaaagttattgtattagtgttacagggctgttataataaattaccacaaacttggtggcttaaaacaacagaaacgtattctctcatagctctggaagctggaaatctgaaaccagtatcatcagggccatattacctcaaaaggctgtaggggagaactcttcccttcccttgtctcttgtcttcttatggctgttggtaatccctggtgtttcttggcttatagatttgtcactccaatctcttgtctcccttttcacatgtctgtgtccctgtcactctctgtcttctcctttcctgtcccatctaaggatgctcgtcattggatttaaggcctactctaatccagagtgatctgatcttagaaatcctaaccttaattacatctgcaaagaccctattccaaataaggtcccaatctgaggactcagcagccatatatttttgggtccataattaaacccactacaaaattgcttttacatgcttgtcaaaaatcatctgggcatatctgtctgagtctgtttgggttctctcttctgttctattgatttatatgttcatttctccaccaatagcacatagtcttaattattgtagctatataagctttaaaatcaggtgcgtaagttttaaaatcaggtagaatgagtcttcccattttcttcttgtcaaaattgtttttcactattctgtatgaattttgaatttccatatacatttcagaatagtgttgtcaatatctacaaaagatttcactgggattttgataggaatggtggtaaacctgtaagtcagtttgaggagaattgacatcattactgtgctgagttgtctaatccatgaacatagtatgtttcttatttatttagatctttgatttctttaatcagtattgtagttttgagtatgcaaatcctacacatgtttgaatattcaactagccttgcattcctggaatgaaccccgcttgatcatgatgtatcattcttttgatatattgctaaattctatttgctagtgttttgttaaggctttttgcatatatatttatgaagatgtttgtagtattttttgtgttatgttttctaatatcaagataatactagttttataaataaatgtataaatactctctccacttctgcttcctggatgagactgtggaattgggatgaaatttttaaatgtttggtagaattctctagtgaaaccatctagaattggagattttctcttgaggagttattaaccacaaattcaatttccttaaaagttatagagctattcaaattaggtatttcatatgtggtcatttgtgcttttcaaagaattggcccattttgtccataaaacttgtcaaatttatgtgtaacgttgtttgaagtattcccttgttatcttctccatgtctgtagggtttgtactgttttattcttgatgttggtcatttgtgtcttctctcttattttctttgtattactagaagtttgtcaattttatttatttattttcaaagaaccaatttcttggtttagtgttttcctctattgtttttgttttcaattttattgatttctgatcttacattttttaaaattccttttctctgcttgttttgggtttatactgctttccttctaatttcttgtggtaggaacttagattattcatttgaagttttttcctcctcctagtgcaagcatttagtgctataatttttctctcagcactgctttatctatgtcccccaaattttaatgttttgttttcatttagctcaatgcaattttttcttatttcccttgagatttcctatttgacccaaggattatttaaaaatgtgttgcttgatttgcaagtgttcaaagactttcttgtcattctgttattatttttattttaattcattgtagtaaaggggcacactcaacatgatttcagtttatttaaattagttgtcatttggtttctagtccaggatatgatctattttagtatatgttcagtaataagtctgaaaaaaatgtgcattctgctgttgttgagtagagtatcctagaaatgtccattagacctttttggttaatggtgtttttatttcttctatattcttgctgattttttctgtctaatggatttatcaattattgaaaggcaggtgttgaagtctccaactataattgtggatttgtctatttctcctttcagttatatcagtttgtcctcgtatggttttcagctcacatttaggtttattatgtctttttggtgaattgattcttttatcattatttcatatccctctctctctctctgataattatctttgctatacagtttactgtatctgatattaatatggccatctctcctttgctttgattaatgtttctaaatcttcttccatctttctatttttgacttgcctttttttttttttttttttttttatgagatggagtctcactctgtcacccaggctggagtgcagtggcgcgatcttggctcactgcaagctctgcctccccgggttcatgccattctcctgtcagcctcccaagtagctgcgactacaggcgcccaccaccacccccggctaatttttgtatttttagtagagacagggtttcaccttgttagccaggatggtctcgatctcctgaccttgtgatccgcccacctcggcctcccaaagtgctgggattacaggcgtgagccactgcacccggcctaacctgccttatttttatatttgaagtgaatttcttgtagatagcatatagtcaggtcatgtttcttagtccatttatcaatttctatcttttaattggtgcattcagattattctatttaatgcaattattgatatgttagggcttaagtttgccattttattttttgttttctgtttgttctctttgattgttgtttttgtttctcttttgtcttcttcctgcctttctccagataacttgaacattttttagaattctttttttatttacctgtagtgttttggagtgcatctctttgtatgccctttttagtggttgctttaggcacattttatatacatacatacatatatataacttattacagtattctgtttttgacatgttaccagttcaaataaagtgtggaagccttaatcatctttattccactttactttccctttccattcatatataattgtcttacatatttcttctacatacattaaaatcacaacagaaaatgtataatttttgcttcaaccattgagcacaatgtagaaaactcaagaggaaaaggaaaatgtgttgcatgcatttacctatatttttattcttttcttgttcctgaacgacatttttactggatatagtattctggactaattagtttttttattttcatcacttgaataaggtgtggtactttcctctggcctccatggtttcttatgagaaatctgctgttattcaaatagttttttccttataggtaagatgttatttctctcttactgctttcaaaattttttctttgtctttagttttgagaagtttgactctaatcttcatagtgtggatttttttggaaggcttagcttgtttggagttcactccttgaatctttaggtttatgtcttttgccagatttgggaagtttcagctgctatttttcaactttattattattattattattatttttgccatatcttctttttttcttctttgactctgatgacataaatattaagagcttttgttaagatgtagttccctgaggctccatttctttagtttttccagtccattttccttctgaaaaattgagtaatttttgttgttctgtcttcaaatttagtgattcttttcatctgccctctttattcggtagttgaaccattttgctgagttttcaagtttgcttattgtattttccaattctaaaattttcatttggttttctttatatcctctggtttttttgtttatttgtttgtttgtagggactttatatttctttcccggcacttactattttttatttgtttaaattgtatttgtaattgctcattgaagcattttcatgatgactgctttaaaaatccctgtcatataattcaaacattactgtcatcttggtgttggcattattgattgttctttttaaacttcagtttgatatctttctggttcatgatatgatgactgatttttccttattgaaatctggacatttgtggtattctgttatgagattctatgctatttaaaccttctgtttgagatggtttcctctgacagcactccaccaggggaaagggggactctgacacattactgccaggtgaaggtagaagtccatattttccactcaatctctgttgacacttgagagggcagtctccttgttcctgttggatgcgggtaggagtggctttgtccctatggtggttcgctggagtatagcgattcttgtctaagagttttctgtatagacttcccttttcctgtactttggacaaagaggtcagaatttttctggggatttttttctgtgcccactggcattttcaggtttctggcttcttaagctccaatttggggacatacgaagcaaaaagaaaatccagggaattcaccaccatgtcattccaaagtctccaggtagtctgccttctcttcacctttcagtcttcttatgtttgcttaacacagtggttcccaactttttggcaccagggacttgttttgtggaagacaatttttccacacaccgggaatgaggactgagggatggttttgggatgaaactgttctacctcggataatcaggcattagttagagtctcataaggagtgcacaatctagatccgtcgtatgcgcagttcaccgtagggttcatgctcctatgagaatctaatgccgctgccgatctaacaggaggcaaagctcaggtggtgatgcttactcatccgctgctcactgcctgctgtgcggcccagttcctaacaggccatagatcagtaccagtccatagtcagggggttggggacccttggcttagtgtatgttactctatggtttgtttggccccaccaagtctcctattaaaatgtgatccccagtgttgaggtggatcctggtgagagatgtttggactgtggggatgcggccctcatgaatggcttggtgctattcttgagagaatcagttctcacacttttagttcttgagagccctggttgttgaaaagtggctggtgcctcctccactctctctcttgctgccactctttctagccacgtgttctctgctcaggccagctccctttccctttcccatgagtggaagcaatctgaggccctctccagaagcagatgctgacacgattgttcttgtacatcctagaattgtgaaccagaaaacctctgttctttataaattacccagcctcaggtatttctttatatcaagggaaagggactaagacagttgtctagggtttttagttgtacttagtgggaaaaattgggaaaagtacatctactccatcttcccagaagcagaagttacatctcttatattttaatttaccactatggttccccagatgttgagctttctggaaaattaataaaactactcaagtgtagaagaacacttgctatatatgtgacttcttaactgaaattatgttttccccaaatcactagagaagtgtcctgctcaatgtaaaagagatgattatgaaggaggcatttgactttgggataatgaggttgatacaacagtttagacttaaggaaaggaggtttaggattggtagggtccaaattggggagctcacctggctaaaatctggcatttgaaatctatcagtccagagtccacaacgtgcagtgctacaaagggtaggtcaagtctacctctgttccaaggctctccagtgtagttgctggatcatagcaacagaagtagtttagcaagcagaagagtcatagctacagttactctgtcctcccaaaagtagcatcccaccaagggccagggaggatgagaaataaaatggaaccatttgaagaaggagcctagaaggatgtagctatgtgtcacagtgggttcttgactcagaagagagctaaaatatagtttaggaaactagaggaaaatgttagtcaacaaaaagggataggcagggtggttaaaaacatcagtactcttcatcctagtactcaggagacattactagttgatcatggtactgtttcccactagacccacaatcctctcaacataatgtcccatgcaggcactaccaatcaataggtggagacacgtaagaagacatctgttttccagctcaggcgggaagctcattccaggcacacaggacatcagatctagagcagcacagtggactccagatcccattaggagcaggcctaaggctgcttatttcttgccttccttaatgagaattggttcagggtctgggtgcagctgagcctgatactgctgactttgattatgagagctgagattagtcaaagaccaagtggcagagaaaaaaaaatctttctttgcatattaagatcctaggcttagctgatctatattgttaattcctgaagatttcaagttagcctgcttacaagttgaatttcaagagagagatggcagtgatttacggtgacatctattaagcttttatagaacataatacatgtgttcttgctcctaccataaaattaattgttgctaattagttagggctgccagctcgcttgcatgtgaaagtctgtcacactcccttctcctggtcctgttaattagccttccacagcctcctactgtctcagtgtcctgtagctttcctctcaatgtatgtttcttatttaaacaaatgagcctgctgtttggctttggttggttttggagagaggtttgactttgggggcatagaagtccttgttggcagtcaatggtgtcaggtgagacaaaccatttttgtacaccatcatacattatgtaagtgcatttgacccaaaataagtattcctctttcaaagttgttttttaaattgagtattgaatttccatgaaataatacaattaagttctcaggtacttggttttgatgatcgtttctgggtttctggagtctgggatggagatcattctggtgggatgacagcccataagcacgtgtgcagtggaaggagcactgggccgggcagcttcttggttgcaat

SEQ ID NO: 12570 - DNA, 12232 bp, Human
cctttcgttcgcatggaatcgcttctgcccacggggcgctgacgctaccgagctcatgctaatatgctattcttcgccctcccctcctcatccccctactcacacaccctcacccgccaccacaacccgccccccccacccacttcctggttttattttttttctcgcgcccgctagggcatcgccgagcagcggcggcggcggcggcagcagcagcggcagccgcaacatctgggggaaacttaaggtggtcacgtaggtttccccgaggctgcggcgcaaaagagcccgcggcttcctggggcagccgcagggcatctgatggcaacgcctccccagccgccggcgagctgggggcagcagggagtaggcaaaggcggggctgcagattagggttgagcagcccgggatcccgaatagttccacggagccatcggccggtactgagaacacgagtaggggggcaagttgcaaaagggtcccggctgcctggaaacgagccacaccgagaaaggaggggcggctgggacgctctgcgcgagtagaaaagcgggggcggctccgaactctccctcccaaggcccagccgctggaagccccgcgggagaagccctaggaagccctcccagctccggccgggagacggggagggggcttgccctccggagctgcggcgtttcctttgctagaaagctccctgcgctctcggcgtggctaggggaaatgacttgcaaagcagaagcggcggcgacttggacggccgcgggggtgggacacgctcccacagccagctcgggcccctctcctggctgggctgtaggctcacaccttacgctttgcggagacgctgcccccaatccccacccgcttcgcttttcttgtccagtctttctgggctctaagattgaggctgtgatagaccttgtgtttcaaacgaagatcgatttattcccttaaaactcgtggaaggggtacgagttggtgggcacagaggagtatcgaaagtattagagtttgcagaaggtgggaatcagagtacctttctgcagaaggcgcacctgttgcctgctgctcggctgcattgtctgcgaaaggaaaaggggcgacgcttcactctgacttttggggtttctaaagagctgggtcacggtcactgtctaccctctccccttcctctcccccccccccgcaagcaccacgtcctccatcgaacgtgggcactgcatggaaataaggaaacatagaaaaataagccctacccccactcccattccctttcagatgggagtgtggggggtgggggtggggtagagagagtgagagagagagataattagaatgaatatatgccagaagaggaggaggcctgggacaggaaaagggagtaaaaggggatgaaccgggtagggaaatcccacccgaactgcgtgagccctctgagcgtctcgtgtcatgggacatctgtacgctcttccgctaagggggtgacgaaggtgggtgggagaggttagggcgctgcaaggcacatcccattccgtgcggctccaggtgcgtactacctggcccacgccggccttgccttccgccggtgcttttgttgcaccctccccacatgtgagcggccgagccgctgcgcgggcgcaggggcttcggggaaagtgaagtgtcgcgacgctgcgggctgcgcagacctgggagaggtcacacctctttcggaaaaaaaaaaagaaaagaaaaaaaacaccaaaaaccacccaagctggctaccaaggtgaacgcagagcggttcccaccttaaaatcggccctgctcgtgacgtcaggtcggaaatataccaaagcgagcgcgggccaggagtccagggagcgcggcagcgcggcgattgggcggcgggccgctgacgcgcgctgacgcgcggagactttaggtgcatgttggcagcggcagcgcaagccacataaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaagtgagtagatgcagcccatgcagttcgccttcttttatgctttttccttcttttgcacgtctcttctttccacttgtgtgggacaggttctctggaagtgggagccagaggcttctagtgagagtgggaccgaaggatggggagtgcgtgcgcgcagttaccggggggcatttgttcgaactccggctttggcactagtggggagttggctctcgacagaggtttccaggctcctcattggtggacgtggaagggagactccacagtttgggagctgaggactagcccgcggaaatgtgcgcaaagtttgctgttagtgaggaattgattgtggcctgtgaacacggagactccaagtcctatgtatacgagggaagctgcccacaaactgacagggagaggaagttcttcagtttatgcgttgcttgggaactgtgtctccgcggctggccagcgcgcgatgtttcccgggtattgttgagtaagggtggtgttggtagcgtgtcctgttactaagttgcctgaaatttctggttttgacatatgctgtccttgggtttgcgaatgtatcagagcgagaatatgaatatgtaaagagtacagttatgaaactgtggagctaccagggggttaatatccaacacaggaatatctctaagggctgtggggttcgagtctcctttctgctttttctgggtaatcttccccccacccccaccaccactatgaagcaagattgtgggggaggggaaagaataaaaagagaggatactggctttcttttttcattagtaataagattgtctgtgctctagaatgtcttccaagtgggaacatctgaaaattactaggacacaagaatgccttgttccagaaaggcagattgtggaaggcattatggggaaggtgttcatcttgctgtgctgggaaacacttctaatattggtgccaataccatataagcagtatgtcccccctctgcaattgacctaagaagctcctggaaaagtagatcccctcttcccaccttgtgaccattaagccttgtgaccattaaagatgctgaaagacaagttttctggaaaagtgaacatcaatttatctgtagctccaatcccagtgctctgtcaaaagcactttagaagtgcggatgcttccactcaacttgccttctcagtcaaggcctttctaacattttgtaagggggaagattgttttctcattttatattcttgacttctactttcttcccctctaccaaaagaaaaggcaatttcaccacaagaaaaaaaaatgcaagagaaggttccaatgctgtattttcatactctagtcttcatactcaggtcctgaattaacctaagatggaaatgacctctccacctacactgtagcaaaggggccagttcattacatcataaatgttaaatgagttcatggactagctttcctcttgcaggatcttctctctgcaaggatttacacagtgcaatgggtggtattttctgttgtttcaagtcatttcttttatacattcattttaagtgctatgtttggtaaaggcttcccactcatttccaatgagacaaacagggaaggcatggaagggcctgcctggtgagtctacatatgcccagctgaatctctgtcgggaagaaaccctgaagcttcctgtgtctgtatttcagggaggagattggacaggctggactccccattgcttttctaaaaatcttggaaactttgtccttcattgaattacgacactgtccacctttaatttcctcgaaaacgcctgtaactcggctgaaggttagtgcaacttcatttctttcctttactctccagagctccccaaacatcaagaaacaggacaaggcaaaccctgtaacttaaggtttgcccgacccatcgccttcgggaacaactttctcattgtgaaattcaacttcatttctagatggtcatttctagaaagagactgctgaatctgagcttcagagaagaggctcatctgagtgggatgagtgggggggtatgagggagatgtttggaaatacccaggagtgtagaccctcagtagctttttagctctgggtctttatttggttagtctttccacgccctaaactgttgttctgcagcattctctctctcctgcctttcctctcgcgcccctacatgctctctgactgccgcgggctgccggtgtagctccaggtgtacccgagcccgggagaaagtgttcagttgaccaggctgagtgtgttatcaccctgtttcatttccagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaaggtgagcaatggcgggagcggagtaggcaggtagggagcccctagtgcccgggacctcggagtgtgccctctgccttggtgccagtagcccagccccagctctcccgggactgcccagctctccggggtccgccgaagctgccctgcaggagaccatgggctgcggcggggacttccgggtgtctgagaaagggaagcagaaagactgggaggccagggtcgcatccccctcgcattcagccgacccggctggcccccgcccgaagttgctggagccggagttggaagagggtcatttgcatgtgctaggagctgtcttccctgttcagaatgaaattggttaggacagagaaccgtgtctgagctaaccaagtggaacagaattccctatggtcaaattaagtgatctctttatttcgccatcctgattgaataatcttatcattttaaatagagaaggtctccaaggaatgtaaataatatgaatgcccacggatttgtatttactgagcgtctccttctccttctcttggcatataaaacacagcaaggagcggcaaggttagctcaaatgttaacgctatcaattttcttctgttaaatgccctgggggaggaaaaaagaaaagaaagaaagaaaaggaagagaaaaaaataaaatggaattgtgtgtatgtgtttgtttgtggggaggaatcgtagaccccagtcacataacagaaattttctccgagttgcctgattttcaaaagaagaaaaaaaatgttggtctatattgtctccttttgcagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaaggtaggctgaggggagctgccgaccctccagtttgcgcctttaggaaaccactgctcatactccagcatcacgttccacttcccggtgctggggatctccgactccccctcagtatggcctccaggaccctgcagctgcctgcttgcccggccttccctagagaaagccgccaggcccttctctcctttaactatacgacccatttggaggaagacataaaataaccccgcattttttaatgcttctagtcagtgaaggctttacaagcactggggccctcagccgctcagcctggtgccccgcggctgcggccttccccggggagggaccgaggcagcagctgggcctgggctcggaaaagcggcgctaacagggctcttcctttgcagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccagggtaagaagctggcgggggggatatcatgtggacaaaccgacagatgggcaggacccctccccacatccgtcattaactctcagattcaacgggggtaaagaaggcaagcaaggctgtatatgcctcgcagctctggccagggcctcaagattcagatcttcagacaatccatgtagctgggggcatagacatgaggacaggatggaggaaggaggagagggacacgccacagggtttgaagctgtgtgaattcccactaccccactaccccatcgcccctcctcttccatatacaccagtgcctctaccatgaaatccaggggctgtgcaaactctcccccttcccaatctactttattcccagtcctccatagagatagatgctttaatcctcatccttcctggcactgtgctggggaaggatgtgggggcctgtctgggggtcagggaagggaaggagagggtgtaaagaatgccagtggggtgggggatcaagtggtcagatcctttttactccagctgtgaaaaatatgcgggctttaattggaggaagtatgttgagcaaacctggtagggactgcaattttattaagatttgcaaaagggcgtctcagctcgaggcccactctgggactagcatgaatactaacatgtcaattgttttgtggagataagagtgaacgtttcccagggctggatggcactgtatttagtctgtatggaaatgacaatttacatatttaaagcagcgacctcgtagcaccatccctaattgaattaattgccccggaacatctaatttccttactggtcagagagaggtttaattgttataaaaacctggctcccctattagaaacggggttagcaatttcacgggttatatattttagagaacctcattaagtgctttttaaaatgaaattccagttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtaataagggagggaggagacaatccagggaggctgtgagagaaatcaagaaaggaaaagaaagggaggaagggaaaccagagggtggggtagagaaaaagacagaataggaaatggaagtcggagaaaggaagaaaaagaaagaaaacaaaaaaagacgagaagaagcgagcccagaagccttggatgaatggaatggaggtgggatagggggcgttcttgattgttatgaaattaaaccctttcaaggtccactggtctacattttattaactcttcagtaattaggtgactcttaaatccctcatttattgctcttcaagtaattagttgtttagcttttctctctctctttttctcccctctctctctttggtattaattgcaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacaggtcagtactgcaggcgcagggcgcttcccctccagaactgcctagcaggatttgtcctgagtttcccttgtcacagattctccttggttttgccaactagctaactgtcttgtacattcttcttttgtttctgattatgttttctgcagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaaccatgtaaatgaacagaattttgtcttctttttgggtcagaaaaaataatgactaaacagcaacataacatacacagttggagattaatttgggataggtcacttattcaatatctgaattttaaacagcctaaatctattctggcaaaagaaatcaggtgaaccagaataattatccagataattcagtaaaatattttttcttaaccagaattttccagtctggtgaccaatatttattaggatcaatttagaatatctcaattcttctgttaactttgcaagtaagtgtagctttcaggagagaagttctggagacccaaaagcttttgaacttgagcaaggtcagagtctagtcaagtacttgtcttgcacagtgattaggaagtatctttttaagactcaagaagtcaacatggatttgaggagtgttgtatgtaatctccgattttccaatttctcaatttacaactgttgggtcatggagaaagggcaaagcagttcaggccctttgggccttgggtcactttggcacagagcagaactcagtagaggtagttcttacaactctttattttcctcattcagtggatggtgatgaggtgcaatttgtagttttagaatagaatttctcccgtgtaagtttctcaggtacatgataaaatatctatgtgttgggtcttgggcctagtataagcaagttgtagccgggcctctaggattccacccagcaccaactttcaaaaaagaaaggaaactgatgctgtagaagctgcttccactcagaacccttgtccttgggcaaatgaagtccaacgagtttcaccttagggcagctgtgaattcatagagagcataagatggggacggtctccttcgctgaccctagtgaattacagatggcctttgggtcactgaaatttatgaagagtgttattgtttttaaaatgcagagttagaactgtaaattgccacgagagcgctcaggttttcttttgtttgtttcccctctttttaaaagacacgttttgcgggtcagcaaaaagagagaatgcaggtgtcggtggtaatataaggttatttttacgagatgcgtttttctccgggtaactgagggacaaatagggtggccacataagagattaaataataacgaaatgttcaatttcttgactttcttgaaaggatgagactagccatatcattttgttttcacatcttatgcccaagtaaagccacaaagcagtaagtaaagcgaaagagaaaagctctttagaaatgctgggaatctgcagagccttcagcactcatctccctcccaggtgtctgcagccctgagacaatgacattccgtcacacaatccccgagagttgaacccagaaacgaactctgtgactggttctcccttaaggaagcggctgcgcaacacccaaggccaagggggtgtcgggtagttcgcctcccgggaatttggggtcaaaggaggcagagatgaccctccaccatgtccgcgtgccgactgcaccggctcgcggaacattcagttgtgattcctaagttgcaaattggctagtgccttttctgtttcacagagtcgctgtcaaactcccggccggccgcgcaccgagttgctcgggtgaagagcgtcgcatgcattgcccctgcatctttccagatgcagctgaggacttttcttgtcctaatgtttctaggagtaaagtgaggaaaaacagcagacacgctgcattgccaaaagccagacgttgcattaccttcttcagaaagagattaaactttgtaatgagggcttcataccgccctcgtattcccgcgtcctcttaagcatttcagttattgtgtatcgttccagcaatggaaaatatatgatcattgttccgaagacatgaccatacagttctcagctctgagggaaggtctaattttaagtctttgctatctagccccattttgagtttatggaaagatggccttaattcaaagctcgagtga

SEQ ID NO: 12571 - DNA, 9442 bp, Human
ggggcataatgatttaggtttggagattatttaggtttggatactgaacctgcatccctactgctcttttgaattctggtcacttaggagaactgagtcccatcaaggatttagggtttggctgatattttgagctccttcaccctgtcttggcacagccctttacagtccctgcttgattctcctctctccattgtttttgtggcaattacacaaacatgaaacaggggtgggagcagagaaagagagcccaggattaggagccagaaattgtagcttctggtgaggaactggcttctaaaccttgaattttactctctggacagcccctgacttgtggcaatgccaatctgtgcctcagttttctctttggaaaacctctgccttctttcccgactttttggaaagatgagaatttgaaggggtctgtgcctctacctacctagaaacaagtgagtaaaagccaatttagctactgaacttaataagtagactctggattccaaactctttgtaattctttgtttcactggtgctagtctcttttctccagttgctctgtaatgtgttggagagcaaagactttacccttttctgtttactgccttcatcctgaacaaccagcaatgtgctcatgcttaatatcttattcagcatacaactgcagatgaattaactaagcccagatggcacgcttattataagaaagttctgtgcataagctgttccttggggtgatctccagcactaccagggttccaggcatgaaaggaggcatcttcaactcccattgattactaatgaaagtagaagaggtatggtggcctgtgggacctgtgtcccttgctgctcagagactcgcttgggctcatgacggtttctatgttgctcagcggacagtcttctcctgcttctcattcccttcaatatgcctttgataaatgttagttgaatgaatgagtgtctgataccagaaacatcgtctctgaaattgaagcttcactgtgagatctagaactcttcagagaatgaacagaatgaacaatctcagcaggttagagatgctaagagatgcgtctcctaggagaagccggctcttcaggcgtgttcatctctatgcccagtgtgtaggaccagagcctcaatgcctggtgggttagagctgagtcccagtttccctagagcttcctggagagtataaaaaaacaggagcaagcctttctgaagtgcagcatttgggtggcagtttggagagcccaaccgaggactgcctaatagtgaaggtggacccctgaacttgaggaccccagaatctctggctcgggtgtgtcttccagggctgagaaggcttaggagcagctggagacaacagctgtccatttggaaaggggaaagcttgagcatttgaaagcattatccctttctacctccccaaacttttctaatgaatgtgtaggaaaggagaaccctctcaatcctcccagccccttatcaggacttcaagaaagatccagtcctcagccaacctgcagtgttttagtttttatcacacaaaggtttaaataaaaggaattagaattttctgattttagccaacccactggcaaattttaggaacctgaccctctatcacaaaacactacctcccaggaccatttcaagcaaaagacctcacccaaataaccccccattattgcagagccagcccccaagctggaaaaggagctcctagaaggaacttcccttcccagccttcccagctggagtctcatccttctgaggagggtcagcctggagcatgcatcaggacggtgaggagcctgggggaagtgggaagacagggaggacaacagagacaggggaagacctcagggctttgcttccatcaactgtttcatctgctattggccaatgttctggggaagctttttccagtccctcccttcctgccctgtcctgcttcccttagatcaggagagttggcgcgtatgggcaaggaacaaagactcacccgtgagccagctctcaaagaaagcagcttgcgttgacagcctgggggcagcaaggatgcagtctcccaggagaggatgcactcggtggtgggaagccaggctggaggggcctgagtgaccctctccacaggcgggcagggcagtgggagaggtggtgtgtggatacctctgtctcacgcccagggatcagcagcatgaaccagcttggggggctctttgtgaatggccggcccctgcctctggatacccggcagcagattgtgcggctagcagtcagtggaatgcggccctgtgacatctcacggatccttaaggtaatgggccagcacctttacccagtgatggggacaggaagcagggagaaagggctcctctgaaggcaagagcctggggctgttgcaggctctgagggcttctgggacttgggtcacttcctgggagatcctctcggaggttgaaaaggggagcctcaggccctcaaagctgaggctggactcccgacttcatggcctggtccagtaagtcttggctttgtcttatagcctcctcctgtcccagggacactctccttccttctgcccatcatgcctcacctgtccctgcttctcacctgactcaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtaagtacccttccctccccacactggggctggaaaagaggctttctgggggagacaaagaacctttcttatttggcaatgtgggcatcccaagctggtgacagggctcctgggcaattctgacccataagtttttcttttgaaaagtggtggtaataagaggattgggaaggagaaagcatagagagagagagaggaggctgcccttgggaacaatgtgtaggtggagacagatgggaaaaaggatattaagggcaacatcctcagggtatagccctgagtctgagcaccatctctccactcaacaccctgacactcccaggtctcctccatcaaccgagtcctgcgggcattacaggaggaccagggactaccgtgcacacggctcaggtcaccaggtgggtcttggagttgtccccagggctaatcacagccaaatctctagcattttatagttctcaaagccctttctcgttctttcttggatcaccctcacaacaacccaataaggaggactgggcagggagtctcattctctcccagcagaagaaaattgaggtccagaaaagtgaagtgacttacccaaggtcaccacctagttgatggcaggccctggaacagaacacaggtcccctagcccctgggttcacaggatctattgaagaagaggcaggactgcatctcataccctccctctgccccatgcatagcttcttagagcatcattcatgttctttgggataacacacccctggaccaagcctactgcttgtccctccaaactcttgcacattaagcatgcaccccaccatggtattgagcaccctttccaccaagtgaccctgcagtgacctctaataactatgaatgccccaccagcttggctctgctcttctacccatggtgtctcccggctgcagccccagagactcagggaccccatctgaccagaggaatcaccatcacaaaccaccacaaactgttatcttccttttcagctgttttggctccagctgtcctcactccccatagtggctctgagactccccggggtacccacccagggaccggccaccggaatcggactatcttctccccaagccaagcagaggcactggagaaaggtgctgggctgggacagatggagggtcagagagtcctcagtgtgacacagggacagtggccctgaggcctgtgggcaaaggctgagaggtgcaggctgtgagtggccctgccttgaggaggaaggtagtttggggttgtagcaggtggggagtgttgcctaaggggagacccatgccttgctcctctcccggtgcccttactttgtgagactcgatctccgcagagttccagcgtgggcagtatcctgattcagtggcccgtggaaagctggctactgccacctctctgcctgaggacacggtgagggtgagtgagctctgcaacactgtacaaaccacaaggaggaagagtctgggccggccagggctttgggttccaatgaggtggagaggggaggtgagaaattggaagcaaatttgtttggagcaacaatcagagatgagatcctccttgttcaccttctgctgactgctctcctctcttccccaacccaaacctttgagttgaggaaggggccagagagcaaaagctagagcagggagggaggatgtcaggcccaaggaagggtcaacattctgagttcaggctaggaacatgtggtgagatcagcaggtgacaggcagcataaagtacagccagctgcattgtccctgtcctcgctcaggtctggttttccaacagaagagccaaatggcgtcggcaagagaagctcaagtgggaaatgcagctgccaggtgatttctctgcaccatcatccatctgcccgctcagtcatctatccatccatccatccatccatccatccatccatccatccatcctccattcgtccatccatttatccatccacccatgtatccatccatccattcatccattcatctatccatccatccattcatccatgcatcatccacccaccacacccacccatccacccagctacccatttatccacccatctatccatgcatcaatccatccatcctccattcatccatccatttatccatccacccatgtatccatccatccattcatccattcatctatccatccatccattcatccatgcatcatccacccaccacacccacccatccacccagctacccatttatccacccatctatccatgcatccatctctccatccatccatttatccatccacccatctatccatccatccagccagccagtcacccacccatctgctcacccacctatctacctatccatttatccatccatccatccatccatccatccatccatccatccatccacccattcattcatgcatccatccatgcatctgctcatgcattcatccatccatccacccatgcatccgcccatgcatccatccagccacccatgcacccatgcatccatccatccatccatctttccattaatctgtgcatccatccacccatccatccaatatttactcagcatctccccagtgccagaccctgtgctagatgctgggcacacacagtcccggatcttaaggctgcactgtccccagtaccatcactggaatttaatcattcttctccagtttcccaaggacctgtcttggggaagaggacagttttgggttaaaatatccatctcttcacacccctgcaagaagtggctgactttcctagaacctctttgtatccaaccttcctgcctctcaccacactcctcccgtccctaaccccaattcctccttctgagtggattcactctcattttataggtgcttcccaggggctgactgtaccaagggttgccccaggaatcatctctgcacaggtactcgggaggagaggggagtctgtgccctgggaagactgaagggctcatgggctcttccatttctggcctgagccaggatctccggctctccagggccccacagtgttcatgtcaagaaagtactaacccaaagtctactatgtgaatggtgccctctggagttgtgcaggatactacttgggtggcaggcagctctggggtcccggcgttctctacaggaggcatcactggaagctaaggttcttctcttgctttttttttttagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctggggtaagaattcaggccaggcctcagtcctgcaggatgtagggagggtcgactgactcaacctccaggagggcatggatctccattgggggtcatcaaaggaatctcaatacagctttcctcattctttgcatggtccacaaaattacggagactagtaacccctgagtctatggtatcactgacagccatagcaggtaaaggatgtgagactgggattcaagtgtgtatatgcagggtgggaaactgatgtctcagcctctctcccatagtgactttgagaggtggggtgggagcaataaccccaagctctctctatttgtccccacaggccacttgcccccacagccgaattccctggactcaggactgctttgccttccttgcccttcctcccactgtcccctggccagtcttagtggctctcaggccctgctctggcctggctgcccactactgtatggcttggaatgaggcaggagtgggaaggagatggcatagagaagatctaataccatcctgcccattgtccttaccgtcctgcccatacagactgtggctccttcctccttcctgtgattgctccctcctgtgtggacgttgcctggccctgcctcgatgcctctctggcgcatcacctgattggaggggctggtaaagcaacacccacccacttctcacactggccttaagaggcctccactcagcagtaataaaagctgtttttattagcagtagttctgttgtccatcatgttttccctatgagcacccctatgcccactctaatattcaacaattatagacaatttgccctatcatttatttacatctatgtatctaccatctaatctatgcatgtatgtaggcaatacatgtatctaaacaatgtatttgtcaatgcatcaatttacctactctatgtatgcatctatatgtgtattatgtatgtatgcgtgcatgcgtgcgcgcacacacacacacacacacacacacactgatattatatcatggcattttattcctaaatcttccagcatgcatccccaaaaaacaagaaacttgtcttacataatcacaataatatatccacatctaagaaaatttactgtaacttcttaatctaagaaaattatgtatttttgtcatatgtattttgtcatatgtattttgtatttgcatatgtattttgtatttgcatatgtatttttgtcatagcagcaaacagagtgaaatgccatttttcatattctgctttccatttatatgtgctttatttatacatgctccaggggcatgtttgcttggtccttttggcagtaagttccaaaccttctcaattctgtcccttcaaataaaggtctaggcccttcctgagaagtctcaggatgtggagaaagggaggaatatgggggaaaggcggtgaagaatcggatattcagcaaggaggataggctcatccttccaaattctttcccttttgaaagtcaggcgatggataatgatggtgcaatgctggtcggcgggcggggaggtgggggcattgtttactcctatctgggataggtactgatccagaagacgtcattcaagaggcctcttcattatcaaatactgtgctgtgctgaactgtgctgttaaataagtagccaccaaccacatgtgactatttaaatgtaattcacattaaaaaaaaaagaagaatgcagttcttcactcacattagccacatttcaaatgctcagtagttacatgtggcttgtaaggactatcgagcatttcagtcattgcagaaagttctatgggactgcacagctctagaatgaaatttcaagggtaatagagcacatcttgcccctgccttgccttctatactttcaagctggaggtcctgctaggcagaacagaaaggagctgtctcagctgaggcctcatggttgtggtggtagtggcaacccatcttgagctgctgctgtgaagatgctggctgcagatggggaggcatggctggggttgtgtgctctgcaaggacagcgggaacccggaacaggcaggagccacgcccccaacagagttggcagggtgggagcgcggtgctcctggacacagctgcagctgcctagctgtggctccagacccaggcatccctgcactctcaggggcacaggaagcccctgccccacaggcttagaagtgcctgctcccactccctggcttctccttgcccccagagtccactcggttgtggaataaagttgtggctgcacctgggcactgtcatgacctggctgggtgtgtgcatgctctgggtggcactgacacaccagcccccctaccaccttggccccctccagactttgggtgccaacaagtgcaggagaaaggccagagggaggggactgagggcatcttagtgtgggcctgcaggcacccctcagcacaaacagcctgggtgtcatggatagcatgttgatagtgggaggcagacaggttcctgggcagaaaggggcaattctgcagagaaaccccacctttaagccaagaatggcctgaagcctgggggccaggctgccagttctgggtgaagtaggaggcccagagtgaggacttcattgttgaccctttggccaatcggatggtgctttttccagacctacccatggccacttatggaccagttagcacacactcctcccttctgagcccataaaaaccccaggactcagccagagtcacacagacattgggactaccagctaagggaaggagctacccacctcaggtgtcctcgactagttgaaatgacctgccggcagaaaggacctacctacttccggtcttctgagagctgttctgttgctcaatgaagctcctctctgccttgctcaccctgcagttgtccacatacctcattcttcctggacatgggacaaaaactccagatccaccaaatggtgggactgaaagagctgtaacaccaacagaactgaaacactcgcacacacacactcaccatgttgtgggtgatgagaaagagagaagagctgtggccgttcagggaccccagacataggggttccccgagccagggctgtgataccctctttggggccctgtggttcctggcatctccaaatttccaggcaccacttcattccccagcacctgcagtggaagcttcttgcggtcctgctgaagccttgcacagagccggcatctgtaccagcacctggagctgcctgccccccacagc

SEQ ID NO: 12572 - DNA, 53806 bp, Human
ctcatagatgcccagaaatggctggtgtcctgtcatcagcagggacttaagcatcagcccattaagacgccatttcctaccatcagtgctgtgctccagggagacggtagaaaacaggtcatttatcttagaaccaggcagcgggaaaaattcccaaacagaactcaggtgaaggtggtaagtttggagaatcccaggcagaccagcaaaccaagctaaacaaataattgtgttattaaaagcatcttgctgtattgtcaatgtgggatgcacaacatatttgacaattttaattatggaggaaataattttaacttttgtaactacttcactacaactttacctttccctccactgacatggatggaaaatggcaaaacacacagctctggaaaagggggaagggggcaggggagcaggtcatcgtggtggtgctgcggggtgtggtggatggagtctggggttctagacttaggaaggaaattaactgcccagctcacggtagtagactcaggaagaaaatgggcaaaattcttcctttttagggccttggcttgctacgagagtaaatattaatgatttaaaaagtgattgaggatgttcaattgtaaagggaaaaaaggaccattaaatactcaaatctttacatttgaaatgtcaaatctttctttttgggcttataaataactcataataacccacaacaaaccatataaaaagccttttagttgcatttctcctttttcatttaagtgttttgaaatgcttcagagaatgtgcgatatccttatcaacatgataaaatatgaaactgtgattgcctgcagcattttacagacatgaattccatcttcactgatgaggcttgataaggcgctgttgtataatacagtgcataatctcaaaccaccagagtaaggattaatttattttgaaaaaaaagaatgcttgctgacaacctctcctccagctgccatgctgggtaaaaatattgtacatttgttgtttataaatttggataaaagaggaatgatgtttacttcagatggaatatctttagacttgtatctgtgtgagagtttttcttttcctaagtagattttcatacctgaggggggaaacagcttaccttttagagaagaggatttctgagagtccaccgaacacacatgggcatgtcattagccaacctggcaaaacagaggctttaaaacaataccaccatagcttttttttttttttaaatactgtttccttttgtttttcctaacctgaatttgatatgcctcaagcctggaaaatcctcttcccttagggtctggtcatctctgtggggttcttaggtcatagaggtagaaaaggtgctttgcatgccaactctgcagtgaattagaagacagggagttctccaggaactgtgatcacagaagaagaaacaatggctgccacatgctcatctaggagctgtatctaggctgggcagggaatctagacaagagttctcagcagcctggcagcccaggcctgaaagagggcattttggatggacttgcagaggaagttgcaaatagatgtgagggaggcaggaggcaccttatgacccaccctgacattggtgtaggaggtccgggtctgggggcagcatggcggcagagggtggttggtgctgcaggcacggggagcctgctcaccctcacctcctctccagaaaggcctgccccatcacttccactcagtgttccccaactcacgaggctggcacctccctcttcctgactgacataaaaatatgtagcgacaagctgtctgccacagcagaaatctgatcagacattgatttcagcaattgccactataggccaagacataaggcaaatttgtttctgagtacggttattgctgctgcaggtctgaggcaggaagggccagcagcatgtggaaggtgggagcaacatcccaaataggagcctcagccacagataattggaatacagattttaacagtgtgtgctgctctgcggctcatgcattttcattctggaagatcctatttggagggaaattctggccttcactttccaagggttacagtagctggctgtcaggcgtgtatggaaaaagggtgggcaactgcttctctatggaaatgatgattaagccggggtgaagtttagacttcatggagccctgggtttcgctgaggcattgcattgagcttctccactgctcccttctgaagagatttctttttgagtcactttagttttaccagcagatcaaaggccgagctcgatgccagcatgggcctcgctgaagcccttcttcggcgtgttgatttattgccaagactttacttgatgggatggatttgttttacatgcatttaatcccactttaacacatgctgccaactcctgccacagtgggtttagaaaatacattttgctaatgcatctctgctctcatgttgtcatccgggtgttttaaattggggagtagaattaatatgtagacgtgcacccgttgaactgtgtttctcctttcaggctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaattttgatgcagtttcttacttcactatttgagccagccaagtgcagacagaggagaaagtgcacccagcaccaagcctgggagtgtaacagcctcctgtcagagaccactctgagatgacggtgaggctgggagggaaggaacagctgctgttgagtgtgcaggcaccgtgccacctactgaaccattgttaggagtcctcacttgatcctgatgtgctcagtaacaccgcaaggaaaactccccattttcatagattaggaaactgaagctcagaaaacttaagtgaatgccaaaaggtcacagacctaggacagcaaggggtcacaccttgaacccaggtctttctgccctcagctcacactctcctgacctagtgatgcctttggcacttgttagatggattttttttttttttttcttgagatgcagtctcactcactgcagcgtaaaactcctgggctcaagcggtcttcctgcctcagcttcctgagtggctaggactacaggtgtacaccaccatgcctggctaatttttcttttttgtagagacgtggcttgctatgttgcctaggctggtctgaaactcctggcctcaggcaatcctccgaccttggcctcctggagctctgggattacaggtgtgagccactggacctgattgaaaagatttttttttaagttcacttatttttcttttttagagatggattctgactgtgttgtccaggctggtcttgaacttctgggctcgagcaattctcctgccttggcttcccaaagtgttgggattaccggtgtgagccactgcgtctggcatacatttgcttcttcacctttaacttctttacagttaaagactaacaaaagtttggaaagaatggacctcagatgccgttgaaaaaacaatccctgcaatattcaacatacctttttaaactctaaatttgtaatcttctaagaccaattaaaaatcttttaactggatttaacatgttttcttcaaattgttagaaattccatatgtttacatatacatctgtcgctaatatctaaatctttataataaaagaggtcaatggcaggtaattggcctgtttactatatctcaaggaaactgacccacaggaaatcagattaatgttaattagttgcagcaaattgtctatgatagatataactgtttgactctttcagttggtaaagccaggcaaaacaaggtctagggccaccattcccattaatctccaggcagttacactgtgagggtaaactttataaaatagattgccctccaaagccgtcctccctcacttggtgctcagcctgcctgtaggaattgctcccatggctaaatagttatttgcatgattcaattagcttgtgggtcagcctttctcatctttgtaaataaaacaatatatgctatgtggttttgcaaaaatatactgtgggaacataatacatatgcacacccagattcatctttaacattccaaagcagacacttcctcagaaccgccttgagtctcaccttggaccagtgtgtggagagaagcacacgccagtgcttataggagattcacacgttgactagcaacccctgagggaattgtgggtgtctctgttatcctagggaggccgaaatgaaaatagcaatgctcttcctacgtgctgtgttaggaagcatgtgcacgttttctctcttcactcctcaccacctctctgggagggtagaagcatcctcacttcataggtgaggaaactgggccatcacacaggctctctggcccagcctctggtgtcccctggggtttgtaaagctctccagacattgagactgtgcaggcatgtctcactccaaattgggtgaaatcagtcattgattttaatagattttcaccaggtaccttttctgcatcaagcagtgggttagaggctagactcagagatgagtaaaaccagaccccaccccctgacctagcccttcttgctcaagaagccaacacttactgagagcatcggaaagcctggtgggcttctgagccctgggactggagaagtgggggtccaaaaacccattacaagatcagagaataacaacaggaaacttccagaaatacccagtcacaggcgaaggggcctgttcacataccgctcgatgcacaagaacccatgtccttacttgagagtccatgtgtgttcacaagcatgtggagcccaagggcctgtgcagctgtccatgtggggatgggtgtcaggcttctgtttgcggtgcacgggtggtgtgggagtctcttaaatctattggaccaggtggccttgcaaaccaagttagggctgttctgtagcccccaaaccaaacaatgtccgtgtgccattccctggccagaagtgggggtgggaggtggcagtattccagagaagtgaagaagtaacgttgggctgagtctcccaggtggggtgaaatgagtgctggtgccagaagaaagggtcctcccctgtgggccagccccccaccaagcacctcccacacagtatctcatttaatgccggtggagtcccacgaggggtgctattatctcattttcccatgggaatctggggctcaaagaagcgacaccacctgtccagagctggggtttgccctgtgaagtccccatgtgccacattcagcagccactagtatcagacaggctctggtgaacttgggccatcaggcctccagtatgaggtcccgtcttggggggaggtgaccagggaaatcgtccctgcttgtggctttcctgcccatgcctcagttgcctgggccacctgagtatgggtgtctggtgggggtggtgtgtgtgtatgtatgtgtgtgtgtgtgtgtgtgtgtgtgtgtgtgtgtgtgtgtgtggcatgtgtcacagactgtgtgtatgtgtgggggggtgctatctgtgtccacggatcatgggattggaggtgagaaacaggaagacccccttttctccggctgtgctgggctgggcctggcactaatgggggcaaacagagcacctccctgggagggcagctgtcacagtgaaggttctggagccagcagcatggatttgaatcctggctctgcctcctaccagctgaagttctgagtgcaggcctgggcacgttctccacgtgtactttatcatgggtagaattctgcctgggcttcagtgtgtatccacgtccccatgggtgtcttcccaagtcccaggctctgccccgctcagctctggccccagtctccttagctctcctggccagacaaccagctctgggtttgaacagatctcacccccaggttctggaacccaaaagatgtgtttttattttttttatttttttattttttattttttttgagacagagtcttgctcttgtctaggctggagtgcagtggtgcaatctcaactcattgcaacctccacctcccaggttcaagtgattctcctccctcagcctcctgagtagctgagactacaggctcctgccaccacacctggctaattttttgtatttttagtagagacagggtttcaccatgttggccaggctggtctcgaactcctgacctcaggcaatccaccctcctaggcctcccaaagtgctgagattataggcgtgagccaccacagccagcccagatgtggatttgaatcctagctttgcctcctaccagctgtgtactcttgggcaagagacttaaagaaggagcctgtcccctcattccctgttcttggaacgtccttctgcaccatctcccctgatgaatgcctgtccttcaaggccaaggccaatcccagatcactgtgccctccagcagagcccagacctgccattccccttgtgcagcactttttatccctactggacatcccagcagaggccctacagagttgggaaagggaggagctgggagggagggagcagggggcatggggaagggtacacgagagaagctacagaggcaggaggcaggagatgcttgctctttagctggtcccagactccctcttgaaatgctcacagcggcctcccatggaaggtgcaattatcatctccatttcacagacagggagactgaagccacttggccaaatacacacagagccagaatgtcagtctgaagcctaaactcacactctttttttttcttttgagatggagtttcgcttttgtttcctaggctggagtacaatggcgtgatctcagctcactgcaacctccacctcttgggttctagcgattctcctgcctcagcctcctgagtagttgggattacaggcacgtgccaccacatcgggctagtttttttttttttttttttttttttttttggtagaggcggggtttcaccatgttggtcaggctggtcttgaactcctgacctcaggtgatccacctgccttggcctcccaaagtgctgggattacaggcgtgaaccactgcgcgtggccaactcacattcttattcctttgtgccttgctatcttgtcagtgtctctttctcatcatgctgggtctgcaggttcactatgagccttaggcagggcagagcggagaaggggaagaatgccggtctcctcccaacaccccatcagagccattggcacctttccccagcagctgaggatcccagagacaccctcaggaaagctgctgtgtccacagatgcttctggccaacagtagacctgcaactggtccctgctgagcccggcaacccagcccgtggacaactagcacaaccactcccagcctgatgacttggctgtggcagactcagccatgtgcaggtggcctgcttccgtctgggcgccaccaaatgtactgccaggagccacacctcacggccaagtgggtacagccccttcacagagacaaagaatggatgcccgggggcagtgtgacctcacagctaggaagcactgtggcttaacgctgatgaatatgggctcttgagtgaaactacccagggttgaatccaggccctgcctcctgtcagctgtgtgtccttgggcaagtcacgtaacctccctgttcctcagtctcctcctctgtcaagcacctgcctcctggcatcgcagggtagatcacgcaagttggtccagataaagcccttcgaggctggctgctcttattctctatctacaacctgccctgtgggggtgatttgcactgggattccagcttgcacagatgccacatggcccttgcaagtctcaggtcacccactgtggataaaacccaggtcttctgacaccctggtggatgcatcttcctccaagcatgaagaacctgagcacagagtcaggccgagtcctgccactcacctgctgtgtgatcttggccatgggatttcttctctctgcagcctcagttttctcatctgtaaaatgagaactttgttctcacctaacttgtagggctgttgtaaagattgagtgagctgccgcacgcactggtgcctggccggggatggggtgcattttctcgttgttattgctacactgtgccccgggtcagaaggggatgcctgtctccagcccctccggctggaatgattacttctggtcagccacagggttaccagggcatgtcaatggccgagtgagggtcctggggatggtgcagcctcctcagcccacctactccagcctgccacccccaaccttcaaggctggcctgaggccgaggcctcacctctcaccgccatctcaggagataataaaagactgattcttttttcctggtaaaatttcagcagaaagtgtatgcatcattaaatatggaaatccagaattttattagcaatctgctagatctgaactgacgccaattaaacaaaaaagatatcatttataaaaaggcagagttcaacttgtattaaatatgaaatgcaattttctcctggttttgatttattactggtggtccattgttcaaagaagcatgttatatttcaatagagaaatattgtttattcattaatattttaaaactggcttattgctgtgcatggctctcactgaatgaaacttatgatttaaaacatgaattaataaacacatttgaaagtgttagacgagatcacaacctctcatttttcattttcctgggagcatattaaatttttataattctgcatctacagttttttcttttaaataaagatgcagattccgaattactctgctaatttcaggtaaccaggagcgaaaagcaatatcatagggactggtgtcagaatcacagaatccccaagaagatgctcaggtttatttttgtaatattcataaatcaaaataaatgagctttgtgcaggaggcagcgttcatgcgcgtgaggtgccggctggagtaggtctctgcatcggggctgtctatgtgtgcaggtgggtagggtgcattgacgctcacatgcacatgtgtgtgtgctcctgagtgctccacagaaacacacacgcatcaccccagctgcttgagagtgtgcaatctgaatgcgtctcagttttttggttcaatggtcaagcattatttattgagcacctactatgtgtcaagccatgctggttactgaggatgagcaggtgacagcaggatctccttgcccttctcccacacagctgctggagccacctctccttcaggaccttgggggctcttgagtttcccacagtcccttgaaacaccttaaacaatgccttctttctggtgagcaattgggaaatatttcttgctgagcgaatagactggaagcgtagggaagagagagatctttacaggctggaggtaaagaagagcttctgcaaacatgagttgaattagaccaggacaaaggcacagccggagctgggcatggtgcctcacatctgtaatcccagcattttgagagggcgaggtgggagatcttttgagcccaagagtttgagacgagcctgagcatcatggtaaaaccccatatttacaaaaaatacaaaaagtaaccagacatggtggtgcacgcctgtagtcccagctactcaggaggctgaagtgggaggatcacctgagcctgggaggtcaagactgaggtgagccaaaacagttggaagaaatggagtcaggagagaggggtgtgtcctgaggacagggaggaacttccatctgtggagtacccttcgcaccgacagctcacaccctgcgcagcccctgctgatcccaacttactgctgccttccaaactccctatgagacatgtgctgtcatgaacccattttacagtggaggcagcagaggcttgagagggtaaagattcgcacacaaggtctcagagtcagtaagtagcttgcctttgggtctaggtctggggtccatgctgtctctaaataggccaggcccagaaagacagtgtgcaaaataggccagtggggttgtgttgtcccaagttatgtggggaggcaggggtttgcaggagtcttggggaaggggacttggacatggcctggggacagtagaggcccaggaaagtcaccagcgcccccaggaatagtgctgccctgctccccccgtcacacacacacatgcaagcgtttctctagagtggaattgctggccttgtgtaggcacccctcttcagccttactaagggacaccaaattgttttccaaagtggttgtaccagtttacacttctgcaggggaacggcatggcctgggtgggggacactggaggaggtattttcaattttcttcccacctggtggttagataatgatatatcaatgtgattgtaatttgaatttgtatgattattaaagaggttgagcatcttttcacatgtttattcattatttgcattttctcttcttttaagtgcatgttggagccatttacccattttttcttacatcttttgtctttttcttatcgatttgtaaaaatttatttatttatttgtttgtttgtttgagacagagtctcgatctgtgtcgcccaggctggagtgcagtggtgtgatctcggctcactgcaacctccgcctcccgggttcaagtgattctcatgcctcagcctcctgagtatctgggattacaggcatacaccagcacgcccagctaatttttgtatttttagtaaagacgggtttttaccatgttggccagtctggtctcaaactcctggttttaagtgatctgcctgccttggcctcccaaagcactgggattacaggtgttgagccaccgttcccagccaatgtctaggatgttttaatgaacagttcagtacttaattttaaagaaagcaattttggctggctgtggtggctcatgcctgtaatcccagcactttgggaggccgaggctggtggattgcctgaggtcaggggttcgagaccagcttggtcaacatggtgaaaccctggctctactaaaaatgcaaaaattagccaggtatggtagcacatgcctgtaatcccatctattcgggaggctgaggcaggagaatcacttgaaccctggaggaagaggttgcagtgagctgagatcacgctgccgcactccagcctgggcaacagagcaagatgccatctcaaaaataaaataaaataaaataaaataaacaatttttaagttcctttatagttactcctttttgcatatggtttgaggtaggggtctgattgtcccacacaatttattggaaagttcatctttgccccactggtctgcagtagcatctccatcatgcgtcaagtgtctccatgtgttgatctgctcctgggctgtcctggctgttgaactgtgtgtctatctctgagccagtgtggtaacactggcttcactctcagagttttataattagtcttgatacctgatacagcaagctctctcactttgttctttaagaatacattggccattcttagccctttgcgtttctgtagaaattttagaattagcttgtcaagtttcatttttaaaaatcgttggaattttaattgagatcacattgaataaatagatgaagggaggggaattgacatcttcaaaatattgagtcttttaatccatgaacaagacatctatcttcatttatttagatcttttaaaatgtcttacaataaaattttataattttctccatcaaaatcctcaggctccttacaccctggtaccaggcccctccataataaaactccaaatttctctttgtctaaactttctctgtttgggccatgtccaggggtctggcctttctcaacatgaagtcccatccaaagtgtggcaccactctctgagaagcaagatcctctctcttggactatgaagtcagacaactctccccttctgcttccccactccctgtctccttcttccctcccttcctttctttttccctcccttcttctccttcctccctctccttccctcctttctgtctctcctttcttcctccctccctcccttctttcctctctctcctttattcctcccttccttcctccctctctccctccctcccttccttctgttcttttttgttattaattaataaacttgattttttaaagcagtactgagtggaaagtgcagagttcctacacacccctgtcccccctaacacacaacctccacaacatcccccacaacagaggtacttctgttacaatcaatgaaactatgtcgacatgtcagtatcatccaaaatctggagattacattagggtttgctttggtggtgtacattctatgaattttgacaaatgtacaatgacatgtatccaccatcgtagtatcatacagaatggttccaatgccctaaaaatcctctgcacgctgccttttatctttccctccccctaacccctgtcaaccactgatccttttattgtctccttagctttgccttttctagcatgttatatagttggaatcagatagtatgcagccttttcagactggcttatttcacttagcaaaatgcatgtaagttccctccatgtcttttcatggcttgctggcacattcctttttattgctgagtaacattccattgtctggatgtgtcacagtttatttactcacctactgaaagacatcttagtgccttccaagttttggcaattataaataaagctactgtacacatttgtgtgaggtttttttgtggacctaagtttttagttcatgtgggaaaatacagaagagtataactgctggattgtatggtaagaatatgtttagtttttttaaaaactgccaaactatcttccaaagtcactgtagcattttgcattccctccaacaatgaatatgagttcctgttgctccacatcctctccagcatctggcattgtcagtgtttgagattctggccattctagcaggtgtgttgtggtattgcattgttgttttaattttcagttatctagtgacgtatgatgttcttttcatttgcttatttgccatctgtacatcttctttggtaaagcgtccaactcttttgccatttattttatttttttttaagacagagtctctctctgtcatccaggctggagtgcagtggcccaatcttggcttactgcaacctctgcctcccagactcaagccatcctcccacctcagcctcctgagtagcttgggactacaagtgtgcaccaccacgcctggctaatttctgtatttttttgtagagacaatgtttcaccatttttcccaggcttgtctcaaactcctgagttcaagggatccacctgcctcagcctcccaaagtgctggaattacaggaagtgagccaccatgaccagccttgcccatttttaaattgggttgtttgttttcttcttgatgaattttaattctttgtatattctggataacagtcttttatcagatgtgtcttttgcaaatattttttctgagtctatggcttgtcttctcattctcttgacattgtcttttggagaccagaagttttaaattttaataaagtccagcttatgaattctctatttcatggattgtgcctttggggttgaatctaaaaattcatcaccatactcaaggtcatttacgttttctcttatttttttctaagagtttaataagttttgcactgtatactttatagagtctataattgattttgagttaatttttgaaaagggggtaagctttgtgcctacatcatatttttgtatatggatgaccagttattccagcactatttttgaaaagactatctttgtttcataacctttgctcttctgtcagcttacgatacttatgtgggtctgtttctggtttctctattctgttccactgatctatttttctattctttcaccaataccatactatcttaattaccttagctttgcagtaagtcttgaagttgggtagtgtcagtctgactttgttcttctccttcaacatgaaccaactattctgggtcttttacctctccatataaattttagaatcattttgtctatgtctacaaaataacttgctgggattttgactgggttgtgttgaatatataaatcaagttgagaagaattgacatctagacaatattgactcttcctatccatgaacatgaactatctctccatgtattttactctactttgttatcttttgtcagagttttgcagttttccttatatagctcttgtacacattttgttatatttatacctaagtagttttgagtgctaatgtaaatggtaatgtgttttttattttaaattccacttgttcattgccaatatatagggaaacagttggcttttatttatttatttatttttaaaatattcttatttatttatttatttattattatactttaagttttagggtacatgtgcacaacgtgcaggtttgttacatatgtatacatgtgccatgttggtgtgctgcacccattaactcgtcatttaacattaggtatatctcctaatgctatccctccccactacccccaccccacaacaggccccagtgtatgaggttccccttcctgtgttcatgtgttctcattaacagttggcttttaaatattaatcttgtatactgcagccttgctgcaatcacttgttagttcctttagtttttttaattcactcagtttttctacctagataattatgttatctgcaatgacagttttatttcttccttcccaatctcaatatgttttatttccttttcttgtcttattgcattagctagaattgccagtacaatattgaaaagcagtggtgagagaagatatctttcttttgtttctgatcttagtgggcgagcttctagttctcatcactaagtatgatgatgatgttagttgtaggttttttgtagatattctgtatcaaactgatgaagctcccctcaattcctgtttactgagaggtgttctgttttgttttgccttaatagtgaatgggtgttggactttgttaggtgctttttctgcacctactgatgtgatcacatgatttttctttagtctgttgatgtaatagattacattaattgatttccaaatgttgaacaaaccttgcatacctgggaaaattcccacttggtggtagtgcataattctttttatacattgttgattccaatttgctagtattttttgaagatgtctgcatttacattcatgagaaatattttctgtagttatcttttcttgtaatgactttggttttgatattaggataatactggcctcataggataagttagaatatagtcactgtacttctatcttctggaaaagattgtagagagttggtataatttccttcttaaatgtttggtaacattttccatctgctttctgttttggaaggttattaattgttgattcaatttctttaatagatatagacctattccgatgtctatttcttcttgtgtgaattttggcagatttcatttttcaggaaattggcccatttcatctaggttacatttgtgtgcatagacttgttcataatatttctctattcttttagtgtccatgggatctgtagtgatgtttcctttctcactgtcatgaggatagcatgggggaacttcccccttaatttaattacctcccaccacgtccctcctatgacatgtggggattgtgggaactacagttcaagatgagatttggttgaggacacagccaaaccatatcaagcggtccttgttaagaagaaaaaaaatgggccgggcatggtggctcacgcctgtaatcccagcactttgggaggtcgaggccagtggatcatgaggtcaggtgttcaagaacagcctagccaacatggtgaaaccccgtctctactaaaaatacaaaaattatccaggcatggtggcaggtgcctgtaatcccagctactcgggaggcagaggcaggagaattgcttgaacccaggaagtggaggttgcagtgagctgagatcatgccactgcactccagcctaggtgacaaaggaagactccatctaagaagaaaaaaaaaaaaggaagaagaaaagaatgatctggtgtattttaaaatgggttgtttccccctccctcactggaagcatgaggggattcttctccaatatttactgtgagaatcttgtacagctctagaggaaaaactcacaaaaatgtgtgtgcctctcatgattgggtcccctggagttttcaactctcagacttgtccatcttgacctcctagtaagttatttcttacatttaaggttttcctaccctggtgctggttcttgcggatgtttctgctcatggttttctgctccagtaagttgtgattctctgaatctgccctgtctgtctctttaattttgggacagctgtttgttttgtgaccttacttctctggcaaatctaagaagagttgttgatttttcagtgtgttcagcattttacctgttgtaaggatagagtgtcaacttctacacttcttacatgctggaccagaaacttgaagtccctcctatctttcttacctcccattacacatacacaattatatatatgacacacacacacacacatacatatatatgtcactattttatacagttttcaaccttccttttttttttaagaaatacatcctgaatgtcccttttttttttttttttttgagatggagtcttgctctatttcccaggctggagtgcagtgacgcgatcttggctcactgcaacctccacctccctggttcaagcaattcccctgcctcagcctcccgagtagctgggattacaggcacacactaccacgcctggctaatttttttgtatttttagtagagatggggtttcaccatgttggccagactggtcttgaactcctgaccttaggcaatgtgcccacctcggcctcccaaagtgctgggattacaggcacgagccatcactcccggctgtcttttcacatttctacccaggtacttactgcagtctttggtattgactttatggtgctctgtggtagacatgtgtcctcatgtcactattctcccactggtggacacttatgttgacagcttatcgctctggcccacagtgcttcataaatatcttgaacatcaatcactgaggacacatctgaacatttctagaggacaaatttgtaaaaatggagttgctcagtcaagggggtgatggggtttggctgcatccccacccaaatctcatcttgaattgtattccccataatccccatttgtcaagggagggacccagtgggaggtgattgaatcacgggggcagtttccctcatgctgttttcatgatagtgagtgagtgctcacgagacctgatggttttacaagtgtttgacgattcctccttcacacacactctcttccgccgccttgtgaagaaggtgcttacttccctttcaccatctgccatgattgtaagtttcctgagggctccttagtcatgtggaactgtgagtcaattaaacctcttcccttataaattacccagtcttgggcagttctttatagcaatatgaaaatggactaatacagagggtgtatgcattaaaatttttgaaaaacccaaatctcccctaaaaggctgttccagtctgtattgtgtgtttttccacaccctggctgttcagcatggcagagtatgggtggaggcaaagctgttagagctgtgagccccacactgtcctcgtgggctcagttcagagcacttctacatcactggagcacattttgcccaaattatcaaacatcaattgctgggtctttcttggcctcaacctgagtgggatgagaatatctctcttgatgctgatttgcaggaagattctgggaaattttctatgatgataataagaagaggaatagcagccactagtgacccatgatgatttcttgtgaccaggtcctaggctaagcccttgttgaatatcatcttcttcagatttagttgccctattttacaaatgggaaaaccgtgctcagagaagggagcttcttgcctaagtgcccagagccaggatcagtcctgctgtgctgactccacgcttgtgagcttgaccacacactatcacatctctgagcctcagttatggcaggggccaaggatgccgaacctgccctcctcccacggggatgaggaccaagggagccagggtctttggaactctaagatgtgtgtgactgtatccagggtcagtgtcatggactggtctgaggcaagtgttcaagctcagcctggagtttcccggcttcacctacacaatgcctagagtgggtggtccagggctcagaaaacactggctgtgtaaaggggcaattctattgcaagcttgtggggcccatcccaggaagccaggctgcccctcacatcactgcagtctgagacaggtgtgtcaagccgggtgacggtggtggtgaatgaatgggaggggcttggcctctggagtccagcctccactgcagtaatctgggcatgtgtcctctctcggagcctcagcttccctctctgtaaaatgggttcatccctcctagggctgagtgaggactgaacaaggtcttgcttacacatcatgaaactcaccctcttatatacggtaggtgcttattaatgagcactactgagtcagggtgtctggggcacccaagccaggaacctcctttggggaagcaccaccaggagctgtttaacccacgtttattgtccaaatgaacagatgagccaactgctattcgggaggccacaggctgcccctgagcccccagtccccaccatgcttagcaggcttctcccctcccactgcatctgtctggtcccctggcgtctgctcaactccaaacagttgcttaatttgtgcattataaaaaaatgagagtttcaaagcactcggcgatgtataacaataaataaggactcccacaatattgcctccttaaccctggcggccacagaagcagcacagatgtctggcaccctgacaatacctggcccctgccactgtggggaatgagtctcagaaggtcatcattaggcctgtgagcacactatgttacgtgtcacatgcatgtccctgtgtgcactgtggacttctgtgtgtttctgagcagtgtcatgtgggcctgtgacacaatgttgtgcaggtgtgaatgcaagggggtggcccactgtgtgagacatgtcttgtctgcgtgtggtcatgttacgtggtgtgtgtgtcttttactattctaaattaaatggagtctgggctgggcgcggtggctcacgcttgtaatcccagcactttgggaggctgaggcaggcggattgtctgagctcaggagttcgagaccagcctgggcaacatggtgaaaccctgtctcaaaaaattagccagacatggtggcgggcacctgtaatcccagctacttgggaggctgaggcaggagaatcaattgaaccagggaggcggaagttgcagtgagttgagatcgcgccactgcactcccgcctgggtgacagagcgaaactccaacccaaaaaaaaaaaaaaaaaggaatctgggcctggtccctggacatccacttcccagggattcagggcctccctccttccctccagagtcccaggtgggtgtgatgctccaggcacaggtctccttggttctctggcctgctgctgtgtggcatgacactgtccccaagcctgcaccctgtcatcaggtcaggctgttctaccacgggtcctggacatgcctcccactgggaagcccctccactggctccagagcctactacagggccctctctgcagcgctcaaggcagagactcaaggttccatcaccacagatgtccaggaacctgggagcagctcctgcttccccagagcacttccctccctcaggctccagctagtcttgagctgagctccaaactctctctcctccccagaggaagttcctgcttcatcccttgtttggcctgatgctccaacaaagagtagggaggaggtggggctcagggtagctctggaaatgccaagaaggtattgacttccccagggaggtgagacaaggcccctgcagtctgggcttagaatcaaaacttctggttgtcatgaagagggaacaattcaccttttttggtgtactgagttgggtactttcaagcaggttaccttatcaccatcatcatcaccaccatcaccacattgctaccaccaccaccaacatcaccaccatcatcaccaccactaccactcataccactgccaccaccaccatcaccaccaccaccatcaccaacaccaccaccaccaccatcaccgtcatcaccatcactatcattattctcactactatcatcatcatcaccatcctcactagcttcactatcatcttaatcatcatcaccatcattataattatcactgtaaccacaatcaccaccacaaccatcaccatcaccatcaccatccttaccctcgttatctttatagccatcagcagcagtagaatcgctatcagcatcatcaccatctccaccatcatcatcactgatttttttcaggcccctggttcactgtcggtctctcattgtggctcccccatcacaatgtaataaatactccagtgcccatgtgaactcccgttcaaaccggatccttagcagtctcagttctccaggtgttgtccatctctgcactcacccctgaaacttctccactactgagacctccacacctccctcctctgcctggcccctgacccccatcctcctctgccagtgagggttgaggttgaggagagcgaggagcgtctacttaacagctacatttctacccaaagcctgttccaggcaacctaggccttttctatcatgcgtctccagatttttttagcctctgttcactggtcaattccaaggccgcttgcacacttttaggcatttgctacagcggcgccctgcttccaggtacccaggcctgtgttggttttctattgctgccgaaagacattctgcctcccacagcttccctgctccgtcttccaccggcaggtccccgagcctggatggctcctgccgtctgtgttctccatgcctagctgctgggagcccaggaggctgcacccgcctctggtgtaaggccacagtctgagcccttagcatggtatctggagccagagatgtccccgggctcctctgctgcccagctgtgtgacctcaggccagacgtgtgcccctctgagcctcagcttccttatctgtgaaatgggaacaatgatgtcacccacacctgaggtgcaggtgtgagtgagcagagtcccatcaccctgttgagtggtgagtggcaggtgaaactcactccccagggacccctgccatgggccttccttctgcccaggtaggagggcggccctggaactaagccctcactctggtcagggaagctggctggtggggttcccgtggatcgggccgggaggaggattctgggtctggctctgtcctgcaggtggctccccgcagggcatcatgctacctgtggccctctcctgcctcggtgggagcagggcaggaagatcgccttccccctgagggccttgggagccatcgaatgtgtaggcaggagagtgccatggtcaggtgggctcggactgtcataagttggatgggccagagtgggtcagacttgagactgagtgactttcttggtcccggacagaaagggtgaggtataagttaggcggtggctacagggagggaggaatgggatggtggtgatataggggtttgggtctcggccttggctgcacactggaaccttctggcaattttttttttttgagacagagtttcacttttatcacccaggctggagtgaagtggcgccatctcggctcactgcaacatctgcctcctgggtttaagcgattctcctgcctcagccacccaagtagctgggattacaggcgtgcaccacggtgcccggctgatttttggatttttagtagagatggggtttcaccatgttggtcaggctggtctcaaattcctgacctcaggggatccacccacctcagcctctcaaaatgctaggattacaggcgtgagccacggtgcccagccccttctggcaattctgattcagttggttggggggcagcctgggcattggcaggtttgaaatctcccctgggggattctgacacagcttgaggtggcctagggcacaagctagagtcatgagaccctttgggtctgtgcaggaccccagtggagtcagactcaggcctgggggtccagcagtgttgctccctgccccctgcccaggctggggtggcttccagaacagggaggcagatggaaggtttgaaggggacagcagtaaggctgagaggcaggtacagggatgagatggagaagtggcagtgtggggctctgcaaacagtgtgggctctgtggctgctgccgtgggcaagggcaggctgctctaggcttttcagtggtgtgagaggctacagctgcgttgaagcctgaaccaggctcaagggcagggctgtctgctactgactgcctctgcccaaatctcctggggcagctttgcagggctctgtgtcggggggaaggagtggacatcccctatttgagtggggctgacacctctacccagggcaggtcctgcagctgatccccccacagtcttgcatgctgcagacaaagagaatttgctgggagacaatgtcaagtgtacagaatgttggggctgaggaccatctctctgtgctggaactcaggctggaggagaggctgggccttcgacggtgggagttttcaccctgagcccacagactttctcgacttcagatttacaaattgaaaatcattaataattctaaccaggcggtgataaatctgagatctctctcgatgaacccagacagcatttcataaatcaaaaagattacttaggaattttaaaaaatctgacgtcaaaatgtcatggttactaatggtttcggtagatctcgtgcggtgatatatcatttatctacgctacatctcagatgtgacacagggggcagaaatgggatgtcttttaatatcgtgaatacatttcagcccataataaaggtattaacaacttcttggtgcgatttcttccagagctgggggtctgatttaatgccattttgacagtggctccgcctcgtcactccccaaacttcccgaggccctgtgtggccctggaaaattctggagaggctgagatagggctgcagacccccattcccatgggggataggctgggttgctcaaatacagctcctgcccataggcggagaccctaagacacccctcacactccccgaaaacaggtcagaaatcacctaattataagtagcagtgatcataactcctattaattaagcacttaccatgtgcaggctatgtaacgcctgatgtgcattcgttcacagattcctccctgcttctcatttctttacaggcccaaagtccggggtgccctgcccacccccacctctctgtcctggtctccctagccagcctctccaggcacatgggtcctcttcctgctccttgaacccctgctggggcacgtctggcctcagggcctttgcacgggcttgccctctgtctggaacactcttccccaggtagccatgtggctccctcccccactgcttcaagtctttgcaggagtctcacctctcagaggaggcctgcccgggcaccttgttcaatcctgtagctgccccggcgtcctgctctcctgtccctcctgtccccgcatggcttgtctgacacctcctatgttcatgtggggtctctctctcctctgctagaaggtctgctcagggagggctgggagccttgtctgttctgctcgttgctgtgttgaaagcttctcaaactacccatggcaggcacttagtcaatgaacagttgaacagttgaaagtccatcttacagagaggaaactgaggctcagaatggggcagtcaccggtccaaagccacacagtgggagagaagcagagcaaggcttcccctcaggactgcatcccctgaaaggtggccccctcgctgcaccatggggtgccaagtccgggagggggtgctcagggaccgcccaggactgtgcagatccgggctgagggcagggagggcccctgttcagtgaccgttccgtgccccatcctgatgggtgttcaccagcccaggggcaccctagagggcagaggggtgacctcacctgctcagagtcaccaggctgtgattccaggtcaggagggacagacagaagggccctgcagtcagccctgtgctgtctggggcctggagcagagtcctatctgcctgcacctcccggggtggcccagcgcagggtgtgtggcagcccctggagcccccaaacccagtttccatcctggctctgccaccttctgctgtgtggcctcgggtggggcctgtttgtcttgccctgtactttctcccctgaggagcgggggtgggattcctctccgcccctcaggattgggaggggaggcaatgagatgaagcagtcagagccccccgcatcagtgagtgctcaaaacatagtccttgctcatgttttctccaactcccttgctgtgcagcagaacagcctaagcctgggcccagagagggacagcggctctcccgtggatgcccagcacatcctgggagcatccttgggggccccagtggtgcagtctctctccagatgccccaccccacccactgagttggaagtgaccctcagccccttgcacatgggtttggagaccctgcagctctctctgccttggctgccaacaactctcagtcaccacaggaaaaaccttggtgggctgatactcagaggggtccctgggagctggcacggcctggtcaggaggctagaggctggagcagggatgtccgggggcccctgggaagcaggtgggagtggaaagtcaagggccacgttgcaatccataggtgccaggctgccccgctgggtcatgcaccaccgttgtcagccgaggcctcctgaaatgccctccaccggcaacacccatgcgggcctagccctcagtccccccacagctgccagtgggatctctaggaaatgctggcctaaccttcactccctggctccaaagctttccatggctgctcgtgcctgtgggacaaaggcaggactccttagctgcctgcccctcagggttcgtttcctaccgcctggcctaccctccatgtggccttccagagctccaaccccaacgctccaggcaacataacccaccctgtggctgccctctctgcaaccaccctgacccatccccgcttcagttgatcaccctctgggatcctgggactagggatggtcgcggagcagggcgggcaccctggtagacatgccacatggcaggatcagctgggggaactcttctgggggctggcgacacagcagggaatgaagctgaccttctcgacagagcccgccaccctctgtccccgagcctttccttgcacctcctttcgtggttgtttgtttggggtcttgccccaccacctcccactaacttacaggcaccgagagggcggcagcctggggtggtcccaccacttgttcctggtgtctcccagacctggtgctaagtaggtgctcagcccttgggccagagggcctgggccttcatcctgtgcttcgctgttctcaaactccacatccgaaataaacctcttctcacctcctccctcttgatccaccctggatcaagccaggattgtcgcaaaagcttcccaagttcgtctacccaggtggccttcacccattcaccattctgcacccagctgccagggggctcctctccaaggcccgagccaggtcccgcccctccgtcacaccctgcaatgccctctgcgtctctggtccctctctgacctccctgtcccctctgagaccacactggccacctcatctttgtgcttgcagatccctctgcccagagctgcccccaggctctcacactcccacacgactccctgttaaacatccccacccctgcagctccctcccccatctccacggcatcaccatctggcacgcgccacatttttatctgttttgtttaaagtctgtctctgccacgagaatgtcagctttgttgaccactgtgtccccagcgcctggaggagttcctggcacacagcggggacaccataaagatttgctttttttttttttttttttgagatgttgtctcactctgtcatctaggctggagtgcaatggcctgatcttggctcactgaaacctctgcccttcaggttccagtgtttcttatgcctcagcctcctgagtagctgggctacaggtgcccaccgccatgcccaggtaagttatttttcgttgttgttggtggtggtgtttttttttttttttttttttttttttttttttagtagagacgaagtttcaccatgttggtcaggctggtgtcaaactcctgacctcaggtgatccgcccaccttggcttctcaaagtgctgggattataggcgtaagccaccacacccagccagatttgtctattgaatgaagttgttgaatacctaaatgaaggaatgaatgatgaatgattctgaaaaagcagggagacaaagtcttcatgatttctttcctctgcatccaccaccccaagttcagggcccaggtgagtatgagacccttggtagtccccgttttcccttttagcccctgactgatcccagcacccatcagctccgggataaaggagcgggggcagatctggatttgagtcctggctctgtctctttcaaagcagtcactcaacccttaggagcctcagtttcttggtctgtaaaatgtggattatgataccttcaccaacatttattgagcattctctatgagccaggccccgggccttctttccaggtttgttaaaaggataatgtgaggtcagggcaggggctcagtgaagagaaatgaatgggggtcaggatgcttaagaatgacagggtgcagcctcccccggggcatctcacttctctgggccccatgcggagtgtgcagcttaatgaagccttgcaggtaagggagaaacttcaccagcccgcctgcctccaggaggagcagcagaagcccggtctttggtgttctaggtggtgctgctgcctcaaagccacatgcttggaggggtgactctgtgccaaggtcacaaaggagatagacgcagagagcccccatccccttccttctccccccgcccatcccactgcccgctcgcccaccccgcagcaccagcctgggcctcagcagtggatgagcctgtcatactagggacttttatctcacacaattgcttctgcctcttgatagagcttctcctcacaaatcaaatcgaccccaggcagggagagtgaaaatcaatgcctggtggaaagttccccacagaaaacagattagttattctggaaacttccttaaccacaacaggctctggcattcccccgggcacaggtccgtttgcccagggctccaggtggttgccaggagggcagagaggaacagaggccggcccagcagggacccaaccccggccagggctctcccaggctgggggacagagcgggagaagggggaggcttggagtcacagacctgggttcaagtccaggtccaccacttccttctggctgcccctgggcaagtcacatcatccttctgagccctggtttccactttcggaaaatggggctctcaggagtgttcaccctgcaggactgttgtgggatggtaggtcacgtgtgcacaacacccagtggacgacaggctgccaatggaggaggcagagtgcacttcccagggttctcgtctgggcagagggctgcatcccctggctctctctgtggataatggttcttacagccgtttccatggactgagtcctcccttggtgcctggggattactttgtgtcgtgagacttaatctgcccagcagcccactggatggttatttattttatttttatttttatttttttgagatggagtcttgctctgtctggagtgcaatggtgcgatctcagctcactgcaatctccacctcctgggttcaagcgattctcctgcctcagactcccgagtaggtgggattacaggcgtgtgccaccatgcccggctaatttttgtatttttagtagagaccgggcttcaccatgttgtccagactggtctcgaacttctgacctcaaatgatccacctgcctcagcctcccaaagtgttagaattataggcgtgagccaccacgcccagcccggatggttatttttaatattcccgatttacagatgaggagactgtggctctgggcagtggagaaactcatcctgggtcacataactgggaaccactaatcccaaggggtctgagagccactctgggactcttcccgatgccctgggcctccctgggcatgcatcttcctacaggatcccagcttgctcccgtcatggccgctgggccctgcctggcgactctaaccctccccgaagtgacatcgatataaatattgttaatggcccgaacataatgttaagtcaggttttactggactccctcgtccagcccgtggatttatggcgataggatttgaggtaaatgtttattggcccaagtgagagccaggacttcctctctcccaaccgccggctccccagggctgcccaagggctcttggtccacctgctgagagcacatcgggataaatctccccgaatgaaatatttattaattttgttaactagtgttgatctcataaattacaccgactttttcatgaaacggttattaacatccatggcgctgtgttaatggcttattgaccaaatatgggataattaggcctggggagcgtggcctggctgatctgcaagaggccaatttggccaggattatgccaatgacctattttatgttgcagccagcgacatgggagattctggagcctgggctttggaaagctgggatcttcaggggggctcctgacctggagcactctgacccctgcccttggcctggcccagcagccttccctggggtggctagtgctgctccccagcaagggaagggggaagtgggaccccccactccaaggcatgccctggcctccatcctgctcttagctctgggagctggtgttgccaggggcagaggagggaacaggcccagaggggttgtcccctcaaagatggcacagtccatgcttgtccggccacatcccccgtctgtcccatctgctcctgctggcgctggagaaggaaggagtcttcctaccttgagaatagggaaattctctccagagagaagagccccgctggcccaggaatggggggccggcggaagaagctaccccaggacactgtccatgtgtgtgcctggctgtgctcctgggcaggcctgtgccacacattcaggcacacacatgtggcctggatgcctgcatttggccacatgcgcaagacagggtctctgtttgtggctgagggtttgtacctgggcctgcagggtgcggggtggtgctcctgcccagatgtgagtggcccggcctctccacgctgtgtctcaggacttggctttctagggggcctcaggtttcaggaagctgggcaggagatgccaccctgctggtgtgcggagagggtttcccggagtcaacagcgagtactgctccctccactgccatggctcctttccctggtgccccgaggtgggacccagtgagaacaaggggaaggcatctctgggtgagagctgctcagatccaattccacccaggccgttctatagcacggacgcttctccagggacagggcgtccgctccttttcaggcagggcattcactgttaaaccttagaaacacacttagggaattgtggccacagggaccatgcttgagatgcccccaggagccctcaggaaaccatccctgtttccctgggggatccagtcacccaggtgtgttccatgggactcaatccctggtctgagctgtttggaccagggctgggcatctcatcccacctaggccaacctgctggtctcttgggcacttggaccagggcccagaggccaggcagtccctgctggtgggtgtactgaggctgccatccgtgggtggccacggagaagcagagggaagtctggagacaaggagagagaaaactcatgggagacagcagcagaggggcccttgaggccctgagtcggggagaaagggtgccgggggagggggaggtgccaggggtgagggggtgcctggggagagggggccgctgcctccatccatcctggcctggccaggccaggctggctgtacctcagagctgcaggggccctggcattttctgggaacaggctgggtatgtggccccaaagaggctttctctaagatggtggagaggagcctgtctctaccctgcctggagccatggagacagttctgggtgccccgggggctcttgtctggaagatggaggctcccagtgctggaggatgcaggaagatgctgtgtgctgagaaccaatcagcctgctgttggccagcaaagcaccctcaccccaccttggaggtagcctggacagtggcccctttcccctggggcacccttttctctgccagggatttgtggaatccgaccccagccccacatacaacccatgtgttcatcctccagctccttgtttctctcggttaacaaaatcttcaaacacggctgtttgtaactaggaggactgactatgggttgggggcccagcctctcggcaggatgacagcaaggacagcctgggtcctgagtaggagcctgggtggagcctccagcatccgcttcaggtctttgccacggtgggacctttctagaactccaggtctcggtttaactctccctccgagaagccctgggctccctcctgtcgtgggaggaatcctggccccttcactgctgcctgccccatcgctccatagatttcctttcctggggctagtctgatcaagtccagttatttttatttcgtcctttgtgagctgcttcccaccctgggctgcaagttccttgaggcaggaccccatgggtcttgggagagttctgccctagggcctggcagtgaccttgctggatgaatgagtcaaggggtgaatgaatgagtgaacgggcagattgtccggtggatcctcttgaatgcacttctactgtaggtgttgactgcaaattcccctcccttttttttgagacagagtctcgctctgtcacccagactggagtgcaatggcgcgagcgatctcagctcactgcaacctccacctcctggtttcaagcgattttcctgcttcagcctcttgagtaactgggattacaggcatgtgccaccatgcccagctaatttttttttgtatttttagtagagacggggtgtcaccatgttggccaggctggtcttgaactcctgacctcaggcgatccacccaccacggcctcccaaagtgctgggattacaggcatgagccaccgagcccagcctctttttactttttttgagacagggtcgtgttctgtcacccaggctggagtgcagtggaacgatcatggctcactgcagccttgacctcctgggctcaagcaatcctcccacctcagccccctgagtgcctgggaccacaggcacgcaccaccacacccagctaatcgtttgtagagtcggggtctccctgtgttgcccaggctggtctcagactcctgggctcaagtgatccgcctgcttcagcctcctaaagtcctggagttgcaggcgtgagccactgtgcctgaccatgaatcccttctgcctacccctgcccgagcccagcagctccccacttctaagcggcaccttcccccttcttgctctctgcactgcctgcccccgttacagccgccagcccgtaccccctttctactgctctttctgggatgtgggacgctgaggttaaaacctgaacccctctgcgacccccctcgcagctggctcagccctcctctgggtccctctggcaccctccagccttcaggaatgggttccaatgtcaccttactagggctcatgtgcttttctcttctttcctctcatgccacttcccccattcgcaatgactggctattgggtgtcactgctgggttttgtctccctcgctggcctgcaaggtcctgggagcccgggctgtgatgtttgcccttcacgcccccatgccaggccctcatggaacacgtgctgaatgacagagtgaagttgtctgaagtcaccaaacctctaagtggtgtgccagcatctgcacccaggcccctctctgctcagagtcattgttgctgccactagctcgggctcagctgccttccctgccatgtgtcgtgtagttgttttcagcacataagctgtcaacgagcgttctttggagatacttgaactggagtggcccaggggcttttcgcctttccgtaagcctgctctgccagggaggcgctgccccaaaggtggcctggccaccgtccagaatggaggcccccggtgctggcctgcccagcagcacctgcggctcagtccctccaggatcggaaggaatcacacctgccacctctacctgctggcccagtgccacctccctctcctcccagactctgcccaagaggctcttgaggcaaatctgagccctgtgcccggtggcagaccttgagcttacccagggctggctggcctgcccctctggaatctgcccttccccaggttatggacccattttcctcggctctggcaaggacaagctctgggaggtggacgagagctagggcttcaggtttctctcctggctcttcctcttagcccctcgcctgctgggcctcagcttcctcctctgtaaaatagtcacagtatcctcatccccaggagacttagggggatgaagtgaaataatccacacagagctcagggtagggccagcacatcgtaggtgcctggtggctgccagctctgaattagcccaaataacaaaaacaaaaaacacagcccatgcaccaggtctagactggggacttgggtggtggggaccccagtggttcctaagagtaggactaactcccttgtatgttgaaatgggtttcagtttccactggaaggaaactgtgcccagctcaccagtgttgctctgagcagcaaggaggtgtccccacttgctgggcctgtttgtgactgaatgcatggttataggtagcactttcactctttaaaatgcttcagattgaggctgggcaaggtggctcacacctgtgatcccagcactttgggaagctgaggtggggggctcacttgagctcaggagttcaagaccagcctaggcaacatggtgaaaccccatctctacaaaaaatttaaaaaaattagctgggcatagtggcatgcatctgtggtcccagctatgaggtgggaggattgcttgagcctgggaggttgaggcagaaaagggattaaaggaaataatctgtgtagcttcaggatgggccagcactcagcggactttgaagtgagctatgatcatgccactgtactcctgccggggtgacagagtgagacactgtcaaaaaaaaaaagaatgtttcagattggatgataaatatgctttcctcagctctaagcttcaagagtctatttggcatcatagagaattttatgttctttggtgcttttctctattttccaatttttctaataggagcactgcttttaggatctgggcaaaaccatgcatgtgatagaaacaaaccttttcctcctcccagtctgctgggtggtcctgctggccatagcatgaggcctggaactccggaggctgcctaaatctgcccccctgctggtggctggactctgtgggccctctggggcttggatttcggctgccaacacctctgaacatgcacacacctcaccccacccggccccttcatctccagccttggcttcgtgtcccggactctggctctggaggccactgtgtctctttgggtgacatttaacgagcctggagaggaggccgtgccccgcctttgccttcggcagagacgggaatgagaattttaatgagggtttatttttaataaaggttaataaagtttaattaaattaaattaataaagtccaatatttgcccagccatgcgtcaggcctgggtgtgctgggaggcgttggggattaagctctgggtttgtgctcccgggtgggggaggaaggtgaggggggaagggcactggggctggggctggcggcagcaaggggtatggggggagacaggctggctcctggggacatggggactcccaaccctgaccggtcttggggtgctggggagagaggaaaggcgcaggtctgagatgctgcccccacggggcccaggctcctcccaagccccgaatgtcccccttcaaagcacctaaatctggcactcaagaccttcaaagtccactaagcgctggcaggtcctgagatctgcatagattatttcctttaatccctcttctggctccacagcctggagaggtgagcaatactgtacccattttatagaggcagaaactgaggcctgtgggggtgaaggacctcccattatctctggcaagcactgggattgggcacaagcagtgctgattcttcctgtctttgtttcctggcctacaaggtccttgcctggccctgctctctttcctcccagtgtgtcctgggcccccccaacatttccaggagagggctctggctttatgtgggtatttcatccaatcctctcaacatcccagggaggaaggtctattataatattatcactcccggtggggtacattggctcacaactgtaatctgagcactttgggaggccgaggcgggtggatcatttgaggtcaggagttcaagaccagcctggccaacatggtgaaaccccatctctactaaaaatacaaaaattagctgggcctggtggtgggtgcctgtaatcccagttactcaggaggctgaggcaggagaatcacttgaacccggcaggcagaggttgcagagagctgagatcctgccattgcactctagcctgggtaacagaacaagactctgtctcaaaaaaaaaaaaaaaaaaatcactcccattttggagatgaggaaattgaggctcagagaggtgaagtcacgcttccaaggcccagagctgggggtggggagcatttgagaaggatgtgatgtcctccaaggtcttcatccttccagggctcctgaggggattcagtgatataaatgcccatggcagggacccctgcaccaggacttgggctctgccatttgcttgctgtttcacccggggcccggctgtcacctctccgtgatgtcgtctgtgaaatgggcatcatggcctcatgggttggtcaagggtggagcatgaagctgcaggtgcctggcttggggcagacaagctcagctccaaatgtggacattcaacagaaccatcaaagaacaagaatcctgcggctagaatcaaatggcctcacaaatggcagagaacaggggagggacagctagagagtcccagagcttcctaggagccgggaggaatcatggggaacttcctggaggcagtaacgcatggtctgtgtaagctttgacttgtgggatggggtggcggtggagagaagcatgtgccaggaggagagtcctgtagggacgaaggtcggaggcaggaaatgatgtatttggcaggagcagggttgatagccagaagcacagtgggtacggctggagggaagtgaccaagtcacggggctatgcctgccctggaggggaggggaactgccggaggcttttgaggaagggagtgatgtggactcaggttgtgccaggcgggaagctgaaggattatgggaatcgaggtaaaggtttggtcaagaacaagatggactaggaaacacagccgtccctggggtctgagcagaggtggccccagtgccttggaatgcgtgcttccagaaagaggtctttctcatccccgggggttgaggatcacggggaagccccgagtggccagggtaacctggggaggagagagaacggtgttggcttacccagcctgaacatgccacgcgcacagggccatgtgcattacatgggctctctccttgcatgctcacaaaagtccttggagggagggactattaatatctccatttcatagatgaggaaactgagggccagggtagtacagtggcttgctcaagatgatccctccctccaaccctctgcatccaactctggcacagggaggaaatcagcactctggagaggctctgcccgggcttctctgcctagcacccactccaggagggcaaagggcacaggctccaggaccagctggcgcccggccccagcagcagacatcccacgaggtgcctctggtgccagctccggcgggcagccctgcctggcagactgtgtgaaagatgtcgaagtgttattaacaaaggcattgattttcctatctctgctttatgcattttattagccaaacactttaccgtgtaaccattcagcgccacactggctggcgatgaatctgaaacgccagggcacgtaaaatggaattggccacattgcttatgcgcccacaacaaaaatcacaggcaaaagtgtcataaaatgaatagcacccggcaatggccataaaacaaatattacccaggggactggggaatttcctgggctgtgaagtagctgcgtgaggggtcgtagcgctggaatgatggcaatttccatttctgtggctttggccggggctgagtcctcctcctgcccggtactggccttggccccaaccacgccaggctgtgctggccatcactagctgagtcctttcacattcgggctgtgggaggcgtgaatggggtgattagaagcaagaccccagagtcagagagactggattcacgtccacctgctcgggccgcgtgacccttctcaaactgctgtctctctctgtgcctgccttcccgtgaggattggagcaggccctgtcctggcctcattgagctataatcgcctataaacggtagcaggcttgtcatgctcgtgattgttagagaagaaaggcctcccacatgactttctgagtgctcagcccactggttcagaggcagtgggatgactgagatgacctcctctcctgtagaaccaatggcccgagcctggtcagcagggccctccatcccctgagtcccactcggctcccttaaatcctcactaatgaccgtgcttaatgaacagcaacgcttcaggggaaggagaaaatgtcctgaacctatatatggattcccccatctccccggctctaaatcgtgtgacaactgctggtggtgggggtggtgtgtatggaggaagggtggctggagtggagcctgggtgctctcagcggggcctcccaggggtgaggatacagggcttctcttttgattgctgggctggacattgagcaggggagatgtcctcccagccgtcctagcaccctggacctcagagcacctgccccatggggaggaggccaggggagggggtagtaggcaagagggcctgcctggcacatagtaggtgctcagtgaaagtgtggcggtgactagagggtgcattggtccgatgagctcctcctgtggctccaccctgctctgtgggaggcatcatttctttgacgtgatcagccggcaatgtatagaggcccctttcacaggcgaggtgcagggtcagcgagaagggactagctgaaggccacaccgctagcccacaccctcccctcctgcaagcggctctgagactccagtgggcatcgacgggcccaaatgaatgctctgggtgccccctccagagttggccgccggtccagggattcaggagtcttcatttgatcattgctccaggagattctgaccccaaggtctcaggtaagaggttaaaaagacgcgatcctaggggctcccagggcaatagttctatgacccccgacttttcaggaggtgcaggggcggggcaagttgccttgacagtgttgctcttcctgcacggggtctgttgggtccctcaccctcctttgagacttgatgacatcccggggagttgaggtcccctaagcctggagtaggaggaggagagggcttatgagctctaggtttgaacctggaggaggcctgatttcacagcccagctgtgtgacctcataaagttacttggcctctctgggcctcagttgctttgtctgcaaaatggggagaataatacccccttcaaaggcctgtttcagccaaggactgagaacccggggctcttgacgcacctacgacttccctccctagggtgaggcccaggcctctcagataactctgggaggatggcagaaagtgtctgaaccagccttgaatccaggtctcactgattccctgttctcaagcccaagtgcctccaacttgggacccagaaatggacaaagcaggcctgggccctgtcctcctggggctcccagtctggttggggaggtggactttgttgtcaaacagaccgtctcaaaacagaggttagcagtgatgggaaagcccaggaggctgtgggagcccaggagggccccccggccagatctcagaagtggggagtggtcaaggaagccttcctggaggaagagtcattgaaggtaagacttgaagggtgggatggagttaaccaggcaacaaagtaaagaggagggttaaggctgagggcacagcagtgtgaaggcctgaagggaagagtttgagggattctgttgcctgagttggagtatggtgggggcaggggaggggtcactgtaggcgaggcaggagtgttttttttttttaaatgtagtttttaattttattttatttttgtaaagatggggtctcattttgttgcccaggctggtcttgaactcctgggctcaagcgatcctcctaccttagcctctcaaagtgttgggattacaggtgtgagccactacgcccagccaaaactcaagagcttttgattgcacttttttttcttatcctgtgattaatttttttttcttaaaaatggtttcaactttctgagtgtacccttcccttggtatccctgagcccaggctgaatgcacagacacactttgtcgactgggagaagaaaacagcttgtttattacactgtaactaccaccgaattacctgattgtttatatttttcttgctacgtaattgtgtttggccttagcatgtaaattgggctataattactgtataatttatagtttttatatcttataacaagttagtgtctaaatcacacacccccatgtaaatactttaaaattattcggtaattacttatttacattataattaataataagtaattagcatacatttacaaaggatttacatacttatttctgaatatcagttcttggcagtgctagtgaaatcttttgctgatataaaatggaggccagggtagaaaaaccttccccaggctgggaaaagggatgtcgctttggggtctcctggcttctcagaggtgggtcgaggagaatgtccccagggtaggggaacctaaaaatgtgcttcaggcctcatgaggggctttctggagaagaatgagaacatctcttccttgagaataaaaacaggtttgcctgcagcatgaagaagtcaaggcagacgtgcggaagtactttctgatgttctcgtgaggaaggtgccagaaatgggctaaaacttgggaaatccccctgctgccaggctgtcttgaccctgacctcattccaaaataatgatgccgatgacggcgatgacagcattgtcatttcaaaactacttgccatgtgtcttcgtggcacagggcatgagcttgacaagtacagtctcatttaatccccacagcaagatgttttaacttccgtttagtacgtggaaaaacgcaggctcaaacaattcattaatgtgcccggacctctacagccttggagcccatggcggggacagacaggccaagtggaccaaaagcagtgatggcgaggggccactcctgcgtccacccttcagctccctgacccaggtattctacctgttggggacactgcacaaatcacggctattggttgaaggtatacactgcatcccgaaggatagcaggcctttcctccaccctcagtggtggcccatgcaagatggcaccccagctagttccacctgtcccatcccaagggggagctcatccaatcccgttgcaatatcagaggatggtgctacaccgagtgcttcctgttggtccctgttgccggcagatctgatcttcagtagtggcagtggctagatcagtcttggtcatggggggtggggggtggggggctctgctttgattccttccactgtgtttgtttgtttgtttatttatttgtttatttattttttttgccagagtctctctctgttccccaagctggagtgatctcggctcactgcaacctccaccttctgggttcaagtgattctcatgtctcagcttcccgggtagctgggattacaagtgtgtgccaccatgcccggctaatttttgtatttttagtagagatggagtttcaccatgttggccaggctggtcaagtgaagccagggacttcacttggcctttgctggtttcctagagtttactcctcagatcaaggcgcccaggtgaatgttcttccacctgtgtaatctgcccattccaatgatacatttgagaactcataaaaagacccgagtggcctgagagcccaggggacacactctgaaatgatcggggctgggattccacctaggattcattctccatgtgcccctactttgttttgtattttattttatttatttttatttttattttttttgaggtggagtctcaccctgtcacccaggttgaagtgcagtggtgtgatctcggctcactgcaacctccacctccctggttcgagtgactctcccgcctcagcctcctgagtagtgcgccaccactcccggctaatatttttgtatttttagtagagacggggtttcaccatgttggtcaggctggtcttgaactcctgacctcgtgacctgcccgcctcagcctcccaaagtgctgggattacaggcatgagccactgcgcccgggcatgtgcccctactttaacagggaggccatgaaggctgtttggattcctgggtgccaacgtcaacgtggttcccacatccaaaagctctgaggatttccatttgccctcgttgctttacagttacctgggcaaagggctgtaagttcctttgggggaaggactggggaatcaatgcggtaaacaatctctgtggtgttgcagcctccttcctcctggggaccagcctctccttcaggttctgggtctggaaactgggcaaaggattctgatttcccacgggagtagctggcctcagccttctgctcctccattcctgttctttcttcattctatagaggaagtgacaccgtatcggtgtcatctaccctgaccctggaaacatctggacctactgggtgccatgctgacctggctgcccactaggggattatgtccacctgcttctgacagccaagcactgccacagtgctctggtatttaagaatctatacttttcaccagggatcccagttctgcaacagcacctcccatcaacagccctgggctacaacaacagccaccactgatctcaaccatgttggtgcctccctcatcagctcattcctgtcacttcaataaatggtgcatctggagccttctaaggaccacagtcaggggtgggcttggatcaggtgtgggagggccactccagcacacctcctcctccgagcctctgatcccctccgccagccagtcatgacagctctggcatcttcgtttaatgagacccattgctttgtccaagcatccaagagccctcccagcagctcttggggctcttgccgagtggcaaatcctgggttgtcggggagtctcagtagtgacaggctcttgcttatccagttgtccatcccaccctctatgaaccagcagcattagaatctgtccctcccatgcatcttggccaggacgtgcagctctttggtgggtgttcctcccttcccttagcaggcctacacttgctaagttgggacacactttaatttgatcctagttatagctctggtggccaggagggcagatcttgagcagggccagcaagtcttaggacatctcctgccccggttgtggcccacttctctgaacccacatagttcaggagaacctgaagttcaaggttctcaggtgcatctaccccagtggctccagcacatgttgctgagtcccactccttccctgtcaaggccccacttttggtgtaggataattaccaggactgatggtttgaccttctctgaaattctgctgctcttctgattaggtcctgagccttgtccccagctctgtctccctccagctctagggcatgagcatctctttaaaccctgcctagaagcccctgcagctttcgcgttcacttggaattggtgattgatcactttgaggtcgtcattttctctccttagggcgtccatggcattcagcagctgccaccagtcctacaatccttctagttgctattctcccgaacttcacgaacactggagttattgctcaagccagcatatccacgcttccctggactctgtcctggctcactctgggtgggagataatgaaagctacacactaaagtgtgctagggaccatggattctctacctaccaacagtgatggagtcctcaccaggctgccagtgagtgatgggacacaagaatccgtctttaaagttgaccactagcactgcccccaaaactcctccaccacctgagcttctccactgtgctgccaccttagggttggattccacagatgcagaggttgagagagattcagggtcacatggtaatatagtttggctctgggtccccacacaagtctcatgttgaattgtaatatccagtgttgggggagggacttggtaggaggtgattagatcatgggggtagattttcttcttgttgagatagtgagtgagttctcatgaaatctggtcttttgaaagtgtgtggcacttcccccttctctctctctcctgctctgccatggtaagccatgcttgcttcccctttcccttccactgtgattgtaagtttcctgaggcttcccagccatgttcctgtataccctgtggaactgtgagtcaattaaacctcttttctttataaattatcccatctcaggcagttctttttagtaacgtgagaagggactaatatgtatgatttattgaggaagagctatcaggagagagggagggaggaaagcaggataggcaggtgaaggggctgagcaggaatggtcttggctggagcctggcctcagcctggccccatggtgggttctggagtatgagctgcaccacgagagttgtctcttcttgaggcaggggggcctgggcttttgagctcctatgtccatcagccactcctggggtgagagcaacttggctgaggacaattgcccagaggaaggagcagtgttccctgcagctggagaataagtacacagcccatggaagggggcctgggcagggcaccagcagcagccactccacactttcacccttttgggagccagagccaggagcctttcctcctttttttcattgtctccctcaactaaaaaacagacagtctgggccctaaaaccctatgtgtgtgaatatggttcttaggtaatgagtgtgtggactatggaaagggaggatctagcctcagactccagctcacactggggcatacaaaggccttgtgggagagctagtttgagcacagcttgtggctatgctagaagctcctctggttccagccaacatgacatggtgtcaggctttgggggacagtggatgagcctaggagtgagaagggagagcttccatctgggtgcttgcttggcctaagcctggcacttgaagcagcaagggccagcatggttaccaagctgtgcaggtccagtcttcaacagtggcaccgtgtggccgagagaagcactagcacctggcattgtcaggttggtctccctttcctgagatggagatattccatagggttgttagataattgggggtggcaatgggggatgaggggtgaggagagaaaattcttcaagaggaagatactgaatactaatagggcctgtggaaactcaaattagtaatatgaagaacaaaaaagaggtttgaccgaatttgcattttattaaaactaagaaattaacattggtatgatactgcattagttcattctcacactgctgtaaagaagcaccgaagactgggtaatttataaaggaaagaggtttagttgactcacagttccacatggctcaggaaactaacaatcatggctgaaggcgaagagaaagcaaggaccttcttcacatggtggcaggagagagaagtacaaacaggggaaatgccagaggcttataaaaccatcagatctcgtgagaactcactcactatcatgagaatagcatggaggaagctgatccaatcacctcccaccaggtctctccctccacacgtggggattatggggattacaattcaaaatgagatttgggcaaagacacagagccaaaccatatcaaatgctattaaccaaactacagactttatttggatttttccagtttttccatggatgcccttttttgttccaggatccagtccaggataccacattgcatttagtcatcgtgtctccttagccatctaaaattggtgacagtctctcggtctttctttatctttcatgatcttgacacttttgaagagtagttcaccctttatttttatgtcagttccaattctagtcctgtaagcaagcatatgataccaccatttctgtgaataaattcagatttatagatgcaaacacacctccacatatctatgtcttttgagtgtatttgtgtgtgtgggtgtatgtaaatatttggacatgagaatgttcactgtgcatatttgttataatttttatatttttagattcctgcttcattggcagtcgcagattctgaagcaagttcttattctggaaggggcaggcgaggggttctggaatgggctggggttggtacatcacaggaaggatgatgcctggggctgtgctcgtttaggcatgggctgcactggtgttcccccaggatggcaggtgatatggtttggatctgtgttcccactcaaatctcatgtcgaattgtaatctccagtgttgcgggaggggcttggtgggagatgattgggtcaagggggcggaattcccccttgctgttcttgtgatagtgagtgattctcatgagatttggttgtgtcaaggtgtgtggcactccccccgctttactctctcttccaccttctctggccacgtaagcaatgcttgcttcaccttccgccagatggtaagtttcctgaggcctccccagccatgcttcgtgtacagcctgcagaactgtgagccaactaaacctcttttctttataaattacccagtctcaggtggttctttacagcaattcaagaacaaaataatacagcaggtgaggcctcattgccaagggtggacagaggagagagcctgccccctgactctctggccaagtttctcacaccctcagccagaaattggtctgatgcgttcatccatcaagaggggcaggccattcgaggaaacacagctgtggatgtgtgcgggcactgtcatgcttatcagcaagcgtcaatgtccacccgtgtgaaaagggactctcactctcacgggctgggtgactttgggcaaatgacttctcctttctgtgcctgggtttctcagtttataaatgcagagtggcagggtattctgggctcatcaaatacaaatgtgatctcccacatttcccagcctccccggcagttaggctggggccatgtggcgagttttggccaatgggctgggagcacagtgtggcacttgtcacttttgggctgaggcagttcagacccatggggttttcttcatcactttcctttcccaccttagtgaccccagaagcacctgttctacagggcctgaccacaacatagagaaaggccagcaccccacagggggctttgtgtgagtgtgaaatatactcttaccatgaaaagccactgacacttgaggttggtttgttgttgcagcaaagcccatcggatcctaagtaatggtgatcatgctcactcccggtgagtggtgacgggcaccaggacctcaggagttgatgcgtctgtggggatgcctgtggaggctgcttcctgggcttcctgaggattcggagctggggcaagagatagctggtgggtgcattttgtgaaaatgctcaagaaattattcttatcattccttaaggagacaaaatttctagtaagtttaacttccagaccctcttggtaaaggttttacctcccatgtaagggtgactttagcaaaaattaacaatttattgtatcaatgatgtgttcccggtggctgagggctgctgagatgtggcaaatggagcctgagagggccaagttcccaggggaggggagggcagcaaggggagaggcctgtaggatcaggctgataatggttgctcacccccaccccaatcctgaccatgagggcaggggaggagtctgtttgcagagtgtggggcctggagccacatgaagtttctgttgggggtctagacttggatgatgcaggcatcatcatcatcgtcagctcatgtacagaaccatccatgtgccaagtcccaagccgataactttctgagccttaacttagttctcccagcatcccagttgtcaggctcccatgttcccagtcttaagaacaaggaatcccaggctctgagacaggaaggggtatggctgaggaggcagagctggagttgactgcagagactcctgcttttgttcaccacgtgctgctctgctgctccccagaaggtgccaagctccggatggggcccttactacctgtcaaatcagcaccgcctccccttccctggacagcccccttgaagggcgatggaaaaaatccagggaaggctgagtggaagaagcgaacttcagaaaaacatcaatagggcaataccatttgtgtgtgtgtgtgtgtgtgtgtgtgtgtgtgtgtgtgtgtgtgttgttgttgtttctttgtgttcttgttttgttttgttttattttttggagatggggtcttgctgcattgcccaggcattgcggcctcgaacttctgggctcgactgttcctcctgccttagcctcctgagtagctgggactacaggtgcgtgccaccacgcccactaatttttaaattttttgtaaagatggagtcttgctatattgtccaggctgatcttgaactgggctcaagccatccctctgcctcagcctttgaaagtgctgggattacaggtgtgagccaccactcctggacgaagaccattttttaaaagaaatgaaaccaaaagcatctatatgtttccatagatccatatgtatatgaaggcatagagaaaaatctggaaggatacacagctgacgggtaacagttagctccagagagggacagagtagagggtggaggtggctggggacactatctgtgatgcttaggtttttttttgttttgtttttgttttgacaatgacaatgcattcatatatcacctgtgtaattaagaattcatttacaaattttaaaagggcaataacaaacaaataagccagctgttgtaggagagctgcagctttgggctgcttttctgccatgttcacctgcccctcgctgagttcactgcttggtctccagcacctgacacttagtaggaactcagtaaatgtgtatggaatgaatgaagaggtgaatgaatgggtggatgagtgcatctcagtaaatgtgtatggagggaatgaagaggtgaatgggtggatgagtacatctcagtaaatgtgtatggagtgaatgaagaggtgaatgaatgggtggatgagtgcatctcagtaaatgtgtatggagtgaatgaagaggtgaatgaatgggtggatgagtgcatctcagtaaatgtgtatggagtgaatgaagaggtgaatgaatgggtggatgagtgcatctcagtaaatgtgtatggagtgaatgaagaggtgaatgaatgggtggatgagtgcatctcagtaaatgtgtatggagggaatgaagggatgagtgaatgggtggatgagtacatctcagtaaatgtgtatggagtgaatgaagaggtgaatgaatgggtggatgagtgcatctcagtaaatgtgtatggagggaatgaagaggtgaatgaatgggtggatgagtgcatctcagtaaatgtgtatggagggaatgaagggatgagtgaatgggtggatgagtacatctcagtaaatgtgtatggagggaatgaagaggtgagtgaatgggtggatgagtacagctcagtaaatgtgtatggagggaatgaagggatgagtgaatgggtggatgagtacagctcagtaaatgtgtatggagggaatgaagggatgagtgaatgggtggatgagtacatctcagtaaatgtgtatggagtgaatgaagcggtgaatgaatgggtggatgagtacatgaacatgtcagatgtgatccaagtagcacagatgtgggtggaaggatcacctccctctttccagccatgatgtctccattgatgcagtctaagacaccacttgcttactggtggctgcgtcttgcttgagtgcaggtaggatggtttccattgaattaaaatccacctcctcccagtcccatgctccttaggggacgcaagcagccgtctttcctccctgttcacgcctctcttgttatgctcagtttcctgctgactttgtgtccaggcttctcatcaccggaaaatctcatttgtctgtccccacaggctctttagggaggcaagtaacctctttagggagggggcgtgagtggggagtggatggtgaggagagagtgcggcctccaaaaatgggaggtcaaggtggattctgtggcctctttgaagaggccctgtctggctctacgtccagctgctgtggtcccggagggagtggccaggggctgcggcctgatgtggcgcacgcagatgtctcacccggccccatctctggcagaactgcaggctcagtgatgcctcaaacccatccccagcccctcccccaccacctggaccttgccgcccctgcccccacctggccgtcccccgagccagggagctggggagaggaaaccacacaccgaggccctatctgatactcataagtttgctcaagcttatgtaaatcacacaaaaactgacaagttttcctattaaaagataattgtaatcagggtgccggacgtgcggtgtggggctgattggagatagacggacagtacgaaaagatggatcgttttaatttgcaccaattatattgaagttcatgggatcatcttcttcaatcttcatgaatactttattttctggctgctacagagctattaaaaagaatgattgaggcacacggcaggccgggtatattttatgaaatatcacctttaaagaatttgagtacgccattttcataatgagttttctagtacctaatcctcttctctattactacatttaagaagtggattgatctgggaagtgcccaaggtgcaggtaatgatacattttgccaggcgcaggcggtgataatggatcacgttttggcgaggaggataatggatgggtgcccagcggaggtgcgtgcaggagtgggcggtgtccgtccagccccgatgggggcctgtgctgagtcaggttcctgtccttgcttggtgactctccggactccagctccaggctggcgaggaaggcgtggaggccagaaaaggagaggacgaggcgggggaccggggacgtgggagctgagatggggaagggctcaggggtcttgggccagtggggaggggtctgtaggctcagctgtagggagaggctggagttgcctggtgtggggtaaacgcccctgatagcagtagcttaagcatgcccttagaatgcccctgtaaggcagacacacctgaaggtgggttctgagctagggaatccgggagtggccaacccggaggttcattccttgtctataggaacatctgagacccccgcccatcccgtggaaaagaggattgaggctgtgaatgttgccacgtggaggttgttaagtggatgacactaattgaaaacgacgtataaactgcacgctctctgccgtggttgtggttctcctgtccggcctgccgcacctagactctccaccttgtatgtaagcccctggtaaccccaaggctggtttgctggctctaggtgtcttcttcagcctctagaacctggtgcccaccctactgaggttgacacagggtcagcacaacacctggtttgccctgagccaggatcagatgggttttgggggaagggtacaggatgggggagtctctgagcccatgaggaaattgatgaacagcagcaggacaggacctgcaacagccccggccaagggcctggccacagcagtcccactcctgactccagctccctctctgggcctgtctcccaggcacagtggtctttggggctggaggagacggcagatgaggaaggggttgcgggtgggtgaactcatttcagagtcagctgggccagggggccaaggggtccctgccaggatggagtgctggggtcatctggtgtgtggtcatgatgacagcagggtcaagggctaaggtgtgacatgacaagcctggccaggggagcccaaccccagggtcatggccctgtctccttgcctcaggtgctgcctgggggcgtcgccctggccctgctaggcctggccctgggagtcacagccctagtggcttcctgagatccttggccttggccctgggcagggcagggcagcctgcggggagaggcagagagaggcgcccccgcgccaccccaggctaggtctcagctccgccacttggccaggctttcctcccaaggcttcagcggcagcagccgtcataattaaccctgctaattaatcagggcaggacggattaattgagatcacaggagaccaggagagcaggtgcggcttcggggctgacgggataacgagctctctggaagcccagggggcctggccctgcccaggggagccctgggctcgctctgcggtgaactgcaccaggcagtggccccagggaccccaccctactggggtgtcccgggcccgctatggcaggctggcaggcagagtctccctcgtccccgccgccaggccccagcctggtggaaccacgagttccatctgtggcccatgagaaaggaagccccaggctgccaggggccactgcacagagtggcaggtagggtcaggcactggagctctttccctacacccgagagcaggtcgcctgctgccgcagagggcctgggaaggcacctgtatcaggggctaagatgccctgagagaggcccttcctaaaccacagaagggctcagcgggattcctgccggcgagtgctgtggccactttctgattcctaaactctctagcagcttccacgatgaggagaatttggaagatgcctgacagaggcaggggccccagtgaggaggctttggctgcagcccaggcaggcgggtggcttggacttgggcagtggcagtggaggtggagaggcgcctcttgggtgggaaactggaacttttggacggactagatacggtggatgaggggcagaggtcagggtgattgctgcatttccaggaggttctgctcctgggatggggagcgtggagtgggttagaaaggcaa

SEQ ID NO: 12573 - DNA, 56700 bp, Human
aattgttagataaggaagatggtcccataggaggggtgactcagttgactcaactctctcctgggaaatacacttctgcattatcctatttataataacagggtgttatgaagtaaatagtcacccaaagaggaacctcctgagagtagagttgagtgtgacataggacagtccaagaaaatatgtgcacctgacaaggtgctttgaggtagcaggtgaagctcaatcacaagaagtggcataactcaacaaatgactctttctgtacccctgggaaaaccatgtttcccaccaagaatctctcaattcatgacagggaatgtgcaacctcaacggatctctctttcttttgtgactattaagattactatctctcaggctgacacaggtggatcacctgaggttgggagttcaagactagcctggccaacatggtgaaaccccatctctaccaaaaatacaaaaattagctgggcgtggtggcacccacctgtagtcccagctactcgggaggctgaggcaggagaatcacttgaacctaggagacggaggttgcagtgagctgagatcgcaccactgcactccagcctggcaatagagcgagactcagtctcaaaaaaaaaaaaaaaaaaaaagaaaaagattactatctagagaggtaaatcttagagaactcaatgaaactcatagggtttctatttttgaagcaaacttaaatgtgggtgtaacaataatttttagagtcactgtaacatgtgtgtgttttccacttaagagaatttgtcatattaggtttgtagctttattgaagtgtttaaaacaccttgactaagtttgaaaccaacatttaagtatcgaaggcaattggttcatgaattaatagtttgaattattagttgcataatagtgtttaaatatttgaggaaatgtgtttaatagatgtaaaagcttagtaaagtgaacattaaacaaaactaagtagtggtaagtgttctttctatgccagtagcccctgagacgttaaggatcctagcaacagacaagatatctatcatctagtagatttagtagactgtatgttgtagcaaaatcgcatgacctctggctattactattgaaaacaaaatcctaactaagatacttagcagaaaaacccagccagcaactatgtaggttaccttttgtaattacagtctctcgacaagggttattattcaattcatgacttgattaggtttggatcattggcaaatattttgctatgttcacctctttagtaataagcttgaggtttactcctttaaaacacttctgaggtcaagctttctgaagtgacagggattgagaggtgaaggttctagagaaagaggaggccaagcaaccttggtgatcaaaagacttttaagaaaaggaaagattaatattcacctttatgttgcagtgatgcaaactgttccatatctcccagatgttcattacagttgctatataaacaaaaaaaatccaagcacttccgaggtctaaatagttttacttcctatagctatcatacaagaacgattcaaagtgccaattgttgccaatgtcgtgtcattcatggatatgtcagtgattcttccttgctgtggacagcagccgacattcagttatttttctggaatagacacctcagcttgctacttgctgggctgatctaagatactctgaagattcgctagggacttatgagctactaatgctcagggatttagtgtcctgaagaactctttaatcctgtgcttcctgaatcccaccctaagccagggccttctgtcacatcccaagagttacaggcagtttgaaagctctgctttctgcttgacctttggaagtcctatgagggaccatttacggtttcctcagtaatttccaccaggatgaatttccttctcatcactctgcctcaggtagtgctctgaaggtcgtcctttctgaacaaacgcagcaaagcaagccacaccatgggtgagatcaaccaagttgccgtggagaaatacctggaggagaaccctcagtttgccaaggagtactttgacaggaagttgcgggtggaggtgctgggagaaatcttcaagaacagccaggtgccagtccagtccagcatgtccttctctgagctgacccaggtggaggagtcagccctgtgcttggagctgctgtggaccgtgcaggaggaggggggcaccccagagcagggggttcacagggccctgcagaggctggcccacctgctccaggctgaccgctgcagcatgttcctgtgccggtcccggaacggcatacctgaggtggcctctaggttgctggatgtcacccccacctccaagtttgaggacaacctggtgggccctgacaaagaagttgtgtttccattggacattgggatagtgggttgggctgctcacacgaagaaaactcataatgtcccagatgtgaaaaaggtaggtggccttatgacagtggggcagaggtcttggcagggtcagggaggaacaaatgggaaagagagatagtgctatccttgtggcattagtttggcaataaccgggggaatgtgggtggcagggaagaggatcacccaggcctagtgttgccaaatttagcaaatgaaatttcaagttgcccagttgaacttgaatttcagataaacaatgaattattattttctgaagtataagtatgtcccatgtaaagtttggcattttatcaggtgatcctacctggccctggtgcattccacacaccctcccttacgcctcctccagtgctctgggggactttccttctcagcaacaccagcaaaacaaactaccccactagggagatgggccaacgtgcccagatgccaagacttgtgaactgctccccatgcctctcattcacagtccttcgaaaacattcaggttttttggatggatttgctagtaaatcaattctttcatctatcgaccaaatgtgcaaagagaaaaaatgatgccatttgaaagttcagatgttcaaatttggaattcattacatatgtgaatttaggtgatggttaagtgcaattgaccactcccactgctccataacccagatctttcaagaatgaattccaatcaagtaagtgggacatttggaccctcttgaagaccaacagcatactgcacaaatacaaggcattgagatgccccttatagaaatagaaaaactttattcttaccattagagtacatgttcatttttaaacaattataagatacaaataaaccagaggaggaaatgctaatcacccatcatccctcccctcagcaataatcaagggtaccagcttggagattctcctggcagctccttctctacacatgtggtccattattacagtttaccattaacaaaaagggaaaagtggattatgatggaacagagttgaatgggaacaacttgtgaaatgctttctgtgcaggggtgtatagggcagctggagaggcaggaggataatctcctaaatgcctcctgaagctgattatagggggagggtcacacggacccaagaggtgtggaagtcatcaaacacgagtgactctctgcaaacaaccacagaacaccgctcaggtgcaagggttaccatggggcctggtagggcttcagtcctgaataattcctcctttcagtaagtttaagctgggttaagtttgcttttgagcctgactgcagctgcttcaagtgtctaaatggatgctcatccttagggcaaagttctctagacaaccaactggaaggcaatgtctgcacatcctgaggtttttctcatgggaatacgctccttgagggtccccaactgagcccatccctgctagcacatcaaacttgaaaaagtgacattcagcaattttttgaaaggcttttaaagaagagatgggtaaaatgatttctgctgttatactttgattagcccagttctctgtggtgagaaggaaataagagcatggagctgcttggaggtggttttggtctgcggctgtccatggtgagcatcacggcatggacggagcacttcatctgggagtggggagtctctcctctcttctctggaggactcctggctgttctgggtgggacacagagaaatgtgtgttgaagacagatacggttctgtgctcacgagaaagagacctcattggttcttcatttcaactgcttcttcacatttttttctctctagagtggggattccaactctggctgtacattaaaaccatattaagctgtgtgcagtggctcacgcctgtaatcccagcattttgggaggccacggcgggtggatggcttaagcccaggagttcgagaccaggctggccaacatgggaaacccccgtctctaccaaaaatacaaaaataagccaggcatggtggtgtgtgcctggagtcccagctacttggaaggttgagatgggaggatggcctgagtctgggaggccaaggctgcagtgagctgtgttcacacactgcactccagcctgggtgacagaatgaaaccctgtctcaaaaaataaacacaatccacaaaaccatattggtggctttattgttacagcggactctcaaagattagaattcaggcattagtatttttattttattatttatttatttttgagacagtcttgctccatcacccaggctggagtgcgatggcgctatcttggctcactgcaacctctgcctcccgggttcaagcaattatcctgcctcagcatcctgagtagctgggactacagaggtgcaccactatgcctggctaatttttgtatttttagtagaaacggggtttcaccatgttggccaggctggtactgaactcctgacctcaggtgatccacctgtctcggactttcaaagtgctgggattacaggcgtgagccactgcgcccggcccaggcattggtatttttaaaaagctcccccagctacttctaatatgcagccaatgttgaaaaccactggtctcttgggtaagcagatacaggaggaggaagtgaatttcaaatcagctgtggaatattagagatggaaggggcttatgaagtctttagcccaactctgtcctatggaggacaggaagttgaggccataggagttgtatatcccccgggtccatggtgtgtgtctgtggatgaggagggttggaacggaggtggctgagtatgtgtccagtgctgtttgcctaccttacacccctgcagtttcacttgctttagccgctgcagtaagatttgcaacgggaaaggaagtagaaaccaatgtttcaaatgaaatatctgattaattcttcctcttttcattgcacttgacaatttaaacaacattctctgacaagggtcatatttttatttccagcctgtgtagtaggaatcgttcaaagttaggtagacaggaagtggcagatctggggcaataactcaggtcttggaggcctccctctttctaccatatccctgaccacacacaactttcctctggctagcagtgtgggcgcaggtgagggaaagacttctcacacctagacaaaggtacagaactacatactcccaaccttggagggtccatgaaggtaacagggaagccactagtatagggagagggctgtggcatcagacagacctgggtgaagatccatgtctgtgacgtagtaactgtgtgatggagtttctacccctaagaaatggagataagcaaatgtacagattaaatgtatataaaggacctgactcatagtagatgctcaataaatgatagctgtgataatattgtcattatgccagtaggcgtttaggagctggatatggttggccaaaaaatggtcaatgattattgcctgttttaaaacaagttgaaggcaggaagacttttttttttttttttttttgagacggagtctcgctctgtcacaaggctggagtgcaatggcttgatctcggctcactgcaacctctgcctcccaagttagagccattctcctgcctcagcctccccagtagctgggattacaggcatgcaccaccatgcccagctaatttttgtatttttagtagagacagggtttcaccatgttggccaggctcgtcttgaacttctgacctcgtgatctgcccacataggcctcccaaagtgctgagaggaagacttttaagaacaggaaactgagagatatcctctttaagttgtttttttctctattcggaaagctgtccataaactatgggtgatcctgattctgactgtggtttaaaagtcctccttcctctctcttcctttcctcctctacttctgctttggatctcaggggttaagggtgtttaatcaggatttagcaatactgacatctgatgagggatcaggcctcctgttgctctaaacaatgttctccagctgccttcaagggcttctctgaagaaccatcaagggacacacgcaggatttatgcaaagaaacttcgctaaggaatttttgagctagtgaaaataaaacacaaaaacccctcccccatccccatcctgtaacttaatggctggtttatctagggctttcagatgcaataataagcaagtatcaaattttgaaacttacaagccattttctcaaaacagtccattgaacttaacatttccttgtgtttagaatctggaataaaatggcattaagtttgaagctgcagagtgaaatgtgtttgcaaagaagtgctgccagctaagcatggtggcttacacctgtaatctcagcactttgggaagctgaggtgggcagatcacctgaggtcaggagtttgtgaccagcctggccaacacagtgaaaacctgtccctactaaaaatacaaaaattagccaggtgtggtggcaggtgtctgtaatcccagctacttaggaggctgaggcaggagaatcacttgaacctggaaggtgaagcctgcagtgatcagagatcacgccattgcactctagcctgggcaacgagagcaaaactctgtctcaaaaaaaagaaagaaagaagtcctggctaacttcaccccatggtgcacatttctggtatttcgatgattcctttagtgcccaggctgtgtaaatgaaggtgatgtgatctgcatggataacagggtggaagggaaacaatgggagctggcctagacaagcagtggattaagagaaagaatctaacaaaaactgcagacactttggtctgagggtgaagatgctatggggaaccagagagaggtaacagataaaatggatagaaaagaaatgtggttcttggtggcatgagtgagggagtgtgctggccttctggaggaagggtgctccgcggtatgggaggcctacatccagctatgggcatctgatttcttcagtgatttgaattggctagaaaaattaaaactagaagcaaaatggtaattgcaaaagaactacttctcattcaggaaagcctagaaaagtactaagtttctcttcctagtacttactgaatactatgtgccagacactctttttttttctaagtgctcagcctatactatgttattctatcttcacatcaggaattctaggcagtagatggaagcattacccctattttcagattacaaaacgaggacacagaaggtaagtaacacgcccaggaccatacagctagtacactggggcccagtttcagccaagaaagtctgactccaataccttccttgcctttatgcaatgctgatgcctcaagagttggtttgtgtgtttccactttgggaaaggtatagaagagatctggagtgaggggctgcctttatcccctttacatcacatatttcctctgagagcggtaccatttctggtgatcctctgcaggagtgattccccattgggttgagcctaagaattacctgggccacgtaaaagtgcaggttccactgtaggagattaggattcagtgcatctgctgcattaatctgcaggtgattctgaggcatatctcaggactgctaatctcatttgagctctatgagttctattggccaaccagcccttgttccctggtggaaactctggcctggaaatgacacacccagaaaattctcacatttttttctacgggaaaccagacagaatccagtctgcaaggtttgtgctgcttttagaagcactgccaacacagggaaatgaaaataatacaactgtggaaggaataccgcactaattttggccaacgagtctcagagttaaggctgaagttcagttctaattgaagaagtcctaggttcaaagggaagaatgtcatgacccaaggaaggctgggtctaaacccaccgtgagtggctattctctgaaatgataactaataagataattgccttccttgacctttttctcaagcccttccatttgtgcgcttctccagactcattactcagcctctgctatggccagtggattagaattatctctcgaatctactctatgaggtctgaatctgggaagatccactttcctctctcccagagaaagaaaaaaaaataggaatggaagacataagcctggtagaacattaaaaacctgataagcatctgatgctggcaagagggtagtccttggtcctttcacacagggtcagtggaagttagaatgtgaacctttctttttctttttcttttttttgagatagagttttgctcttgttgcccaggctggagtacaatggcacgatcttggcttactgcaacctctgtctcccgggttcaagcgactcccctgcctcagcctcctgagtagcggagattacaggggcgtgccaccacgcttggctagtttttgtattttagtagagacagggtttcatcatgttggccaggctggtctcgaactcctaacctcaggtgatccgcctgccttggcctcccaaagtgctgggattacaggcgtgaaccaccccgcccagcctcagaatgtgaacctttcatcaaagtaatctatgtaaagaaaaactgtatgttcctgtggctccagcaaaagggatttccttttttgggaatctgtcacataaaaataaaagcaagaaggattagtgcagtattgttggtagtggggaaaactatacacaggcaaaatcagtaaaggacagttgagtggatcataaagcacccagggtggagtagtgtgcacaaatctaagaggtgagttcacatccatatgcattggtcttcagggaagtccctaagacattgttaagtgatgaaactattataagcaattagaaaaggaaattttagaaaaaatagaaaactctttgttcaagcatggagaaaggcataggagacacaccagcagttagcacggatttcttctagtaggctagattggaaggaactgggggcaatgataatttttgctttatgttatgacatatgggttgatgatttcaagtgcatgttttccctttgtaatgagagagaagcgctctatgaactgtgtctgtattcctagctgtgctctccttccctgcatgtacttgctgtctattgtaaccttgtgccttcccctctcttcctcttagcacctcactttccacttggctgtctgatcacctcttttcttctggcccaacctcagcctaacctaaataggccatagctcaggttggcagcgcttattctgaaatgggcaattccattctatgcagtcataggatggcaggtggagtgggattgtttactggggaccactgtactggagccctggttatctgttggtagcatttaaatgagagagaatgatctgtcatcatccctagatctaccactctatgattttgtgccactttgacaaatatgtgactgtctctttcagaacagccatttttctgacttcatggacaagcaaactgggtatgtcactaagaacctgctggcaaccccgatcgtggtgggcaaggaggttcttgctgtgatcatggcagttaacaaagtaaatgcatctgaattttccaaacaggatgaagaggtaatgctaaccctgggcatctggttggaggctcaggaaatttatttgttgtataaccaaagaaaagatgtcacaaccataacttgttattctctgccgtctgtaggtcttttccaaatacctcaactttgtgtctatcatcctaaggcttcatcacaccagctacatgtacaatattgaatcccgaagaagccaggtaaaaggaaggcagcattagtcattccatgctgacctattctgacaaagccgcccagagacaacaaattcagacccctcctattcctcctgggggtgtaagccacgtggaacagatccccaaacttcagtcccacgtgtcctctcatgatcttcccgccactctccccacacacactcccctgcaccccaagctctccaattgtgtacacaactggcttggctttcttcagtctagatcccgagtggacttggcatttctgtctatgagatggtgatgacaataatggtacctacttcagatggttgttgtgactattagcgattagctctcaaataaagtttgtagaaattcctgggtcatagtaaacctattaatttgaggagcatattattcctaactccatgagacagagggataaagggcactattagtacctaagatacctaggtctggcccactctctggacctcagtttcctcaccagtacaatgcacgagtagaggttgagagggaggtcccttcccgtttgaactctccaggtaaggttacctctgactatctcaggatgcatggaaggaggtatgtggctctctccacatcagggccagcaggagccagtgggccaccgatactggattctccgtccagggaccatccctgcatcccatttcagggcacttcccctttggagccaaaacatctagacacaggaaccaatcatagcttctctctctccatagacccgcagccttgcaaaagtctactcatcatctcacctagaggatctgagtagtttgttggatgtacacatgttcaaaatcagaattgcactttccaatgatatgcatttattttatttgatgcacctcatgttttcttgtggtgaatgctctatctctccatagcatactttattctaactgttttctttttgatacctactttcagatccttatgtggtcagccaataaagtatttgaagaactcacagatgttgagcgacagtttcacaaagcgctctacacggttagatcatatctgaactgtgaacgatactccattggactgctggacatgaccaaggagaaggttcttattattctacacattttgtctcatctcacatcgcctatataacacacaccacaggaaatgtgatccttaaaaaacagatacactatgtaaataattagtcatgattgatgacaagaacagaggtaaaagtgtgtgtcttggagcaaaaaagatgtaggcttgaatcttggtttttccacttcctagtaatatgggttttcagcaagtctgttttttttttacattaattaatagactatttttagagtagtattgacagaaaaattgattataaagtacggagtttcctcttccctcccaatctcctctcccagtttccctgttattaatatcttgcattagtgtggtgtgatgaatcaatattgatatattattattaactaaagtccatagtttacatgagggttcatcctttgtgcagttctctgggttttgacaaatgtgtaatgtcatatatctgctactacagtatcagacagactactttcagtgcctcaaagccctctgtgcttcacatattcaacctttcctcaccccttccaaactcctggtagccacaggtttttttttgtttttttttttgttgtttttttttttttgctgtttctatagtttttgccttttccagaatgccatatagttggaatcatacagtatgtagcttttcagactggcttttcactttgaaatatgcatttaagtttcctccatgtcttttcatgactcaatagctaatttctttttatcactgaataatattccactgtatggcaggtttgtgtatccattcacctgttgaagggtatcttggttgcttctaatatttagtgattgtgaataaagctgctataaccattgtaggtaggtttatgtgtgtctacatgttttcaactcaattgggtaaataccgaatagggcaattgctggattatactgtaagacaaattgatctttgtaagaaactggcagactgtcttccaaagtgactttactgttttgcatgtctaccagatgcactttctcaccagcagttgttaatgtcagtattttgggtattagcagttgctgatgttagtatttggggtatcagttgtggtatctcattgttgttttaattttcagttccccaatgacatatgatgttgagcatcttctcatatgtttacttgccatctgtatatcttcttagagagatagctgctcagattttttgcccacatttttttatgttgttttcttatcattcaattgtaagagttatttgtatattatgggtccaagtcctttaccaaatatgtgatttgcaaatactttctcccagtctgtggcttatcttttcattctcttaacagtgtctgctgcagagcagaaggttttaattttaatgaagtccaatttttctatattttttctttcatggattgtgcttttggtgttgtatctatgaagcctcatcaaacccaagttcacctagatcttctatgtcatctcctagaatttttatacttttgtgttttacatttaggtgtataatccatttcgagttattttttgtgaaaggtacaagttctgtttctagattcactttttttacatgtagatgttcagttgttccaacaaaatttgttgaaaagactatcctttgttcattgcctttgcgcctttgtccaagttaactatatttgtaagggtctatttctgggttctctattttgtttcattgattcatttgtccattctttcactaataccacactgtcttgattattgcagcttcatggcaaatcttaagtcaggtagtgtcagctttttgattttgttcttcttgtcagcaagtcttttaacctacctgattcttggcttcttcatctgtaaaatgaggacatctctcttatcaattgtgagaattagagattttatatatttttttatatatataaacactatatgtacatagtgtctagaatttacacagtaggtggataatcaatattatctttaccaactttaggtttttgtattctaaaaaaatttaattaaagtagaaatattgaaacatgtaatattattcacaatataatgcccttgtgtcatcttctttaattctgttgctacccttctagttcaaaataactaacgataccatattatttatatattttttcttttgttttctttcctttttttgagactctgtcttggtctgtcaccaggctggagtgcagtggcatgatcttggctcactgcaacctcagcctcccaggttcaagcgattctcatgcctcagtagctgggattataggcctgtaccaccacgtccactgattttcggtattttagtagagacaggatttcgccacgttggccagactggtctcgaactcctgtcctcaagtgatccgctcgccttggcctctcaaagtgctgggattacaggcatgagccaccgcacctggccttatttatatttcttcatattcatgtgattggaagttattttttcagagtaattgttctaagtggataaacataggatgaagcactaggagagctgggttctgatcttggttctgggactttgtagctgagtatgttggttaggattcttttggctataagaaacatcagacacagctaaaagcatctctaacaatatgatatttattctcctacttaacaaggtagggcagcgctagtactggttgattcagagatcagtgcagtcattaaagtccaggtgctttctctttcttcctggcaaggtctctgctacctgcagcgtgctggtgaggcctcctcttatggtggaaagatggctgttgcagctcaaatcattggcacataggcatgacacaactgggaggcattttctccaaatgtcactctcatcagcttttatctgaggaataccttttgccagtagtccctcagcagacttctcccccttcttcaatgtccagatctgggccacatacctgcccttaaactgatctaggcacctcatgtagaccactcatgggctgtggtctgatggaaaattaccacctgatactcaaatcgcatcaggttatgctagcaaggaaaagacagagaatgaatgttgggtaaagcaaccaacattttgccactctgtgtgaccttggccaagccttttaccagatttagcttaattgtctatgaaagaattgctatacattgagtattttgaactatgtgccagggtagatgttacatatgtattattcatttaatcctcacaacaattctttagtacaaattctattgttatccctattttacagatgtaaaaggttaagtaacatgttaacagtcaaaaattcctaaccagtattgctgggaattgtagatctttcagcactaaaattccagaattacgtagattaacataaaatatacaaacacataaaattcatataagatatggtaggtcatggaacagtgtgtttaatgatacttaaatctgattgcctccaggaattctacgatgaatggccaatcaagcttggagaagtagagccttataaaggtccaaagacacctgatggcagggtacgtgcaaatgtcttccttgatgccatctgtgcatggtgtcaggtgctaaaattaagaggccacagtgcatagagcactggcctgggaagacctggagtagtagaaacagcactagacaaggagtttgaggttctagtcccagctatgccccaagctagagctgattggcccctgccttaactccttgttgaacctctccgtttccttttctataaagccagggcttggtagaccagtggttctcaactggaagggatgcatcagagccacctgcacaacattttaaagaagtacctgggcccttcttcagatatgtgggattagaatctctaaggaagggttgggttaggtttactttcccccttgactgcaagcttcatgaaggcagaaacccctgtgtccatagcacacaggaaagagaaggggatggattgtgtccaggcctcagattcatcatctgccccatgaaacagagagaataattctctagtccctttcagctttggcagtgaaacctcctgtttctgaggcacctgttcagataagtcactgatgaaaggagggtacgggtcactatatataatgtaaaactgactacagttaagaaattacatgatttgttctagtgaagttattaatgtcaggtatttctggacaacaaaagggatcacttgaaaataaaaacagactctctgatgatttggtagccaaagatcccccccaccccaaaagctgtttgggggcaattcaactttttaaaaacaaaatttattttagcctgtgcatgtagataaacagccaataatatttctggttttattataagtttgtagtcaggatataagtagtttgataatttatgttataatataatgtggttgggaaataaggttctatttgtaagagttttaaagtacaagttccccaatgaaaaatgatttctttgggaaataacattattcccataatatcctctttctttcttaggaagtcaacttttataaaatcattgattacattttacatggaaaagaagagatcaaagtgattccgtgagtattggcaggaagttgctgccgcagttgccgttgtatttttgcacatattgcatttctctatattgcaatgattttttttcttctcttccccaaggacgcctcctgcagaccactggacactcattagtgggttgccaacatatgttgctgaaaatggatttgtaagttattgaacaaattcaaattttaaataatattgcaagaaactcttattagctaagagatagatacaattgtgaaagcaagaatgcatccaataaaagctagatgggccgggcgcggtggctcatgcctgtaatcccagcactttgggaggctgaggcgggcgaatcatctgaggtcaggagttcgagaccagcctgaccaacatggtgaaaccccgtctctactaaaaatacaaaattagctgggcgtggtggcacatgcctgtaatgccagctacttgggaggctgaggcaaaagaattgcttgaacccaggaggtggagattgcagtgagccaagatcgcgccattgcactccagcctgggcaacaaagtgaaactccacaaaaaaaaaaaaaaaaaaaaaaaagctagatgatcacttcctttggcataggacaaaggagagaagaatcttgacagtcaaatgtaggttaactggagacttctgaactctacacagaaatatttagtcagcatgagaaaggttcctccatccctcaatttcttattctgcagccacacacatttcagatatcctttggaatccaatgactatgatttaatgactgggtttaattctatctcaagtacatcagtcaattttttaaagcataaatatgggggatggggtggggatggtgtgggatgtggaacttttcaatattgagttaaaagcttgggcctctaaggtcttgacccacctgtaaatgttcttataacatttagaacataatgttcttcaaagaaaggactaaaacagataattgctgatgaaaagtttaaaaaagaataggctgctttttgcctcttcaaaaacacagttgaagggtgctcagcccatcaaatgatgtaatttattcaagttagatcatgaaattaatgcatggcatgaaagattccttaaattcttaggctatatatgcttataaaaactttgaaagattctcgcattttctgtgtaagagtactacaaaaatagtagacatggttcattcaattattctcagaaagcacttaccttggggccgagaggcaggcagagtttggtgaggtggggatttaaggagggagcccacttagatcttgttagattgttagttttttaggacttttgtgagcaagttgttaaactgttggcagcttgaaatctcccatggcaagagaattgggaccatggaaattggcaactgatacaagccaaggatttccccaattcccagccaggagagctgatttccccagcacccattctggagctcacagttctagttccatcccatagatttaaacaaatcacttaacctctttaggcttccatttgttcattttttttttttaagtatgaacttaattgctaagatcccttctggctttaaaatgctatgatagctgggtgtggtggctcacgcctgtaatcgtagcactttgggaggccaaggcaggtggattgcctgaggtcaagagttcgagaccagcctggccaacatggtgaaaccttgtctttactaaaaatacaaaaattagttgggcttggtggtgggtgcctgtaatcccagctacttgggaggctgaggcaggagaattgtttgaacccaggaggtggaggttgcagagagctgagatcgcgccattgcactccagcctgggaaacagaacaaaaactccatctcataaaatataaaaaataaaatcaaataaaatgctatgattttaattatctcttggaaagacatggtcttttattaagatccatttgtgattatgacccaaggtacagaaaacttaaaatgacccaaagttgagtgatttcttgtccttatagatgtgagcaatagtctgtgaattccactaagtaaagtgatatctctcactgaatccttactttggtgtaactaaaaacttatctggctgtttcctcctgcctcttaaccatcatcttctaacccaaatctcactttaggaagaagaagaagaagaaaaaaagcaatcctagctctgctgctcatactggctgtagcagagctaggatttctcagctttctcctccccttggcctgagcagcctgttgctttgaatttgaaggggattccctggagtctgggggagtgggaaggggcagagacggtaccacatatcctccagtgatttaattagcagcagggaagccatcttgaatgagttgttagcagctgtggcctagttgaggtccatttgcccgcaagcagtcaagagccgtgtagaaaatcctcactcccaatgcgttctttcttattctgctttgtggatcaagagggctccactacacaatatttcagaccatttgtctcctcttgccttccagatctgtaacatgatgaatgcccctgcggatgaatacttcacatttcaggtaactgcactctgggtcagacctcacctcttggggctggggtagaggagtggatgctctcgcctctcctccacccccagagtccgcctgatgctcaggtgtggccacaggcacacacgggtccatctcccactcaccctggctgggccagcaagtagcagattcttcagtgaaggaagaaaagaaggttaagacagaaggccagggaggggacctgccactcctccatttgctcacactcctggtcatttacggcagtggtccccaacctttttggcaccagggaccggttttgtggaagacaatttttccacagaatgagggtggggtgggagatggttttgggatgaaacttccacctcagatcatcaggcattagttagattctcataaggacggcacaacccagatctctcacatgcgcagttcacaagagggttcacactcctatgagaatctgatgctgctgatgatctgacaggaggtggagctcagacggtaatgtgagcaatggggagtgactgtaaatacagatgaagtttcacccgagtacccactgctctcctcctgctgtacaacctgctggttcctaacaggccatgggccagtactggtttatagtccaggggttggggacccctgatctaagggctcaacagttcctgacacagcattcatgctcaataaacgttctctgcatgcatgaatggctggctacctcctacatcctgaatcctgctctcctggtggttttctcagcagcccttccctgcagcttattgcaactgttctcaggaaaatcaacaattctgactgagtcttcagagcttctcctgctgttagactcggttgtatccttccttctccactgtgcagagacccactgcctggggaatctgcctccactcaccgccagatgctcccaggaatcagcttctgtatgtgctactctacctgacccacttctccccatcagggcttcctgctggaacctggctgcagacccgagttgatccctccccgccccccgagttcatccagcccaccagaagggccagcctgtcatcttcaccaccccctccccaactgtcaccccccacctgtcatctctgccactcccttctctacctgcccatccctcctcacctgtcatctctgccacccactccccacctgtcacctcctcccaacctgactgttagagataaactggcatttggctccacagcctcttattttctgcctctgggcacttgttattctctgtcctgtatttaaaaaaacatccccttagagccctgatctcagtcacaaatagagactgccctccccggtgggtaccgttggggtctgtttttctgtctctctcacatacagagccccatctctgccttttaggaaaagccagccttccccaggctgcagcgtgcctccttagcggcagaaccacaccacaccttggggaaagctgtacacacttgcttcgttacgtgcatctgcctgctcctccctttgccgattgacatggaaaacatgtaaacaccatatggctgctctagctccttcctccttgcaattgaagcttatttgtgaccatgctgtgcccaggcctgacccctatatttatggcacgtggatgtcagaataggatgcatgtcagcaaaagggcgacaatgattttctagagtctgaaccttaagcagtcattgtctaaacagggagtgggaatggagctggcccaggagaatgcaggctgctctgaaatgtgaggccctttgctttctctcatgctccactgcagctactgctctgatgtgctctcatggcctgggcagagaggaggcctggggcctccccggggccttggggagtccccagtgtgggataaacctccaggccacagggatttcccagttctctgggaaacatcattgtggtgcccatgaaaatgtgcttctcagatctccacctgtgggaagtgtagccgtgcaatggctgctggcctgaaatccatggtcacatctgtgctgaggccacacgctccacaggccactcccaattggtaactaagtgtggcagggacagtaaagcaggcctgctcctggaagacagccagataccctgccaggcagcttgggccctaggaatgcctaacagctctgcaaacagtttcagaacagcacggtggtctaaggggctcccctcaaccttccatccttccgtttctcctttgcaaagggtcgggactgcatctctgtctgatgtctctctcagcacccccagcctccctccccgccgctcttcaacggcatcacctgtgcatcattccgcacagcggactaggacgggtgaccgccctccccaaaccaccaccctccttttgtgctccgtcttctgattctgtctctccctgctcaggccccaccctgattcttacgattcctttttgcacctgagaagtttgatagacaagccaatgatataaaaagaactgccatcagagcaaacctgcaaaggcagtggttctcacactatgtttcttgggggcataatggattcatttcctattgctgctgtcacgaattgccactgagtggtttaaaaccacacgaaatgtattatctcacagttctggaggtcagaattccaaaatgagtcttcttgggctaaaatcacggtgctggtgggactcttgctttctggaggctctggggataattcatctccttgccttttccagcttctcagggcctcccgccttccttgcctggtgacccttcccctggcagagccagcagcaccatcactctgaccttgcttttgtcatcatagctccttctcccattctgattctaacctctcttctacttttaaggatccttgtaattacattgggtccacctggaacatccaggctaatttccccatcttaaggccagctaattagcaaccatcattctatctgcaaccttagttcccctgtgttgtgtaagataacatattcacaggttccagagattaggatatagacatctttgggggccattgttctgcctgccatagggttcctcgaagtggactaaggggtcttcctttaacgtcaattaaagtggtcctaattcacaggaggaaaagtgtatagaatttcctcagttttttgtcctactaatttttcttaaaccttgggttccttctgtaacttgtctgtcagtaaggtctaactaatggcaaagcacaagaatatgaactggtagcaaatgaatatttcctgaaacactgagaagcagtcagcaaagcttattttggaagctttaacaaatacgcatgaagttctttcacacgcatgtgatatattctctattactgattttgtccttggttcgtatgatggtgtaagtacataaatatttcttattgttttccaaagatgcaggctttgcaagcactatgcactgcatcttttttctaaagctttgaccatcaggagacggatgttgaggtttggttcctctgcttttcattccatgtataatgactacatagagtagtaacaaattacttagattgagcacttattacatgctcagtctaaatgttaaattgtggttcaggctataagtgcagttggaattccaaaacagaaaagttctttatgagttagaaaaattagaaaggcttcatgggagagccaagacttaacaggggcctgtaaggatgactaagtaagccaagggaagtcttcaagaacaaataatgtggtgtgttgagtgcttgtctatctttgccttagctacatactgtgcaaatgctacatcatggttctcaaacttcagagggcatcagaattacctgggaagcttattgaagatgcatgcccaggccaggcatagtgactcacgcctgtaatcccagcagtttgggaggctgaggcgggcggatcacttgaggtcaggagttcaagatcagcctggccaacatggtaaaacctcatctttactaaaaatacaaaaattagccaggcttggtggggcatgcttgtaatcccagctactcgtgaggctgaggcaggagaatcacttgaacctgggaggcagaggttgcagtgagccaagattgtgccgttgtactccagcctgggtgacacagtgagaccctgtctcaaaaaaaaaaaaaaaaaaaaaaaaaataaacaagctaaaacaaatctgttacacatggtccttggaccacactttgagaaacactcctaaacttttgtgcctgcatccctcgactagaccctaagcatcttgagggcaagacctgtgatttattctttgtaccttcagcaactgccccagttcctggcataccacagaggcttgacaaatgtttactcaactcaacacaccacagaatgaaagactatcttcatggatcagtcagaaaaacaaaaaccacactagtattttaacgggagaattttatttaaggaattagctaaacaggtgttagaagatagaaaaagtgtaaagggaacagtgaggtaacatagtggtaagaagcacttcccatcactcaggcttgggaaagaaagggaaaaggttagaattgtcagaaaacagacacttggttctagttcactctattggatgtgctagagtacatataatggctgtatggtcctagccatgttctgacacaaagtaggaattgcacatctaacaccaaaagattactctttcttttttttttttgagatggaatttcactctgctgcccaggctggagtgcagtggcacgatcttggctcactgcagcctctgcctcctgggttcaagcaattctcctgcctcagcctcccaagtagctgggattacaggtgcccaccatcacgcctggctaatttttgtatttttagtagagatggggtttcaccatgttgaccaggctggtctcgagctcctgacctcaggtgatctgcctcccaaagtgctgggattacaggctccagccactgtgcccagcctttttctttaaattaaaaataaactaagtgacaggtggttgggtggtagctagaagggaggagtacaggacagtcttgtagtgatggaatagtgttgtatcttgattctaatggtggttgaaaagctacacaagggataaatttgcataaaactatatgtacacacacacatatatgtgcaaaagtaactgcatacaaatcttggtaaaatccaaatcagctctggatcgtacaatgtctgttttctggtttcgatattgtactatagttacacaagacggtagaaaatgtactgtagttgtctaaccatcattaccattgtgtgaaactgggtgaagggtacctgaaatctctctgtacatttcttttgtaatatcctgtgaatctatgattatttcaaactaaaaaggcaaaaaaataacttgaggtcccttctcgtttgtagaaaggacctgtagacgaaactggttgggtcattaagaatgttttgtccctgcctattgtcaacaagaaagaagatattgtgggagtggctacattttacaacaggaaggatggaaaacctttcgatgagcatgatgaatacattaccgaggcaagtgcaataataagataatggaagtcaatgcaattcacaaaataagagagggcacgtaattatttgttattctggaatgatattttgaagggccattaagacatgagtcacacatagctgtaaccaatatgttgttattttgtcgtttctatttcctgacttctataaactgcaacattttctaccaaagtataaaattttagcttaaccaaaatttgtaataatactcggaaaacaggaaagaggattttcttcttctttctcccactcctccttcctgttccctctcattcttattcttattcttacgcccagccccctgcctaatttttaggtcctgcttgactatactggtgttggtaacacctctctcttctattcatggtgcatggtacactttaaaaagcaataattcagccagttttattgtctgaagctgattattagtatgtttttcttaaattaaaagaaggaatggggtggttgatgatggaagggagatggatagaaaagcgtgcagattgttgcctccaaaccaatttttctttcactgaagagaattagaatcaccttttatccgtttcagactctcacacaatttcttggatggtctcttttaaatactgacacctacgataagatgaataagctagaaaacagaaaggacattgctcaggaaatgctcatgaaccaaaccaaagccactcctgaagaaattaagtccattttggtaagtgggaaattcagtcctgtggacataagatgttacctaaccacatattctagaagtcatctaattacccaggggtctgacaaatgcaaatggtttactcctgggctgagagagagagacagggaaggaggggttggaagaagacatggatggcccagtgtacagagacccttactggaagtacagctgcttggctggaatagcactttgttcaaaacagccctggggctatgggagctatagcaagaaaaaaatatatatattttaggaagggaaatgtatcagtcagctattgtcatataatgctgcataacaacaaccctaacacctcagtgtcatgcagtaatgaacctctatctctcactcacatttgtgggttgaccaggctttgattgacagtggctggacttggctccaagctatgaatttggtttgctctatgtgtctctcatccttcttggaccaggagctacctgatagatgtccttctcacaaagatgacagaagtgcaagagagcaaacctaactgtgcaggcatacttcaggtttttgctcacatcacattcaccaaaatgctcattggccaaagaaagccacatcacgaagaccaaccttatagatgatgggggagcaagtggatatttgctaaccatgttctaatcaccacaaaatgaagggaaaatatcatgtgcccaccatctctatttcttttatttccctggctttgtgtgtgtgtgtgtgtgtgtgtgtgtgtgtgtgtgtgtgtgtgtgtagttttgctggagtgggttggttttggtgagcatgttggtttttggttttgccgagtggtttgagtgtaattcagtttgatagtttgagatgttaaagatgagaagatctgggggtaataaaaggaactgtgataagctaatacaaaaataaatgtaagccactcattttttctttcctacatgcaaacaacccacacctctttaaaaaaaccagctactgtaatcattttgggggaattttaaaaatcaaatatattagattatttcttgaaaaaagtcttcataatcaggtgctataggtctttgtatccatgacaaagaatgcgtctttgccatggaactcattgtagtatattttatttatttacttatttttagagatggggtctcactctctcacctaggctggattacagtggtgccatcatagctcactgcatcttccaactcctgggctccagggatcttcccgcctcttcctcccacatattttaaatatatcttaactaagattgtaatagtagaggaatcagatggaaatcttctcctttaggaatttcacacctcaattgcttttacattttagaaatttcaagagaagttaaatgttgatgtaattgacgactgtgaagaaaaacaacttgttgcaattttggtaagtgttttctttctaaccttaatgcctgttaaatagaggcattataaatcaataatatattaggacatgctttcttgtttttcaagtaaatgttgagttttctctttcctgatatttctcaaggctaaaaagaaagaattcttctaaagattgatcttttgattccctgcttttcttcatctttgtcgcctctggtccaattcatacagataatttacaattgtaggtagcctagactactgcttaggggacttcaggcacagaatctagggatatcaaggcacagtttattttaatagctttggatgacaccatggccaccacagagaacatgacagagttagcgtggagcatggatctttctaggcactggcaccgcctgccatttctagcttctcttctggagtctgaaggctccattctttcctgttgttgccagtaggccatccctattatttttctttgaaattaactttcccacttcactaattctgtcttttgttgtgcccgatcaactgttaaactcgctcaataagttcgtaatttcagagatttttttcagttctagaaggtacatttaattcttttgttaagattctaactctgtgttaaaacttttcatcatttgatctattttgactattttcccctgtattttcataaatgtattgatgtgtattattttaaggtacccatcttaataccagaatcacctgtagatctgattctactgtttatttttacacctgggttctagtcatttgatcctgttttaaagcatgccttatgcttttaaaataaaaaatcagatattgtagataaaaacgtgtaggggctctgagtgatattatccttctgcaaagagcattagagtttcttctggcaggtgagagaattgttttagatttcatttggaatgatcttttttggctttattcctactattagggtggagcccttgtttctagaaagtggctcctctggaatccatgaaatcctgggatatttacgaagaccccaagaccttgaatttcagaggattgaattccttctgattgaaatggaaatatcacacttaatttccttactaactgctataacctgttttccaccatctctttccgatctgtgatgtgagcattctttctaaactaagacacatcgactatctcaccttctccctttccatcttttgtgggctctgtcctcccacccagggcctttgctctgctaccataagactgttggtctttgacccttttttggggcttacttcccacccccgtgttttcatgtcatctgaggttcccttttctcccattttgcttggctccacctttggcaccatcctctcagcctggcccagaagaccaccctttcttctccccacctgccctcaacaataggcatcttcttggaaaacaaaacttttattgacatccgtgtcaccagaaattctctaatttcttatttaaaggaagaaggatcttatgttgtagaagcaataaagtggacaaagaaccagtagacttcctaaaaaaccagcctattttgaatgtaaaatctactcagggcaaatcccaaatcattgttgcataaaattgaggaacgtaacaaatatttcagaggagttctccaaaattatcctggcatcatttcccagctacgtaattatttgtccatcttcacgtacctgagtctctctccaggcctgcactttcatgttacctccagggaaggctcagctgattttctgggtgtagcaacagttctgtgcaagagtgtgaggggtcagcccaggctcaggggctgggggaaccagaaaccgtaattttgttttaaatagctatataccattcggtgttgaaatctgtgtaaatagagcatggctgtcccctgaaaaacattaaacttactaaggggagtgacctccctttccctatgtttgtgtcctcctcagtgcactagtaaggacatactacacattcaaataaatacccattgaactgaatctctcctgcagatctgtctggtaggcccacatagttgttgctcatttctgcctcttagcactttctcacccacatggaatcgtctctccgcttccttctgccagctcagctgcatgcatgtccctccagcatctctcctcctttaatttccccacctgtccaaggacattcagtttctccctcggcatggagcactggccatactctctgattattctaagtgcttacttttcactcgtatatattttatagccactttaataagttaagttccttaagggcaagatacatatttttatttctcaagtcgcaccaatgccatgtgtctacttggctattttttcacataatccgaaatcctaaccagatgtgagttaaatgaaatgtctgcaagtatacctatgtactgcagggcaatcattggtttatccatccactcattcattcaacaggcatttcctgagcaccttcatgggacaggacctgcagatttgggatatggcagcaaataagcagatgatccccaccctcggggagctcacattctagtgggaaactgtcactgagcacataaagaaaattcaagagaattgaattaagcagtcgtttactgtttactgaatatttcttgaacagaaaaaaagttgagtatcaaaaatgagtaaggcttttgtaactaaacattttattttgcatcattgaaagaaaagagctactggagttggatttagaatggtaacccatcacttagaaagtctttaatatggccaagtctcagtttcatcacctgtaaaatggagataatcgtgtaggcctgccgttagcataatctgtgcaaactgcatcatccagtgcctggcacatggtggttcagtgaatcacacattgtgttcttttattgtaattttggtttacacccaatgttggctatgggagtggaaagggaaaacagatgaatgtaatctgaaacaacccatccttatttcaacagaaagaggacttgccagacccacgctcagcagaactgtacgaattccgcttcagtgacttcccccttacagagcacggattgattaaatgtggaatacgactgttttttgaaataaatgtggtggagaaattcaaagtacctgtagaggtcagagggtatttaatttaaaatactgtgtgattctgtggctctgcttcactgatgttttctgtggttcaaaagatggactcagtttgaattttaaattattattaactttctaaatacatcagcttaacccctatctacaagaccaacacatctttttagataagattgccacagaccttctaacctttagaattctattccaaagtctgaatggtgtcatcttcttttaggttcttaccagatggatgtacactgtgaggaaagggtaccgagctgtcacttaccacaattggcggcatgggttcaacgtggggcagaccatgtttactttgctgatggtaggtacagagggctgtaaatccttgtaaacctgcagatttcccatttgagcatgatgagaaataggtatggtccatcattttagatcagtaatttaaaaattcagggcacaaacccctctccgctgcagatgagtcccagtatccttgagcaccggtgggatgatcattcagacattcacacacttaccttctcaaaggaaggttcagtcttcacccacagtactacaatactcacaacaaataaagtgaacttgctccagaaacctagtgggcctattctctattgcaggctgcacttggtatagaggtatattaattcaaataaattatagatatgcatatatatgttatttttttagacaggaagattaaagaagtactacacagatctcgaagcctttgccatgcttgctgctgctttctgccatgatattgaccacagaggcaccaataatttgtaccagatgaagtaagtgaacacatgtccaatgttgacacgtattggtggacattggaaagtacttagggtgagaaaaacgcttctccctattccttggcccagtcaatgcctctttgccatgttggaaattccagggctggattctattccctcccaagcttccgccttcacgataacgttgctctttctccctaggttcttgcgtccccctttcctttctgttttcatttccagatgtgcctctgccttcttcctataggccttcaggctttcttctctcaactttgtttaatcagagtattgaattcctatattaaagtgcatgaatctggctgggcacagtggctcgcacctgaaatcccagcactttgggagagtgaggcgggcggatcaagtgaggtcagttcaagaccaacctggccaacatggtgaaaccctgtctctactaaaagtacaaaaattagtcggatgtggcacacctgggattataggcacatgtctataggaggtagacgtgtgcctctgaggtaggagaaacacttgaacccaggaggcagaggttgtagtgagccaagattgcactactgcactccagctggagcgacaaagagagactctgtctcgaaaaaaattaaaaataaaaaacaagtacataaggtacatgaatgttaggcttacacttgtacactcctatggagcactccccagctcaggctagagaatactacccctgggctcactacccttcacctccctggtctttttgcttctgccaaactctccttcagctggtcttccatcttaacatcgatgccatctttctctcttgccccaagaaaggaagtacaataagaagggtgcaagctctgggctcaggcagatttggattcactgggtcacaaattatttaaactttctaagcctcaatttcctcatctgggaagtaagaattatagtaatggtacccagcacataaggttgttgtaaagattaaatatgatcatgcatataaagccctcaactcatggtaggatcttggcagttaataaatattaggtatgattgctgggtgcggtggctcacgcctataatcccagcactttgggaggctgaggagggcagatcacgaggtcaggagttggacaccagccttgccaacatggtgaaaccccatctttactagaaatacaaaaattagccggacattgtggcgtgcacctgcagtctcagctacttgagagggtgaggcaggataattgtttgaacccaggaggcagaggttgaagtgagctgaggtcacgccactgcactccagcctgggtgacagagcaagactcagtctcggaaaataaataaataaataaacttcaggtattattatggttactattattgttgtgatgtcattggactattcattcaccagtattgctcatggccagcccagttccttgataatgggttttaagatggtctatctgccttagccacacttcattctcatttctgacacattgaactacccctctccagaagtagtgaagtgttgtagacagactgaatgggctttggagtcttgggtttgtggggaccaactacttcttggttgggggatcttggacaagtcatttaatctatttgagattcagtttcttagccatgagatgtataaagtgttgacctctcaaagattgttgtgagaatccagtgaaattacatatgtgaaacctacttgagaaagtgcctgctaggcaggtttcacatatataatttcattgagcgaaaagcactttgtaagcagtgactcctcatcttcagcaattctacctattattaggctttgtcttgaaaagatgatctccatccagacttgaggcaagagacatcttcatctcaaaggttccagcctacactggccgctcgctcctccagaatgcaagtcccctgacagtcactgaagtcctcgtcctccttcttgatcagtagtatactagccaattcagttccagagaaacaaattgagcatctattgtgtgctagtaaggacttgatacctactgcctcatttaaccttcacagcacagtgaagggaggtgccatataggaggtactagtatcccccactttaactgatgagctcaaaagatgaagttaaaccttccctaggttataggaagtagcaggattgaagttgccatcttgcctccaggtttgcaggaaagatgcatgcagccacaccctgccctctgcattggcctggttttctttcatcattcctcctctgtaaactcaactgtatgggcatgtggtgatggaagggcttcctgactgcagactgtcagtgtgtgtgaatgtctgtgtgtgtatataaataatatatatattttttggagacagggtcttaccctgtcacccagggactgcagtggcatgatcacggctcactgcagccttgacctctggggcccaagcaatcctctcacctcagcctcccaagtagctgggactacaggtgtatgctaccatgcctggctaacttttaaattgtttttgtagagacagggcctccctatgttgcccaggctggtgttgaactcctgggctcaagcaatcctcctgcctcagcctcccaaggtgctgggattacaggcctgagctactgtatgtggccaactaattctttttttttttttcactaaatcatttgtgagtcagctgcaatactagatttcattcctaaatattgcagcatatatttattaagaattaggaggacattcacctacataaacacaatacaatgatcaccctcagtattggtacaataatattacctaatataaagtgttttttaaaaattttccaattaccacaataatgtcctttatagctattttttccttctaattcaagatctaatcaaggagcacactttgcatttagttgtcaaatatctttaatctcctttaatctggagtagttgctcaacctttttgtgtgtttcaggatgttgatgtttttgaagagtctaggccaactattttgcagaatatctttcaatttggatttaaccacttgtttcctgattaataaattcagactaaacatttttttggcaggaatactacatagatgatgctgtgtccttctcaatgcattgtgtcaagaagcccatgatatcaattttatttatgggcgatgtccagaagatctctttatgtaaaggaacattttctcctttgcaattaataagtaatacgtgaaacgttagtttgagatcagattaatatctagcttcccaataacattttttaactaatgtttttaaacctaaaggaattaaagataccactcctttctgactagaattgagctttttcatttttaaaaatatacattttaaattgctacataatagatatacatacttttggggtacatgatattttgatacattcatatgatgtgcaatagtcaaatcaggataattgagatatccatcaccttgaacatttatgatttctttatgctgggaatattcaaattattctttactagctattttgaaataacaatggattgttgtttgctatagttactctgttaatttattgaacagtaggtcttatttcttctacctacctgtatatttgtacccattaatcaacctgtcttcatccttcccacctccctacccttcctggcctctgataaccaccaaactactctctatcttcaaataaagaaaatgtggtgcgtgtatatatatatatatagtatatatatagtatgtatatagtactatatatatactatatatagtacatatatatagtgtatatatatagtacatatatagtatatttatatagtatatatagtatatatatacactatatcgatatagtatatatataatggaatattattcagccaccaaaataatgaaatcttgtcatttgcagcaatatggatggaactggagattattttgttaagtgaaataagccaggcacagagagtcaaatatcacatgttctcactcatatatggaggcttcaaaagtggatctcagaagatagaaagcagtttggtggttatagaaactgggatttactcatttttttaaaaatctctaatgccaacacagagtagttgtttaaatatgtgttaaaattatgatcgattgtaatattgatcagatatggcctaattattccccaactaaagtatttgctttccctgacctgccagtaacctggcaatgacctctcccagcctaaagttttgttctccatgaaataaataaagcttctctactaaggctaccagccatgttttttatttcttctttctttaaaattatttattctatattttcatgagagtcttcacataatctctagacctttgacatcagcctcttttaccctgaaggcattgaagaaaaacagggtacaaaagactggggcccctacttatataaagctgtgatctaattgttaataaatgggaaggaacagggagatacatttatctcactgtcttgggggaggagagaaatgttaccttatagtgcttttcatcttggttctatgcagataacctatgggcctccacatgtttgctatatgttttataagtcatagtccaccgccataagccccagggaacttaaagaatttagatacaaggagctgaactccttagtttaaacaattaaatcatttatgcattcaacaaattaaggttttttttttccaaaagagcatattctcatcttctaaatctagaaaatcttttccaatatgttatttttgaccacttcacagataattgagtgaggagggagaagagagacattaagaaaaatcctgaattgtatgaacctatgtgtaatttttaaacagctagaatcatggcatgttgttttccttctagatccacgtctccattagcaagacttcatggttcttctattttggagaggcaccacctggagtacagtaagactctgttgcaggatgaggtacgtaaacctctctttaggacagctaaacacaaattctggatcaaagcactaacccacagaaaatgcttggaaaaagggtggccttgagttacagcagttgatagtgtatacccttgttgaagtcaattgatagaaattgctatattgaactagtttttgaacagccaagttggaagtagctgagacaggtgaagagagccatggaaagtcacagaatctctgtgggtctgtagggaaagaagaaaaagcttatggtggatgcaaaagggctccgtgcaccccaagcatatgtaaatgtaaagaggaaaggaggctacatggtcactgatttgcttattcattcatggggcatatgctttagagcatggtctatgcctttaagaaagtcaagctttcatagtggagtgtattcacacattcttgcattgctataaagaaatacctgagactgggtaattataaagaaaagaggtttaattcactcccggttctgcaggctgtacaggaagcacggcagcatcaacctctgggcaggcctcaaggagcctacaatcatggtggaagctgaagggggagcgagcacttcatatggccagagcagaaggaagagagatgcgggggaggtaccacacacttttaaataaccagatctcatgagaattcactcagtatcatgaccaaggaggatggggctaaaccattcataagaaacactgctcgcaaaatccaatcacctcccaccaggacccacttccaacattggggattacaactgaacatggggtttgggtggagacacagatccaaactatatcatggaggtaggcatgacgtagccaccatcagagaggcactgagccatgctctgagagttccaaagggagaaaccacatttgtgtgaagacagtggcagcggaaaggggcaaagagggtgggatcagagatggctttctgcaggagcggctcagccccttgaattcattgtgaattgcacatattacgtactactaatcttccagagagggtagtcattcttcttcccttgatcaattttattgaagggatatatgggcctgtggaaagttgtggatgttgtctaattatactttcttaagaacgttccaaaccaaaaatgattaaggtgagtcattagattgaggggagcactgttttgtcgcaggcagtgaacttgttcagaatcacatgcttcattaggatacatgagccctctggagagtgggcttttctcactttcaataataatcttttattaaaagctcagggagaatatacagaaagatatccaagtttagagagaatactaaattcttctaggtaatgaaaatccaagatggtcctcataagccaagcaggaaaatctcataaggcagagcaactgggcagaaaaatggaaaaagaagaaaactgcttgcgttgttttaacagtctgtgattgacacagcacccaacaccattgccatcccagacctgctgtggcatttctaattccgctatgctcttggcaaagcactaacctcatataagtccagatggtggttctcagacatgggtacctggaccaactctttcagactcattaatttaacagggcgggggcagacaggctgttaaggcacagatcctgggccccattctccacttactgaccagactctctggagtttgggcctgggaatctgtattttgaaccagaacccttttaattctgatatgcagacagaatctctccctgcagcagaattcacagcataggtaacacctgttctatgagaattaaaagaaggagcggaactgaaaataactcaggaatgtaagagtaaattgttattacctaatttgttataagtctttattttgctggttgagacaatctttggtttctgagtaagaattttctgtaaatcccactgtttatatgataccacagtgaggtagcatcaaatgtcatgtatcgcataatcatacagtcacctactaaaacaaaatactgttttaaaacagctgccaaatatctacatgcttaacactggaaggctcctagtttcttaaatgtttttccttctgggatttggcagtttagagttacagttttccatctgaattttttttaatgttatttactttgcagtctgaactggctttgatggctatataaagacttattattctttctaaaaaggaatattgcatctcagtaatctataccatcttttcaaggacctctctgtaataccattcaacctgctaattgcagacttttaaagccttgtcaatagagtcgctaggcaatgcagtcacacagagcctgtttatgagcagtcaaattggacacacacacaaaaagattgttacctatcagatattctttttacattttggggagacaatgtagttcttgtatttttttcattctctaaagaaaatacacacattaaaaattttaatttttttaaataagggaaatccttgggatttatccagtaatttcagcatctgtgggcattactcagacattttgttttgcatattataaggctttgaacggcaatgtccttctatcctagcagagatggattcactgctttgaggaatagaactgcctgtactctaaaccagacagaaatcaatgctttaacccaaatgaatgagtggaaaccttgttagccaaatttgcacaagtataaattttaatactagaatatactgtagaaatgacaaaacatattgctcagcataaataacaaaatcttgttattattcagaacatctctttccaaagcgtatgataattttatttatgctttttcatatcaaccgcatcagcctgccccattttacacatagaaatgtgaaggagaaatcaaataccttgtgtactggcactagcaaggcaagaacatgttggcaatattctcttgcgggcgtcataggcaccatgctgaagactagaacggcctgtactttccctggcctcagctagctcgagagccacgatctgaatgaattaaagccatttctacctgtttggggtgtgctatgcagaattcatagttctatcgccattttaatagtcagggaaaataaaaaagattctttccgtgagcaaatgaaagcagctgagcaagtcagggcccgtggccagaggctgggaagtaggtctcctttcttgtctagtgcacctgtctccacaaaatgtcttcaacacaatgctcgaaaacaaatggaatattacatatttatacatgtattcaatgttcattaatagttgcaaaagttacataagcccactataaaaattcaaacgataggaaaacatcaaagacaaatatttcttaaattgcttcaaatcctaccatccagaaaccgatatttcattaacgtctaatgaacctcattgcagtcaccctgtggatatacacaggaagcatggagagaaaggactccatgtgttcccactacccaagctatttttttaagccagagttggtttttaatcaacttcattgaagtatatgtacaataaactgcatctcttattttattttatttttgagacggagtctcatcctgttgcccaggctggagtacagtggcgtgatctcaactcactgcaacctccgcctcctgggttcaagagattctcacacctcagcctcccaagtagctaggattataggcatgcaccaccactcccggttaatttttgtatttttagtagaggcagggtttcaccatgttggccaggctggtctcgaacccccaacctcaggtgatccacccaccttggcctcccaaagtgctgggattacaggtgtgagccaccatgcctagcctaaactgcatctctagagtgcccaattccatgagttttgactattttatatacctgggaaaccagcaccacaatcaagatgcagaacacttctatcatccaagtaattgctcatatcatgacccttcacagcacatcccactgtccactcccagccctaggcggcaacctttgaaatgttttcagttgctatggattagtttacattttctagattttatataagtgcaatcacacaattagcacaataatagaataatcatgcaatcaatcacactcttttgcattggtttctttcacgcaaaataataatttttagattactcatgttgtgtatgtccatgattcattcctttttttagagatggggtcttgctctgttgccaagactggagtgctgtggcactgttatagctgtctgcagcctcaacctcctgggctcaagcaaacctcctacctctgcctcccaagtagctgggactacaggcatgagtctctatacctggctaatgttttgtattttttgtagaaatgcattcttgctgtgttgcttaggctggtcttgaactcctgagctgaagcaatcctctctccttggccttccaaagcactgggattacaggtgtgagtcactgtgcccagtcaattcattttttttcattgctaagtagaatccctttatcttaaataaaaggtattgcatttgactttatttgaatttaacagaagaaatgtttttgaaatggaaagaattgcagaacttcacatgatagtgtccttatcacaagaaatgttagctcttaaagagccctctaaaatgaataacaaatgactatgaaaaattatgaaaagttgtagctgagcatttagatgtttgacatttttaagctatatgtgttaactttacagtatctactaactcccttctatgaaatatgaaggaattggtatactttttcccacatgtctgttttatatgatatatttttttaccattatcaatatttataaaattacattttgctctgtaatttccactattgtttattttaattcaacttttaattgagtccagtacttattgactctacattttcatataaattttataattgatttgtcaatttacaaacacacatacacaaacttgttggtattttggttggaattctactcgctctatggattattttatgttcttgtggtcattatatgcataggttttgcacttgttcccctctgaaaattactcatccctgagtggagccaactatctgcctagtaccgtggaagaagggcaggaatgagctggggaaatcctcagcttccaatttgttgactcaaacattctctcaccaattctaaggagcacacctgtattagtctgttttcacactgctgtaaagctactacctgagactgggtaattataaagaaaagaggtttaattgactcacagttctgcactgctggggaggcctcaggaaacttacaatcatggctgaaggagaaggggaagcaaggcatgtcttacatggtggcaggcaagagtgtgtgagaaagagtgaggaagtggcacacttaaaaccatcaactcttgtgagaactccctcactatcatgagaacagcgtgggagaactgcccccatgattgaatcacctccttccaggttcctccctcaacacctggggattacaattcgagatgagatttgggtggggacacagagccatatcaacacctctttgattttgttttccggaagttggtaaagctcacactgagcaaagcccatgaagctccaggccttctatttgggatctggccattgctgtctgccttccctccttcacttcttgttacctatgacaatgtctttggtctaggagattgaatatcagaagtcaatacaaatgtacatcagcataacttctccatcaactcctcttttgctgttgttttgtgttgtcaaagtaggtcttgaaaggaattccttgcttctcctgtgcgctgggcacatcttgagacctcttgctctaattaaagaatcactgagtctgtgtttacttactaaacaaacaaaaaacccaacttgtgtgcaagtgtgtgtgtgcatgtgtgtgtgtgtgtgtctgtgtgtgtgtatgtcccactttgttccaaagaggatttgatggagcttcgaagaatacatacaacactaaagaaaaagaaaatgaggactaatggaaaaataagaaaaacgaggtgagcatagtaaaggccatacatacccaaaatgtatatcagagatgggccacaaatttggccaaaacgtttatcagacacaggccacaaatttggccaagtgctttctagcaactaatacaaaaactggaatgggatcttttatatgaatctatatccacaacttaataagtcaattagaagctcttctttcaagaacctcaggtgtgaaagggagaacagagaaaatctaaaagaatgtagaattaagaaagagtttttcaattaggaggcttgtacatgtttttagataaaaatgaaaatgagtgagaagaaaaaggtatgaatgaaatgcagatatgtagtgctatatgcaaaagaagcagtactgaaatggtgactataaaccctttttcttcattatatcaatttttaaaaatccagtattgactcattttgaaaagtaagatagtttttgataatctatcaactttaatacagttgttttattattttggattggaaaaaggtataagagtaaacagtatttgtcacatatgtttctatatatttctttatatatagcgttttctttcacgtctattaaatagcaacaagtgtccaggtttacattaagcaatatgcactaaaacaattggtgcataataaatttgatgtatttgatttgttgtagattatatactctgcacaatctgacacttggtagagacgaggaagtctctgtcccaaggaattatttctctgaattcagcagtctgatttgcttctttaaatgacttaatgtgctataaatattaacttgtctaaaagtttaaggcattttcacacattcctcccctccccctgctttttttcctagtatagcaatcaaggttggcttcaaatattattaatttgccaagtatgtatctgagtcacataataaacatcactttgggaacatagcaatgttcatcagtgaacaaataaaggcagtgattccctgatgtcagtatgccactggatcaccccaagtccaaaaggaaggccaccattgttccaaaatcaggggcaggttaagtgggatcaaaatgactccacttacttttcccctccctggtaatccagaccaggttgaaaataacctgtatccagatttgattcagagattctggactgatatgtacaatagacttctgtgaaatgtcccaagtaagaaattgattcggggtccaggcacggtggctcatgcctgtaatcccagcactttgggaggccgagatgggcggatcccttgaggtcaggagtttgagactagcctggctaacatggtgaaaacccatctctactaaaaaatacaaaaattagctgggcatggtggtgggtgcctgtaatcccagctatttgggaggctgaggcaggagaatcgcttgaacccaggaggcagaggctgaagtgagctgagattgtgccactgcactccagcctgggcaacagagtgagactccatctcaaaaaaaaacaaaaacaaaaacaaaaacaaaaacaaaaaaaaacattgattttgatccagataatctctcttttgtttttgtaatttagactggtcaacacccattgcttcattctagctattttaaaagtttaactatagttgctatgatgaactcattatgttgacaaaacaaatcacaattttcccttctattacttatatatgctttgtaaaacaccacttttcttgtcctagaaaatgttataaaaagatgacttaagggaagatttatataaggcatagtgtagtgtctaaaacttgagttcttgtccaattattgctttctaatatttcaatcttctgaaatgactgagccatatttggtcttaggtttgcaattctatttctaccaggagctagcctcataactttacgtaataataataatgatacaacaataaattttaacagcgatttacagttttaaaatgcattcacagttgtcatttcatttgattcagcattccacagatattaattgagcatagactaagtgctaggcagttaggcagggcagctgttattatgcccatatgagaaaacaaatacagatgttaagtgaagtctctaggattataccactgccaaagtggggaagccaggaaatgaacctgggttccctcttgagaggtaatgtagtgtggtgcagagattaggagcacagactctggaaccatgctgcactggcttagacaccagttctgccacattctagctgtttaacctcgggcaagttacttcacctctctgtgctggggtctgttgtgaagagattaagaatattcacaaagcacttagagcctggtaggtagtaagaactaagtaagtgtttactgttattatttggtgttcaggacagtattgtttttggcattatgctacttctctctttatatagtttgatagactatctcctctttctttccagtggagtttttctgtattttgtaactgtcaaattcatttggcaaaatcactatctatctgtcatttggcctgtatgactaaaatggtctatttggaataactgggctttaagaaaccacccccagcttatatactcattttctttctttctttctttctttctttctttctttctttctttctttctttctttctttctttcttttttttttttttgaaacagggtctctctctgtcacccaagctggagtgcaatggcacagtctcagttcactgcaacctccagtccccagcgttaagcaatcctaccaccttggcctcctgagtaggtgggaccccaggcacataccaccacacccagctatttttgtatttccatatttttagtagagacaggagtctcaccatgttgcccaggctggtcttgaactcctgagctcaagccatctacccacctccgcctcccaaagtgctacaagcatgagccaccatgctcggcctatattctcattttctagaatgctaagaaatgaagctgatccttatgtgaagagatgtagtgagaaactctttgaagaaaggtctagttaagtcttggtaaaatagaattgcatgaaaacattttcaggataatgtggaaggatttcattattttttcctacatatacacgaatatgagtgtaatttgcaatttctgaaagaccagtggtttctatgatcactctaaaattacctggtagataaagtaacatgtctgacagttggacttctcccagaaattctttattaaagcttctcaattaatacaagcacatttttaatctattgttatttattttaatggtcctagaagaaaacatttatttactccaaaaagttaaacactgattacatgaatattggctaacagtatctatttttatagtttaaattaaattatcttacttaaagtatagtagaggggtttgcttagtccatgagataaaaactaaaagcaagccaaaaaaaaaaaaaaaaaaggaaggaaaacaaaaaaaaaacaaacaaaaaagtgttgaaagacttttagattttcttcttgttaagcatagtttcatttgttcagaggcaaattattgatagcattttattgtgaattttcatcttacagagtttaaacatcttccagaacctaaataagcggcagtttgaaacagttattcatttgttcgaggtcgcaataatagcaactgacctggctttatatttcaagtaagtacataactctgcacagtggaatgccctatactctgtgtggttttaccttccataaattatctgttgcattaatgttaaaaggcatttattcacacacatacacacacacagacacacacacacacatacacacaaaatttgctctccttttggattaccaagtagagtatcttcaagacagatgcctgccagtaaatttactagacctctgggaacatattttaaaaacataagctcctaatattaagtaggttgctctccgaacaggtttgaattgcagaatgtgcagccaagtttgtgccttgtcaaaagagtgaagccaagagacctctcaaggtggctttttgtccaggtgaattctctatggtccagaatctggcattttaatgtttcagcctcagaaatttaattctgtcaaagtctgggagctgaacaattttgatggcattgacacacattaaccaaacttacaaaactgagtcatacgtaacagagagccagcctatttacaacagtaatattgccaaggagaccagatactcccagtatctccacattttctcataagtgaactataaagttgcttgatgaaaatgggttagaacaagatgaactagttataggatggaaatattcagtggcttgggcattgtcaaattatgcctttctgatccttcactaaatatttatttattatttattattattattatatgtattattatacaggtctcactctgtcacctgggctggagtgcagtggcacaacctcgggtcactgcaatctcggcctccaaggttcaagcgattctcctgcctcagcctcctgagtagctgggacttcagtctcccaccaccacatctggctaatttttatatttttagtagagatgggtttcaccatgttggccaggctggtcttgaactcccgacctcaactgatctgcccacctggccctcccaaagtgctgggattacaggtgtgagccgttgcactgggcctgaatatttaattattaaatagttcaatgtgaagacaaatactaagaataataaaatggatatccaaatatctatagcctaaatttaacaaatgcgaaattttgccatatttgcctcagattttgctttataaggagaaaaaaactagtgatgcaattgaggtattccacccctactccactatgaaaaatcccttcccttcttccacaaagatatcaccgtctgacgttgatgtgtattcataatttccatccatgtttttatatggtattgttgtgtgttgttttttttgtttggtttcttggtttttttgcgacggagtctcactctgtcaccaggctggagtgcagtggcgcaatctcggctcactgtaatctctgcctcctgggttcaagtgattcttctgcctcagcctccagagtagctaggactacaggcacacgtcaccacgcctggctaatttttttttttttttttttttttttgtattttagtagagatggggtttcaccatgttggccaggatggtctctctatctcctgacctcgtgatccacccaccttggcctcccaaaatgctgggattagaggcgtgagccacctcgcccaacctgttgtgtgttttcaaattgtccataggtggtatcatactgtctgtacatacctttctgcaacttgctttattcatgcaacattgtgtttcaaagatttatcattgataataaatggagctccaatgcatccattttaactgaatagagtattcaactgttgaatattcataattaatttacccagtcttctattcatagacatttcaattgtttctaatttttcatcattgcctacaatgctaccttgtatgtccctgtatatatatgagagtttctctaagaaatgtaaaagtgacaatgctgtaggatttgcatgtcttcaatttcatgctacattacaaaactgcactcctgagaagttgtgccagttagcactcccacacacagtgtgcaagagttccagctgagtgaggtggctcatgcctgtaatctcagcactttgggaggccaaggcaggaggatcacttgaggccaggaatttgagaccagcctgggcaacatagcaagactgtctctacaaaaaaattaaaaaattagccaggcatgctggagcatgcctgtagtcccacctactcggtaggctgaagtgggaggatcccttaagcctaggagttcaaggttccagtgagctaggatcaagctatttcactccagcctgagtggtagagcaagattctgtctcaaaaaaaaaaaaaaaaaaaaaaaagaaaaagaaaaagaaaagaaagaaagaaagaaagaaaaagaaaaataccacatctgaagtactcttgaactcagcaaattgaaattttattttgctaatataatgagtgtgagataatatcttattgttcaaatttgtagtttcttgattagcagtgagaccagctggacatccgtgtgttttgggttccaactttttgttggctatatgtgttgtgatatcttatcatagtttggggcctttatttttaggttatggtctcttttctcatatgtaattttgtatttactttcatttttaaagagacagggtcttgctttgttgcccaggctggtttaaaactcccggcttcaagcaatcctcccaccttagtctcccaaagtgctgggattatagatgtgagccactgcacccggccttatatgtaactttttcgttgtaatgtattccaagttacctgttttgttttgtttttccctctctctctctctctctctgtatggtttgtgctttttctgccttaaaccctttctgagccaaagttataccaccattctctgctctcgtattttctggccctgtagactttgctatgtggacatcacaatgcaaagtgggaacgtgaaatctgaaaagcatgtatttaagatattttttctctcttttcataagctaaaattgttgctcacagctgtatcttttctaggaagaggaccatgtttcaaaaaattgttgatgcctgtgaacaaatgcaaacggaagaagaagccatcaaatatgtaactgttgatccaaccaagaaagagattatcatgtaggtagttgaaattgtatttctctcttgttttttgtaaaaataacttattttgtacttatttctattttaaaattttttgttttcttcctaagggcaatgatgatgacggcatgtgacttgtctgctattaccaagccctgggaggtgcaaagtcaggtgagtccagttaagttttcttttctgtcacactgtcaggtactgcctaggtcccatgtaaatgtccacctaaagatctcaggcaacctcagaattctgaaaaattacaaatattagtgagacagtaggcaatttgattaggccctagaataaagcaaatagaaggaactttggaaggagaattctttcttgaaagaattctttaacattgaaacactgtaaataatttatataaaattatccaagaaatgtctgagtttttaaatagaggagtgtattagcctgttctcatgctgctgctaataaagacatacccgagactgggtaatttataaaggaaagaggtttaatgaactcacagttccacatggctggggaggcctcgcaatcatggtggaagatgaaggaagagcaaagggatgtcttatgtggtggcaggcaagagagagcgtgtgcaggggaactcccctttataaaaccatcagatcttgtgagacttacttaatatcactagaacagcacgggaaagatttgtccccatgatccaattacctcccactgggtcactcccatgaattgggaattatgggaactacaattcaagatgagatttgtgtggggacatagccaaactatatcaatgaggtaagtcagaacaagatcaggatgcatcgttagtgttttcctctatcaagggtgtttttgctcctatagtctcttcttcaatgtgctgtgaattataagaaggcactgactgtgagatgatgtctaaggttgccttccactgaagttcttcccccaccttggggaggcactagtctaccacttgctttcttactaattggatgaaaaaaccttcctttttcctccagtaatttctagggaaacccctaagcagaagagagcccagaattaaatgggtttaactataaaagtgggttgtatctttttaaaaagatagaataattagaactcagtgtaggggagaaaaaatatctatttctcacccatcctagcttcatgactgaggcccctataacaaaagacagattaacaagagaaaagcgtacacgtttatttgttttacatgtaatacaggagccttcgtgaggaaacaaagaccctaagaaacagttaaacttgtatgttttatgctaggttggatgaattagatagtcatggagaaatagaattcaacaaagagggtatgatctaatcgtgaggcagcttagcaaggccgatttgttcagattcttcttggcatctttgtgtctctggctcctttcctccaggaatagggagggcacctcttgaatgaaggtcttatgatctgcttcaggggaaggtcagaaaatccttacctggttttatgacctacttcaggggagaaggtcgggggaaggtgagactgatcttcctgctgctttagtttcctcaaattccgtcaccttaaaatatttgggggcagggtgtcctgaactccgtcaccatcaagtccaaaaccaaatgcttcctctccttccacctcgacatgcctgctcttcttcctctgttctttatcgatgaggtcacccaagctagaaacctggggtcctgcttgagcttatctccctcatttcaaaatcatttatatcagcctcgctagtacctcagttctgacttttatcagaactatggtagcagcctcctaatagatgctcacatcaactccacaagtcatcctctgacttgctgccaggatgtctctacacagagctcaactcagccattctactccttaaaaggctcatactccccattgccagaggtttccaacttctttcccaaagaagtaaagtctattttctcccaacaaaacttgcccaaagatcactttataaaagagaaaaaagcaaagctactttagctttcatctctcttggtctccaccttcttgggccctagagcacttcaggggaaccctagactccaagagtaaacagcactggcctagagaatcaaattcaagcttcctggcaaaatttacatggcctgtcactgcctgtcctcaactcacactcccagcatcaattcccatcaccttctcccatgtcattgcttcacactctaagcctgcactcacagaagctttgtacgttccattttatctcggcaaatattcttcccctcctcttttcctggaaaattactcttgttcttcacaatacaacataaatgccacctccttccttcatgaaacttatctttactcccttctccctgacccatagcacttacactattattgttacagcacttaccacactgtatacatgactgtcttcgctagactctgaacattttaaagaaaaagatcaccccttattcctcttggcaagcctggctcatgccaatgtaaaggcagctagcaggtgttcaatgaacttgataaatgtttttttttagtgatataaattaatgctggaatatcctcacactgtaattaggtaaagctacatactaatgggtgtatgtcacatgtgcattcacagacatatgctagatgctaacagatagacaggacaaagaacaaccggcgaagtgttagaacttgaagcataatatttaatcctcctatttctccttttcgttggtgagaagtggtggcaatcgtaaatgggagatagatactcctagaataagcctagaacactgaagtaggaagaaaaagctcccctttcgcatttcaatataatctgtaaatgacctctttttaaaagttaagagcatacggtttgatagcacctcaaacattgactgtaaactcgatccttaaatgtcacttgtactaataaaatgcaagttctctattcataagtggatttagtgaaccaagcctttctcatttgcaggtagcacttatggttgcaaatgaattttgggaacaaggagatctggagagaacagtgttgcagcaacaacccattgtaagaccttgacataaaaatgtattacttattaaaagttatcaggacaggccgggcgcggtggctcacacctgtaatcccagcactttgggaggctgaggtgggcagatcacgaggtcaaaagatcgagaccatcctgaccaacatggtgtaaccccgtttctactaaaaatacaaaaattagctggtcatggtggtgcatgcctgtagtcccagccactcgggaggctgagacaggagaatcacttaaactcagaaggcgaaggctgcagtgagccgagatcgtggcactgcacccagactggagacagagtgagactctgcctcaaaaaaaaaaaaaaaaaaaaaaaagttgtcaggacaaatcagtctgttttgttcatacatcttagaaacctgtcttaaaggatttatttctctttctagcctatgatggacagaaacaaaagagatgaattacctaaacttcaagttggatttattgattttgtttgtacttttgtatataaggtaagtaagcaaattatttgaattaaatacataaacatttggatgagaaattttctttcaaactgtcaccaaaatttagaagtcacccatacggaaagccattggggtatcactgtttctccaaagcagtttgaggttttaccctaatctcattcagggctggaataaaaggagggaactcagatgtgagcgaactgaacacttccttaggcaggcagtaaagacagcacgtgtctctttcccaaacttcataggcccgtggttaaacttatcctagcagctctgagtgctgtaacaattccttacagctcactctctgcatatgaaagatcctgaaaattaactgtatgatttatgtagtttctgacctaaaattccttttaggagttctcacggtttcacaaagaaatcacacctatgctgagtggtcttcagaataacagagtagaatggaaatcactagctgatgagtatgatgcaaagatgaaggtcattgaagaggaggcaaaaaagcaagaaggaggagccgaaaaaggttagatgggctctgtttttgctccctgtaatgtagccagaagctaggctgagcttaatggcatgtgacaaagccataaagagtcaccacaaacagaaaacctgctttactggtgcagactgatcattttaacaggccgattagtggttttcaggtccccctggccctgccacagacaacatcttatgtataactccagatcgaattgaccggtccagttgaagtagaggttggagctaggcttcttcatcttgctagaaggtggctcctctgcagaacactgggtgcttagggataatatgtaaactacagaatctgggggattagagttaggtgagaaaaaagtttttgtcccaacattatgcattagctgtgagaccttgggcagcttgcttaacctcgctgagtttaatattcttctccatgtaatgaggtggttttacagatcttcagcttaaggaagccctacatgtagagtaaggctgaaattgccggtctcccaaatgtctcattgggagatgtttttctggcatgagattcctgtgccattttttttctggcatgaaatttctattcctaaagtcactttgtcaagtttaatgttgtttttggattcttaaaatgcttaggattaactattagttcatcagatggcccaaacatcattttgaaagtggaatgctaatttctgtcttgaaagtttatcactctgaaggttttgtaagcaattgttattgcttaacaaagaaatcatctctatgtggaaaggccctgacatgttccttttaggtggctctattgcatttagtgaaattttaaataattcataggagaaaatatttttcttaacaaagttaaggatgtccttcagaataaaagcaggagtttttgactccttgatatccattcacttatgtatttatcagatgtcttctctgtataaagcccggtgttaggcaggccctggggaaagatgggatcctttatcttgaacaatttaccatttggtgggggaactaaacattgtgaaccaatgcacaattaacgatctcgaagaaggcactagtgtgcacatgggccatggagaaggctttcctgaagaatgcttacgctaaccacagaaagcaggcattggggaggaagagtaagaaaatatgtacaaaggcttggagtaggaataagcttggtgcaattgaaaaatttttaagctgatatagctggagtctagagagtaaagagtgcgaagtacatatgaagctggtagtgcaggtagctgccagatactgtattgccttgaaggtgggctaaaaatgttcatgggtcatttgagagatttaaggtaagatatgatttgcatttcaaaacaataagtgatttttaccaagcaagtgaaaagtgagggtatttcttagtactattagatttaacctttatctcaactttattatgaagagatgatcaggtcctttaagtgacattggatatggatctgtattttatttgcacaaaaatttacttctgagtttttttgctactacatagagaattctttgtggactaagatcattattttctatcaccaggcatggagctttgtgcatcaagctcagatttccagactgcattgtctcagtgagaaactaagatgttaactggccaaccattgatcagattctgttttttatttatttaatttatttttttgagacggagtctcactcactctgtcgcccaggctggagtgcaatggcatgatctcagttcattgcaacctgtgcctcccagattcaagcgattctcccacctcagcctcctgagtagctgggattacaggcacatgccaccacactcagctaatttttatatttttagtagagacagggtttcaccatattgaccaggctggtcttgcactcctaatctcaagggatccacccgcctcagcctcccaaagtgctgggattacaggcaggagccactgcacctaacccagattttattttttgaatggaccaactctgaatattaattcaagtttttacatggtcaaacccacagtacttgctaggttaaaatgactaattagtctacaaagttgacactactatcatgggaatgttagaataaaaacactgtatatccactaactcctaataatattgctttccttgattttactagctgctgaagattcaggaggtggtgatgacaaaaagtccaaaacatgtttaatgttgtaatattatctaactggtctaaacttcaaatatcattttacctttgaagaaaaccagaaaacattcaaaagaacttcaacaaatcatcacgtaacaggatcttcagaaaaactaccctgtgactatgaagaaaatatatattgctagcccaaaaatcccaggggcaaaataaagttcaacaaaagtgcaaaatatgacaaaaataggtacatttttggtgccaatttattttaaattaaaaaatatgcaatcctgaaactagtcacaaattcttttttaaaacattaattgtatttatttgctaaggctgctataacaaagtaccacagactgggtgcttaaccaatagaaatgtattttctcaaagtcctgggggctggaagttcaagatcaaggagttggcagggttggtttcttgggaggcctctcaacttggtttgcagatggccatcttctccctgtgtcttcacatggtcttccctctgtgtgtctgtgtcctaatctccttttcttataaggactccagtaggactggattagggcctacccatgtgacctcattttagtcttaattacctcgttaatggccttatctccaaatacagtcacattctgaggtactggggattggggcttaaatatatgaaatgggtgaggggtgggggagacacaattcacccataacattcgtaactgtgattcatacctcaagccactccccgaactaaaatctctcaacatcttaataaaagagtaaacgcagtatagaatgtatagtgttgtaaatatgatatagaaaataatgatgtcattttattcaacgtcattccatctgaaatgcttatctcttttctctacttttacccttgataatagaatgatgaagaccaaactattttttggcaatatttattaaaactatgcctttgacctacactcctccttcaaagtttgaaatcaattattttgggtgtaactaagaatattttttacagttcagaactattcttttcattaaaaagattatcaatgcacaagattctaactggataatcataatgcaagttaaagcagctaatgaatattatgcgttaagaagcatgtgattggattatgcaagaaccttatcaaaaatagtacagaaaaacttcaaccaagatgactttctaaaaatgattaatagacctaccaggcattctaaatattaaattgttaagacaaactaagggcaatcaactacttcgactgcatggtatatgtctgtctggatattcgagaaatttaagatttcttcttttacttatctataatcatagataaaattagaaaatagaataatatagttatgccatatattttatcatagaatttttttgtcacaagctatctacagtctaaagaattgaacatcaatgaacctatatattttgtaatagacaagataatgttcaattttgagcagccaagaaatgaatcgccatttatttttataagttaggtacttagaattgtcagactgcttctctcacattagaatgtaaaatttatgaggaaagattttgtctattttgtctgttttgttcacagctctatctcggcacctagagcagtgcctggcacaaggtaggcactcagtaatatgaatgaatactatgtgaataaatgttacaacaaacagatataaataaggtatgacagtaagtcatatgtacactcaaatgagtattgtttattaaagtaatcaacttagctaagtgatgcatgctcccttatttccattgcttaaaataattttgaaattccacttccagaagcactattattttaaaaaccacgtaagaaacgttattcctttagccctatgtaattttagaccccaaaacatcagtcagctcaaacaacttcccctccttagtcaccagaaattgtattgagggtagagatgtccaccactgaaggtctgccaaatacatgaactctgcataagagcaagtataagaagg

SEQ ID NO: 12574 - DNA, 72843 bp, Human
  misc_feature (1)...(72843): n = A,T,C or G
atcataacaaaggcatcattcaaattaggcaggtaattactaccagaaggacaactgggtgctcgcttgctcatccattgctttctgctttaaactcccgaggagtcgctgcctggagacactcccgcccggactgcttctcgggccccattaaacggctctgaaatgaactgtgaagttaccatttgtgggcggagagcgctggggccctgcggacggaagaccctggcttgaccggactaacagtgtcgccgaagcaaagcagcccctctgggtaggctgtctgtctcgcctcctaccctctggggcaactagcctaaaaacccggttctcaacttaacagcatgtggcccagcacccgcttttgccttttattccgcactctgatttttggggggatcgtttgttcccgctcattttctacaaacattacggtatcctgttagcattccgaacaaggggctgttcatatatttgccttcaatgatttcctgaagggacatgtggaagtaatagcgagcggtgcagtcacccaagctgaagatgcacgagagcgggtcgcgtagaagaactgcggcaatgggacccccagcgcagccccaggcgccctgttttcgaggctgacatcccaagatcctgtcctggttaggcacagcaccgcgcccgttggagtacttctctgtgactctcccctgtccactgcactgtgtccaccctcctggtgaaggaggagacggctgttggacatgccagtcccaacctggccactttggccattttcagagtgcgtgtgttggggtggggttgagggagaaggatgaaggatgacccccaaccccaacaggagaattcaaaaatcagagagcgatgaaggtgaacgcgctcccctcccccgctgtcgctgggaagccccactctgcccaggtctggttcctggagcatcagcgccccctttccctcgccggcaggatcgtttcctcccgacactggcctctcgccttgggcgcagggtttggggctcagctgtcaattccaaggaattcgtagggttcgacccacgcggcgggagggaacggagggagaatcaaaaggcatcctcccccacgacgcggaggcggtggtacgattcctcaaacgcccaagcttgagctttttttgtatgcgagatagaagccagggcaacctcgcccagataaccccgaaaacaaaggcacgaccagataagtgacttcaagggagtaaaggtcgttctatcggagaacgttccaaacctacacagaccctcttttctttgtaccgtatttcagaccacccagtcttgtacacacacacacaccacacaaaacaaaaacccatcattgtcatattggactcaacagtttgcccaatcctattaaataactagcaactatatagcccttcccctaaaagacccctagttcaaaacggcgcaaccgcttggagatttctcccgagggccctatttctcgttgggccgagtttgtagaagggacatttcttgattctagatttatattctctctgggtattaaatgcaattttgtatgttccttttcttcttttcaaagagaatacaaaactatagcagtctaagaaaataaccccaaaatggggaggcaaactcattctggaaatgatgggctgtttgtagtttcacaaaacctctttcccggcagagcaccaacacctcccccttccaccaccccccatcccatctggtctgcttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaaggtaagggaaaagaaaaaatgattttttgtttataagggaagtccctgatcagactctgggactggagaaagcgaagtaacttcaaactttgggcgacaagaaaaaaaaaaaggagctggattccagttgtgtgtccagagagtaatttttttttttcggaataaacttcacttggggacgggtgggagataaccatagagttagaaagtctaggtattttttttaaacacacattttccagacctatttttaaaaacaatgtttttctaacaaccctatggcctcccaaagaaattgtttaggcttacatttttgaggtttcttttgggagtgggggtggtgttcgtgaatactgggccgaacaccaaggaactgggggtggaggcagaggtgtttgccctcttcttggcagtgggtcctggaaggcgacaggttttaaatgagtgttttcattcctcgcctgcggtttggcgggacagcgctgcagcccatggtgtggagcgcggctgggggaccagggggaggtggggagaggggagcgtggaggggagcgtggaggggggcgcgcgaaggggttgcggggcgcaggaggcgggctgggctcggctggagaccggacctcggtgttggcctacagcacagggagccggccgaatgcgcgtgattactggacggcgctgctctgggagagagtcggggccagatttggcgcggcggtgaggcggctgcgggacaagcagaggcgcgcgggcgtgggcaagggtttggggcgctctggagcggtttgttgggtcagtgaggtgccagggagagcgggtgcctgccgggcagtgtgctcgggttgcacgccctagcgcgggggcgacagcggcggcgcgggcgggcggtctggaataatgacaaacacatttggccctgagtgaagaagtcgtcgtcgcctcgcattccagcaactgggatttgaggaatttcgaaccgcacaccaaggggccctcattgtgctccgtggcccccgcccccgcctgtcttcccgcgccccctcctcggtggaatcatttctgcattgcccgggggctctgctttcgctcagttctggccgcaggcaggaagagaggaaaggtctccaggaaggtgccgaacttcttgtgaggaagttagggacgacttggaactggggaaacttgtttgcaggtaagacagaaaggtgggaggtaaaccatattctccctccgggcacccgagccctggacaccccctacccggcacccttctccgcgcgggggtgcgtggcacttgccgtctgagctcgcccagcgctgctcggtcctctctagttggccttttttccattcctctccctgccggcttcagagccgtctgtgcgtacttctccttcctctgctgtctacccccatggaaaccagatttacacacgaaattaactccgcccggctgcgcccagggagcgggcggcgtccatttggcattgaatatgtgggatcagctgttctattccgggagggtgtcggccaggtcggagcgacgagtgtggcccaacccgagtacgttgccagagggagccaggagcctgggccgggccaggtgtgcgagagctgccgatggcctggcctcgcgtcttggtcgggaaggacttgctggcctggcaggctgtgcgttgtgcatccctcccgcagccagagcgccggtcccgcacttcgctccccgaattgtgctaagacctcaggatgtgcgcaaggagtgcctggaagaacttgccactcactccatcttcctgggtgggaggcaagcatggatggggcccatatcaggtccctaccgccccgcgtccgaaaagccgcgggctgggcggtgtgggaaatggctttttggctccgaggccaaattgctcaatgttttggaccgactcgcctcgccgcggtcgctcctgacaagaactagacagatttttggagcagggagcatccagggcaaacgcacgacagtcctccgcagtgcatctcaccggacaaacatccccggagccacaggaggggaggaaggggctctccgggcgtgcgcacctccccagccgccgcgctgtcccatccccgacccctaatctggtcaacctggaccccggcactgctgaattgcatcccctcttctccctttctcctcggcctcctcctttccacaaccctcaagatgaggaggccctgcctcgactccccgacaggcgcaaggccgaccaggctcgctttgacgccctggtcaggccctgcttcggagcttgcagttttgggttgacccaagtgcagctggacctcgttcacaagagtgaggggaagccaagaatgaacccgtcgttagcccccggtgccctggctcttgtttaaatccttagatcgagaaggacttgaaggagatcccaggctcccagctctgcgcccctgggccagtttcctctcgggacgcggactgaggagggatgcagggggaggggcattgggccgggctttccagctgcaaacacgtctggcgccgaggcgggcccattttgtgcctcctggggacggaccgtgggcggcgcgcagcggcgggacgcgttttggggacgtggtggccagcgccttcctgcagaccccacagggaagtactccctttgacctccggggagctgcgaccaggttatacgttgctggtggaaaagtgacaattctaggaaaagagctaaaagccggatcggtgaccgaaaggtgtgggtctcagggttccccgggtctaactcgccgggtccaaccgcagcatcagccttggggcggcagataatctttcggtctcgcctggggcgcaagatgcaggatcgggggcaaatggcttctcccaacttccccctaattcgggttctgccagatggttgtcgtttgctgaagtggctcggcggcatttccttttgttttaaactgatcaatgagcgaacctgggatgggctgaaaaagtagattgtaggagggaataatgggaaacccgacttggggcgcctccttccctgcctcctactgcagtttctcggcccccgcgaaaggggagcgacaagcgcgggtgggcgcggactcttgagggggcagaggcggctatggcgcgtgtcgggcaaggtggcaccagaaggcacttttgtgtgtgtgtgtgacaagagtctcgctctgtcgcccaggctgaagtgcagtggtgcgatctcggctcactgcaacctctgcctcccaggttcaagcgattctcctgcctcagcctcccgagtaactgggattacaggtgcccgccaccacgccaggctaatttttgtatttttagtagagacggggtttcaccatattggccatgctggtctcgaactcctgacctcaggtgatccgcccacctcggcctcccaaagtgctgggatttacaggcgtaagccaccgcgcccggccaggaacggttcttaaatgccgagagggcgcatgctagctctcctcagcattcccggtgagccgctacccacggccgtgcggctctcgtgcccataggaggcgctggcgagctcctgtaaccctaaacccctcggcccctttccccccacccgcccggattctcttcccgctctcccccctctctccacacccgcccggccccctctcgggtctcagttgaaaacaatgcaaacgcagagcgtcgtgcctggggcgcagcggcctctgcagctctgaggttcagagcgcggcgcgcaggggcgcaggggcgcaggtccccggagcggctgggcatcgccgccaaccccgggacaaccaagccgccgaggacttggtggaggtgggagggagagcggaccgcgcagtgttcctctgggtcccggggtcagaagccggacagtggcgggggctggacagtccgagcgcagagcctcccgggcgaagtctgcgcgcagcactcccggctgcgctgtcggggaccaggagcctgggctgcgggcgagctagctggcgagccgggtaagattcgcggggctgtcgcgccctctagtgggctccggggacgcatcccgctttccccagccccgggcggtcggcgccgctatctcagtggagcgcagcgctggaaccccgggggcccggagcggaggctaatctgggtcacctttcccctcctccgggcagccagtggactcctcgcaggctctgtgtgggcccgggaggcgccgggtggacgagagggggccgaggtctctgggtttggattgagaatgggacgtccttgtaattcaatgtgggagaagcaggggagtgtggaggaggacgggtcccgtgcgtacttggggggcaggcgccgtcttctgcgttcnnnnnnnnnnnnnnnnnnnncgccggtggcgcgcggacagatagaacagcgcggcccgggaacgggcgtcgaggtccaggcggtccccctgccccgagggggcggaaatgctaaggtggcgagagcgtgggttgcacagaaccctagtagcgagtccggctgagcctctgcggcctagcccagcagcgtcgtcttcccggctccgaagacgtcttcccgaagccccgctgccccggcgcaccagctcccggtgatggggatgatgatggggatgatggggagatgtccccgaattctcctggggtcccgaggagatttagccattttcaacagcagttttcctatttctgcttaaaccccgcgggctttcaactgaggtcaccacgaaagctaaaagtacaacctaaggaaggaagagactggaaattaacatttggggtagtggagctcagaattcctcgcagcggcgtctgtgtcgcaacccgtggacgcacgtccttggaccaacactgccatctgctggccactcgtaagaactactgcgacccgctgtgagaatgggcttcgcggagaccattaggaaggtgctttattttttattttttatttattttttgctcagtaggaccgtaataggtgactgattttcttttgctgtgaggctacaagaattgctggaagacaacatttttatttcgtggaaatttgtgttgtgtttctccttggttgttaatgctttgcatttacatagtgaacatcttattatcagagctggcctgtgaggagggtagtgggggggcattgatgttcccgtttctgagtgaggagacctatgtcggggccttggtgacctcaagccgaatgctcaaactgctactgctactcctaaggttgtgccattaggagtcacacccgtttggtgatattcaaaaggatatgtcattttattctcccgtggttaaatatatggtgagaggagagcaggcatgtttatgagcccagattgtcccataaaaggctcctgtttaaaaacactccagccccctcccattactggaatgtctgatggagctccgggagatcaaaacaacaaaacaggctctggtagggtgcagaggtcctggtaaacacaccctctgctggaaaacagggagaagtttccaccagtgtagacctgcacttggtttgcctgggctgaagttaggagactgcgtagaaaaaggaaaatgtgtaattttcacagttagaattaacttaggagagctgaaattaactgagcctcggaaatctgaatcttgaagtcaccagtggcttttggggctgtgagagagtctcctgtggtctttaatcatgtgagggtggggtgaaattcaatattcagtggttctgcaatgggatgcactgtgcaattggtgattgagaagccaactctctggctttaggagaagaatgtcttgctgttagtccttctggaaatagagccttgcattgcctactgtctgtttacactacctttgcacattgcctttggttatagagtcatgtccaatggctctttacttctgtttgcagggcaggagatggcaccctgttaaagagaaaggatagtagctgcaaagtcatttgtttctctgtttctgtgactgtatatattggctcatctttgaatggtctttatagccacaccaggctggaggtaacagggtcatgggagtggactgctggtgtgggctgaatcagagttcagatccatgtctccaggaggtaggaggtgcagggcaagtcatgtggcttctggggcatccctcactttcttagttaaggagaagttgaaggagccgatctaaaatatcttgggagtctgcagaaaaagtcgtgaaaatcaaagcactttcaattaaactatataatttagtccttacaagaatgccacagggcaagcaaccagtcaggccttggtagtcgtgcttcctagaagaaaagactgaggttcagagagttggatagagtatcagatttgggatcagtggctagtccaatgtgatttccatcctttcttctgagagaaagcataagaaggccaagaggatggtggaaaagcacaagtcacctgcctgagagtcaacagggcggggggtctctttctcagtttgttcctctaagttatggcaaatgttttttgagctgtgattattgagaatgggggctgaagttcaacatgtagttggcatgagggaagtaattatgattgaagaaaagatttgggtgaaatctagtgttcttccctgcaaagggggttgttctcacggattcttatggtgccatgtttctcagaatttgtagtttcagttacttatatttgcacacctgactttagatgagctccagaatagcagttactaattaaggatgagcatttagagtagataaaagtggcaggaacagcaagactcactcccagagagcctcactacaggtctaataggtgaggaaattccccatgtttcccatttttcttcattacctccctgtggggcaagcactgccattattcatgagtaaactgtctgagttatagataagtaatgacatgaaacttcacaaacacgctgagcacagtggctcacgcctgtaatcccagcactttgggaagccgacgtgggtgaatcacgaggtcaggagttcgagatcagcctgaccaacatggtgaaaccctgtgctgtactaaaaatacaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagaaagttcacaaacaggcctgatttctacccagggcaaccactgttatcagagattggggtttggaatcttaagcaacaaacacatgtttattctcttccttcctgatggcttgctcagaggacctgtttccattgcccactttttttttgagacagaatcttgctctgtcacccaggctggagtgcagtggcgagatcctggctcactgcaacctctgcctactgggttgaagccattctcctgcctcagcctcccgagtagctgggattataggtacctgccgccatgcctggctaattttttgtatttttagtagagatggggtttcatcatgtcggccaggatggtcttgaactcctgacctcaagtgatctgcccacctcagccttccaaagtgttgggattacagatgtgagccaccacgcccggcctcattggccactttatatgtcagtaaataatctttcctggcagagggtccactgtatctggaggcactgaaggaaatctgggagtgtctggccagggcaaagcactgcttagagcttgcacaggaaaagcagtgagcccttcttttaagctggagaaagctttaaagatgcatctttggcaagtcttgccaaagaaatatgggttctaaatgtgataaaaccaaagacatcaagctggctctggaggccttgtttgaagtttgctgagtggattgtcagtgggaggctgatatttatatgtacaaacacacaagcattactgctaattgtggtaaatcaggctggccagcctggctctggggcccactgtgcctgccaccgcagcagtgtggaagccttgcatcccaggcacatgtcaggatcctcggaggccatcagccagccagcattgtgtgaattgcatttgggttcacagcactgtaattgtgtttctcctgctgtggtgagcaaaggaggaaaatggaaggaggaggtataatttgccctaggaaatagtcaggcaagtaggtggcacacaggggtgggatatggctaaaacactgaccttcccttgagagagaccatatggtgaagtggagagggcatggcgtttgtatcacacgaccttgtgttcaaatcctggctctgtcactggctgtgtgactttgggtcatttgcaaaacctctctgagcctcaactgccacttcttaaaatcagctctaagtaatcacagggttattcttcacaaacacagcatgcacatgcaaactttggcttagtaaataatggtttctccttctcttactttgttttctacataccccactccccttcctgtgaggagccttccacctttttctctgtgttctcttcctctcccattttcctggtagcattcaataaaacagaaatctgatttctgcaaagtaggccaccttacggtagaaatacatgattaggccccaccaaaaactttgattaggctattatcttctggatcctggatcccctccaaccaaaccaaacccaactagggctaaacacagcaatatatgaatacattgaatttctctctcactctttcttttttttaaaccagtttactcaggaatcacatgcacacatattttagcttccaaagccaatgatggaacaaattgtgtcccattaggctcactccattgtatgagttagcatcagaggagttcataccagagtgacttcatcttgaatagggcctaggtaagaagaggatgagacctgctgggctgcattcccaggaggttacacatttgtagtcacaggagagaaaggagttggtataggagttgatagatacaggtcataaagaccccagtgataaaacaggttgcaggccaggtttggtggctcattcctgtaatcatagtactttgggaggccaaggcaggaagattgcttgagcccaggatttcaagatgagcctggacaacatagtgagaccttgtctctacaaacaataattttaaaaacatgagctgggcatgatggtgcaggcctatagtcccagctactggtctgaggggcagttgggtggcaggctgagatgggaggatggaggctgcggtgagctgagatcaggccactgcactccagcctgggtgatggaataagaccctgtctcaaaaatagataaataaataaataaataagccagcaaaaccagaatgcagtgaagaagctggccaaaacccaccaaaacgaagatggtgatgaaagtgacctctggtcatccctactgcttattacacactaattataatgcattagcatgttaaaagacactcccaccagtgccatggcagtttacaaatgccatagcaatgaccagagatactctatatggtctaaaaaggggaggaaccctcagtcctgggaattacctgtccctttcagggaaaactcatgaatcttctaccgcttgttgagcgtataatcaagaaataactataggtatactcactcaagcagccatgcagttgctgtgcccatggagtagccactcttttattcttttactttcttaatatatttgctgtcattttactcttttggcttgctcttgaattccttcctgcatgaagccaagaacctttgtgacctcccaggctgaaccccaattttgagttccaccctatgacatcttttctggtgaccaatgaagggacaatggtaacctcccgttgactttaaattaaaactgattggcactgtttgggcttcaccggtgggtgagtctctccttgcccagattcaacttgctaacatttttttctcttcaattttggctcctttgtccttcctaatgttcttcattttggacagatgggaaagtggctgtgaggcctctggcttagcagcctgatagcagcctcctgttgtctgggtgccccagatgggagcacgcctggctggccacatcttttgcaacccaccttgtcatcccttctctgggaccttttctctttagtttcttttttaaaaaaaattttaaattatttatttatttatttatttttagagatagcatctcgctgtgttgcccaggctggagtgcagtggcataatcatggctcactgaagcctggacctcactggctcaagtgatccttccacctcagcctcctgagtagctgggactataggcatgcaccaccacgcctggctaaattttgtattttttttgtagagacggggttttgccatgctgcctagactggtcttgaactcctgggctcaaatgatctgcctgcctcagcttcccaaggtactgggattataggtgtgagccactgcacctggcctctctttagtttttaatgactggctgtttgacttctctgctcttcaggctgaaattcttatttcatgtttgtagtctttgccttggctatttggcaactgtttaaggcaagacacttggttttgagagttctcccgttgtgttgaccctgggacaccagggtcattgttctgtagctccaattatgttaggtctcatgcttttgggtttcactattggccaccccccagatgctctggggtttttggcatttggtgtggggacccttgttagctgatactctgggcttttcggcatttggatgctccagggtgtttggcactgacattcccctctagcattgtgggttagagtcccacccaggggaaatcttggttttgccttttcttgttttctactctaaagttatcattttctataaaaacattttcttttcttattgtcactttgtttaatgctttgctccaggaggtgggaatttgcaggggaaaataattgggctctccctatacttagaaaaacttctgtgtctagtagagatccttgttagacaaagggacagtggtgagtcccagagaactcgtcactagggtgccttttaggcaattggagcaaattcaaattagcaaactaagtttggccatttggataagtcccagttttgtcagggaaataatttgggtccagctatcttttataaaatagtgcgtttgcgttcctacattatggctagagctcaaagataaaagctattggatctttgtttatgtgtgtgtataaatgtctagatgtgtttatgtgtatgtacatttattatgttatatattgtatctacagggtaccaaattggcttataaataaaagagtgctcataaaaagagtaaataagtccaagcatttctcaagctcatgtaacttaagtttactaaaatttagagttactaaaaattcatatataactctgtataaatgtgccaaagaagatatgctcttagtgaaaataaattctttttggccaattcagatgtcatttatatgtggggtttaaaatatgaatttcgaaagaaaataaaaacaagtagaaagaaataaaaaacaataagcagtggagagagatgtgaggaaagttatgaatatgaagacgtatttttggtaaggaatgttataaagaaattttatgagaaaggatcttatatgataaattcttgtcctaaggtagaatgactgattgtttagaaaagaaggaaatataggacaagtcagaaagtccaagcatgttgtagatgacctatgtaagtcacgataaagtttatacaagagaatttattaaaatttagatgtaattagccataactgaaaggaaatttatttatttatttatttatttatttatttatttatttatgatttattttgagaaggagttttgctcttgttgcccaggctggagtgcaatgtcatgatcttggttcactgcagcctccgcatcctgggttcaggcatttctcctgtctcagcctcctgagtagctaggattacaggcatgcaccaccacacctggctaattttgtatttttagtagagatggggtttcatcatgtttgtcaggctggtctcaaactcctgacctcagttgatccacccaccttggcctcccaaggtgctgggattacaggcatgagccacctcatgcacccagccaggaaatttatatataatactctatctaaattttggtgccctatgttaaaacaagtttttcttcaagtattggtttgctttcagtaagattgcaagaaatattgacttttaattctagaatctgtttcctttgaaggcctctcagatttatatcttttccttttcccttgaaaaggtatagcctttgcaagttcaaaactgacttccctagactccttttaggaaaagcaatacagtggttgtttcaggctgtggctcaatagctaagcctttgttctttcatggtggtggcctgggttcagttcctggcttagagaatgagaggtttccagtttgctacttctgggacttttgtcatttatttattctttttgtctccatcgacagcttctgattttctcacttgaatttttttttctgtgagctaccttaagggtaatgttggatcttgtaaaaattgcttgccatctctttggagatacctcttgtgtccatggttaagttataaccttggttaaggcctgttggtttcactagggaaaatacctttaaaaaaaggcttaaaagccagagatgttggctatttgtcctggctagagtctggtattaagggatttaaaaggattttttaaaggacctctatagttataagtcagcttaattaaaaatggatattccatagtcatatttatatatatatacacacacatatatatgtatgtatgtgtgtatatatatatatttaaaagacctgtatgatttttttcttcttggaacttatttttttgagagaaagtgttttgtgtgtttgttgtttgtttttcttctcagtggactgaattatttctccattctgtctttttaccccctttaatgaccatattagaggacctaagataatttctgacagcctgggactccttgggaggaaacagaaggtgccacagacctcgttttgggagaaacctctgttttcctcatggaaccccaagagctgtaagcagagagttctccctcagaatccaaggctctgctctgtttacgtcacattacctgacctttgtgacttttgggggcatcagaaattactttgcattatgagggaacctttagcattggtgtgtattacctaggtaggatgtgtacttttagggattgcagttgcttacatgagtggttattactacagaccaatacttctttcttctcacatttaaatgaaaaaaaagcatgctcttgggcatccacctatgaatggaggatgggctgatttgctttaggttggccaccagcctttggggaacatcgttgcagtgaaatgcttggtgaaagcattgcactgtctgatcgcatagtgcacttctatgcacttctgcctgatgtcctaggctcaacacctgctacataattaagatcacttacttatcaggtttttaatcaaaatgaaatgttgctaagagttaacattatagcatatgtaattgagattactggagaaagttttacctacaagatatgtaaggaaagcaaaatgtgtttttggtaaaagattataggaaggtgtgccagtatagttttttattttgcttactttaatgggttaaaggattgttttaagtttgataggagaaagctgaagcatgagcaagttgtggaaggtatatgaaagattaacattttaaaagaaattctgtgtgtaaacattggctaaagttaaaggaggaggttggagccaagatggctgaataggaacagctccggtctacagctcccagcatcagcgatgcagaagatgggtgatttctgcatttccatctgaggtatcaggttcctatcactagggagtgccagacagtgggcgcaggacagtgggtgcagcgcaccgtgcgcgaaccgaagcagggcaagccattgcctcactcggaaagtgcaaggagtcagggagttccctttcctagtcaaagaaaggggtgacagacggcacctggaaaatcgggtcactcccaccccaatactgcgcttttccgacgggcttaaaaaaaggcacaccaggagattatatcccgcacatggctcagagggtcctacgcccacagagtctcgctgattgctagcacagcagcctgagatcaaactgcaaggcagcagcgaggctgggggaggggtgcccaccattgcccaggcttgcttaggtaaacaaagcggctgggaagctcgaacagggtggagcccaccacagctcaaggaggcctgcctgcctctgtaggctccatctctgggggtagggcacagacaaacaaaaagacagcagtaacctctgcagacttaaatgtccctgtctgacagctttgaagagagcagtgattctcccagcacacagctggagatctgagaacgggcagactgcctcctcaagtgggtccctgacccctgacccctgagcagcctaactgggaggcaccccctagtaggggcagactgacacctcacacagccgggtactcctctgagacaaaacttccagaggaatgatcagacagcagcatttgcggttcacgaaaatctgctgttctgccgccactgctgctggtacccaggcaaacagggtctggagtggacctttagcaaactccaacagacctgcagctgaggatcctgtctgttagaaggaaaactaacaaacagaaaggacatccacaccaaaaacccatctgtacatcaccatcatcaaagaccgaaagtagataaaaccacaaagatggggaaaaaacagagcagaaaaactggaaactctgaaaagcagagcgcctctcctcctccagaggaacgcagctcctcaccagcaatggaacaaagctggacggagaatgactttgacgagttgagagaagaaggcttcagacgatcaaactactccgagctacaggaggaaattcaaaccaaaggcaaagaagttgaaaactttgaaaaaactttagacgaatctataactagaataaccaatacagagaagtgcttaaaggagcagatggagctgaaagccaaggctcaagaactacatgaagaatgcagaagccttaggagctgatgcgatcaactggaagaaagggtatcagtgatggaagatgaaatgaatgaaatgaaatgagaagggaagtttaaagaaaaaagaataaaaagaaacgaacaaagcctccaagaaatatgggactatgtgaaaagaccaaatctacgtctgattggtgtacctgaaagtgacggggagaatggaaccaagttggaaaacactctgcaggatattatccaggagaacctccccaatctagcaaggcaggccaacattcagattcaggaaatacagagaacgccacaaagatactcctcgagaagagcaactccaagacacataattgtcagattcaccaaagttgaaggaaaaaatgttaagggcagccagagagtaaggtcaggttacccacaaagggaagcccatcagactaacagtggatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattctgtcaccaccaggcctgccctaaaagagctcctgaaggaagcactaaacatggaaaggaacaaccggtaccagccactgcaaaatcatgccaaattgtaaagaccattgaggctaggaagaaactgcatcaactaacgagcaaaataaccagctaacatcataatgacaggatcaaattcacacataacaatattaactttaaatgtaaatggactaaatgcttcaatcaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaggaagagctaactatcctaaatatatatgcacccaacaatacaggagcacccagattcataaagcaagtcctgagtgacctacaaagagacttagactcccacacaataataattggagactttaacaccccactgtcaatattagacagatcaacgagacaaaaagttaacaaagatagccaggaattgaactcagctctgcaccaagcggacctaatagacatctacagaactctccaccccaaatcaacagaatatacatgtttttcagcaccacaccacacctatcccaaaattgaccacatagttggaagtaaagcactcctcagcaaatgtaaaagaacagaaattataacaaactgtctctcagaccacagtgcaatcaaaccagaactcaggattaagaaactcactgaaaactgctcaactacatggaaactgaacaacctgctcctgaatgactactgggtacataacgaaatgaaggcagaaataaagatgttctttgaaccgacgagaacaaagacacaacataccagaatctctgggacacattcaaagcagtgtgtagagggaaatttatagcactaaatgcccacaagagaaagcaggaaagatccaaaattgtcaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagaagaaaagagagaagaatcaaatagacgcaaaaaaaaaaatgataaaggggatatcaccaccgatcccacagaaatgcaaactaccatcagagaataccacaaacacctctatgcaaataaactagaaaatctagaagaagtggataaattcctcgacacatacaccctcccaagactaaaccaggaagaagttgattctctgaatagaccaataacaggctctgaaattgtggcaataatcagtagcttaccaaccaaaaagagtccaggaccagatggattcacagccgaattctaccagaggtacaaggaggaactggtaccattccttctgaaactattccaatcaatagaaaaagagggaatcctccctaactcattttatgagggcagcatcatcctgataccaaagccaggcagagacacaaccaaaaaagagaattttagaccaatatccttggtgaacattgatgcaaaaatcctcaataaaatactggcaaacagaatccagcagcacatcaaaaagcttatccaccatgatcaagttggcttcatgcctgggatgcaaggctggttcaatatacccaaatcaataaatgtaatccagcatgtaaacagaaccaaagacaaaaaccacatgattatctcaatagatgcagaaaaggcctttgacaaaattcaacaacccttcatgctaaaaactctcaataaattaggtatgtaaatgggacgtatctcaaaataataagagctatctatgacaaacccacagccaatatcatactgaatgggcaaaaactggaagcattccctttgaaaactggcacaagacaggggatgcgctctctcaccactcctattcaacatagtgttggacgttctggccagggcaattagggcaggagaaggaaataaagagtattcagttaggaaaagaggaagtcaaattgtccctgtttgcggatgacatgattgtatatctagaaaaccccattgtctcagcccaaaatctcctgaagctgataagcaacttcagcaaagtctcaggatacaaaatcaatgtacaaaaatcacaagcattcttatacaccaataacagacaaacagccaaatcggtgagtgaactcccattcacaattgcttcaaagagaataaaatacctaggaatccaacttacaagggacgtgaaggacctcttcaagaactacaaaccactgctcaatgaaataaaagaggatacaaacaaatggaagaccattccatgctcatgtgtaggaagaatcaatatcatgaaaatggccatactgcctaaagtaatttatagattcaatgccatccccatcaagctaccaatgactttcttcacagaattggaaaaaactactttaaagttcatgtggaaccaaaaaagagcccgcatcgccaagtcagtcctaagccaaaagaacaaagctggaggcatcacgctacctgacttcaaactatactacaaagctacagtaaccaaaacagcatggtactggtaccaaaacagagatatagatcaatggaacagaacagaaccctcagaaataacgccgcatatctacaactatctgatctttgacaaacctgagaaaaacaagcaatggggaaaggattctttatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacatagggcatgggcaaggacttcatgtctaaaaacaccaaaagcaatggcaacaaaagccaaaattgacaaatgggatctaattaaactaaagagcttctgcacagtgaaagaaactaccatcagagtgaataggcaacctacaaaatgggagaaaatttttgcaacctactcatctgacaaagggctaatatccagactctacaatgaactttaacaaatttacaggaaaaaaacaaacaaccccatcaaaaagtgggcaaaggacatgaacagacacttctcaaaagaagacatttaagcagccaaaaaaacacatgaaaaaatgctcaccatcactggccatcagagaaatgcaaatcaaaaccacaatgagatagcatctcacaccagttagaatggcaatcattaaaaagtcaggaaacaacaggtgctggagaggatgtggagaaataggaacacttttacactgttggtgtaaaagtgttggtgggactgtaaactagttcaacccttgtgggactgtaaactatttggttggtgggactgtaaactagttcaacccttgtggaagtcagtgtggtgattcctcagggatctagaactagaaataccatttgacccagcaatcccattactgggtatatacccgaaggattataaatcatgctgctataaagacacatgcacacgtatgtttattgcggcactattcacaatagcaaagacttggaaccaacccaaatatccaacgatgatagactggattaagaaaatgtggcacatatacaccatggaatagtatgcagccataaaaaatgatgagttcaggtcctttgtagggacatggatgaaattggaaatcatcattctcagtaaactatcgcaagaagaaaaaaccaaatgccgcatattctcactcataggtgggaattgaacaatgagaacaacacggacacaggaaggggaacatcacactctggggactgttgtggggtgggggtagtggggagggatacctttaggagatatacctcgtgctaaatgacgagttaatgggtgcagcacaccagcatggcacatgtatacatatgtaactaacctgcacattgtgcgcatgtaccctaaaacttaaagtataataataataaaataaaaaaatttttaaaaaataaagttaaagggatattattattattatttttgtaagttaaacattaggattaaaaagcacaacagagttttctagagcactgatctactctgtaacagaaaattgtaaagggtttaaaaggtttatgagaatcttaccttatggtcaaactggttaagattgggaagatttgtctataaagttttattaagaattgggtttgacattaatactacactaatgcaaacgtgaaatgtggctttctctcttgaataagattttcatgtattattacaagataatgaaagatttttatttgctttttaaataaactataggaaaaataagggagagaaaagtgacagatcatttggaaacccaagtctcccctatatcaatgagtaaaagtttttacctttttgaaatctttgagttatcattttggctaaataaatgctttatggtgacctgggattctattttgtaatatcaactgtttaaaccttttgtatttgacaaacgttccaaactgaaattctaatgtaagtctttttctgacctgattagtccttctagatattaggtcccctaaagtccaaaagtgacatatttggcttattagatatattaaaatcatacaggaagcactttcaaatataaaatgctatttggctttctttggactatacttatataaatgtgttattggtatatgttccaaaattatgcaaaactcctataattctgatatgacttagtgtacattatcagtcataattatagttcttatgttacattattgtgtgctacagagttaaccaaatttctttgtcaattgcatctttaatcagctgtcctaagacttttgtcacccacagacaattgtcttgttttaatccttttcaaaaggtggtttataatcagctataggactctgatgggtactctaaaatgcaagcctctgataactttgaaaattgtgccattggctgggcatgatggctcacaactgtaatcccagcactttgggaggctgaggcaggcagatcacgtggggtcaggagttcaagactagcttggccagcatggtgaaatgccatctctactaaaaatacaaaaatcagtcaggcatggtggcatgcacctgtaatcccagttactcgggaggctgaggcaggagaatcacttgaacctgggaggcagaggttgcagtgagctgagatcgcaccattgcattccagcctgggcaacaagagggaaactccgtctcaaaaaaaaaaaaaaaaaaaaattgaaaaagaatattgtgccattgaaacagaaaagaaaacacaaataaacttccaggattctcatagaaacttaatatattcataaggaatgtggcccaatatcaggcaaaacaagagttaacagcatggactaaactaataaaagaccaaaacaatcttttaatgactttttgcttaaaacattgcatatcctttctgttttgcttttcagagtcaagaaaacttttcctttggaaagtatttactgcttttaacaattgaaaaaagtatactactatggacaaaatttggagcatatgtctttctttttacctgatttctccagaatttgaaaactatttgggagtattcttaactaatagcaatatagttatttgcctaagtgcagtaagaatcttttcttttgtaataggacacaattaaagaaactgcttattttatgaaggctttgactagaatggtgtgctttcagatacaaacagactgctttaagggatcaaagttgacttatagagccaataaaagccactatggaaaactggccttattctttgtctatgcagtctctgtatggggttcctgacctgtggtaagtgaagaatgtcactttctgacaggcccaggagccccaagttatcttgggacatcaagaagaaaggaatgcacccaacttatacaggtatttgcaggcacagataaatctgtggctggctcaaggctttaagaagcctaatgtgagattctttttaaattaaatttccatcgaaaccaattttaacaagagcctatgtggcaaataattatttttgctgcactttatacaaataatcaggccaaatttcataagattaaaactttatggcaaacaaatttgtcccactatgatttgtctttggtaaaaatggaagctagagagagaatttgtttcaaaaactatgatacaccagttattagattctagtctcgtctgttgtttttgagtttcttctgcaatttaggcagaccctgcttattcctgagaatcaaccagtgatctatggctgttgctcagaagaaataagagggatggctaacgtaaagatctggattagtattctaattctaggcatgtattagaattggctagtgaccccatatcagcttggttttaacaattacccagttcatggaaagccttcttatttagtttacttgggataattgtgctgattttgttttactgttgtggaatatattgctgttgtcctctttgtgtaggaatgcaggaaaagcttacttaacattttcttaaattgaacacttattaatcttccagatttcaccttttgtcagaactcagagttatgatttgtcctcactgtactgacaacaggctctggtagggtgcagaggtcctggtaaacacaccctctgctggaaaacagggagaagtttccatcagtgtaagcctgcacttgggttgtctgggctgaagttaggagactgagtagaacatttgctgcagaaaaaaaagaagatgtgtaattttcacagttagaattaacttaggagagctgaaattaactgagcctcggaaatctgaatcttgaagtcaccagtggcttttgggactgtgagagagtctcttgtggtctttaatcatgtgagggtggggtgaaattcaatattcagtggttctgcaatgggatgcactgtgcaattggtgattgagaagccaactctctggctttaggagaagaatgtcttgctgttagtccttctggaaatagagccttgcattgcctactgtctgtttacactacctttgcacattgcctttggttatagagtcatgtccaatggctctttacttctgtttgcagggcaggagatggcaccctgttaaagagaaaggatagtagctgcaaagtcatttgtttctctgtttctgtgactgtatatattggctcatctttgaatggtctttatagccacaccaggctggaggtaacagggtcatgggagtggactgctggtgtgggctaaatcagagttcagatccatgtctccaagaggtaggaagtgcagggcaagttatgtggcttctggggcatccctcactttcttagttaaagagaagttgaagtaatcattctgaaatattatgggagtctgcagaaaaagtaatgaaaaccaaagcactttccattaatctccataatttagtccttacgataatgtcacagggcaagcaaccaatcagaccttactagtcgtgcttcctagaagagactgaggttcagagatttggacagagtgtcagatatgggatcagtggctagtccaatgtgatttccatcctttcttctgagagaaagcataagaaggctaagaggatgggggtaaagcacaagtcacctgcctgagagtcaacagagcaggggtctctttctcagtttgtttctctaagttatggcaaaagctttttgagctgtgattattgagaatgggggctgaagttcaacacatagttggcatgagagaagtaattatgattgaagaaatctagatgaaatccattgttcttttctgtaaaggggttgttatccctgattctttttttcttttttcttttttagatggagccttgctctgttgcccaggctggagtgcagtggtgtgatcttggctcactgcaacctctgcctcctgggttcaagtgattctcatgcctcagcctttccagtagctggaactacaggagtgtgccaccatgcccggctaatgtttttatttttagtagaggtggagtttcaccatgttggccaggctggtcttgaactcctgacctcaagtgattcacccaccttggcctcccaaagtgctggaattacaggagtgagccattgtgcctggcctgttctcactgattcttatagtgccatgtttctcagaatttgtggcttcaattacttatatttgtgcacctgacttttaggtgagctccagaatagcattactaattaagaatgagcatttagagtagaaaaagtgacaggaacagcaagactcacttccagaaagcctcactacaggtctaataggtgaggaaagtccccatctttcccatttttcttcattacctccctgtggggcaagcactgccattatgcatgagtaaactgtctgagttatagataagtaatgacatgaaacttcacaaacaggcctagatttctacccagggaaccgctgttatcagagaagggagtttggaatcttaagcaacaaacacatgttgattctcagtatttgcctcctgatggcttgctcagagagcctgttttcattgcccactttatatgtcagtaaataatcttccctggcagtgggtccaccatgtctggatgcacacagggaaatctggtggggtctggccagtgaaaaacactcctcaggttttgcaggaaaagcagtgaacccttcttttaagctcgagaatgctttaaagatgcatcattggcaagccttgccaaagaaatacgggatctaaatgtgataaaagccacgacgacatcaagctggctctggaggtctcctttgaagtttgctgagtggattgtcagtgggaggctgatatttacatgtagaagcacacaagtgttactgctaattgtggtaaatcaggctggccagcctggctctggatcccactgtgcctaacaccagccctgcatcccaggcacatgccgggctcctcagaagcgatcagccagccagcattgtgtgaattgcatttgggttcacagcactgtaattgtccttctcctgctatgaggagcagagagggaaaagggaagggagggttgtgtaatttgccctaggaaattgtgggggagggacaggcactgggccgggtggggggcggtgcgacatggctaaaacactgaccttcccttgagagagaccatatggtgaagtggagagggcacagcttttgcatcacacaggccttgtattagaattttggctctgacaccagctgtgtgaccttgggtcatttgcgaaacctctctgagcctcaactgccccttcttaaaatcagctctaagtaaccacagggttattcttcagaaacacagcatgcacatgcaaactttggcttagtaaataatgatttctttttgttctatctactccacctccctttcccattagaagcttgctacctttcactctgtgttttcttcctctcccattttcctggtggcattcaataaagcagaattctgatttctgcaatgtaggccaccttagagcaaaatacatgatcaggcaccaccaaattaggctattatctactggatcctgtttaaccaacccaaacccaactcaggctaaatacaggaatacaagaaaacgctgaatttctcccctttctttttttttttttttttgagacagagtcttgctctgtcacccaggctggagtgcagtggcgcgatcttggctcactgcaagctccacctcctgggttcacgccattctcctgcctcagcctcctgagtagcggggactacaggtgcctgccaccacgcccggctaattttttgtatttttagtagagacagggtttcaccgtgttagccaggatggtctccatctcctgatctcatgatctgcccgcctcagcctcccaaagtgctgggattacaggcgtgagccactgcgcccttccctccttttttttttaaaacaacaacaacaacaacaacaaacagtttattcagtaattatgtatacgtattttagcttccaaagtcagtgatggaacaaattgagtcctattaggcccactccattgcatgagttagcatcagaggaggtcaaactagagtgacttcatcttgaatatgggctaggtaagaagaggatgaggcctgctgggctgcattcccaggaggttaggcatttgtagtcacaggatgagataggagttgggtaggaatggtttcataaagaccacaggatgcaagctgggtgtggtgccttatgcctgtaatcccagtactttgggaggccaacgcaggaggattgcttaatcctaggagttcaagaccagcttgggcaacatagtgagacctcatctctacagataatttttattttattttattttatttttttgtgatggagtcttgctctgccgcccaggctggcgtgcagtggcatgaccttggctcactgcaacttctacctcaggggttcaagcgattctcctgtactcagcctacctgagtagctggaattagaggcgcacaccaccacgcctggctaattttttgtgtttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttactggccctagcacctacaagttcattcacagttccttctcactgacttcaccagtgaccactatcagtgacttcaagggagaaatgaggggggagataaaataaagtgaatggggaagagataaagaagagaggtcttttcacagtttgccagaatagtcccttcagtggttttaccccagggcaacaggagcccccttttagtttctttctcttttaattttcttttcccttcccactttttgcccactttttgccttatttgtgtctgactcaatttccgtctctttctctacttcttcattcccagatttggctgtagaaaattagaaagttcttgaacttggtttgcacgggtgcttttactttaacatgaaaatgaatgatcagcctccttctaatttcatcctagagtctactgcatccctcctaccccctgcacaggaatttagtcacacttatctctcccactttctctcccttcttcactttctctattgctcctcctttcatgcttgtacctgcttttccatgccctgtttagcctggcttgggatccagcaggttctccaagggttcctgcaagaaccccggctgggtgcccaggtctgagcctggtatgtgcctcagtatcacaaaggcctcctgtaaatgacacacattgttggaagtttcagaaattctaggtcaaaatggcactgaaatattaaggtatttaccccaacccaagcaacttttctaaaagttgtagagagtgtgacctctttattaattgaaacgtgaaaatcagctctagtttggaagctgagaaaaaatatatatatatgtatttatttctttgttgtttgaattcttaatataaatggtttaaaggaccattgaaaactgcatgcaatcacagaaggttttggcttcaggcagctcccgccatgatcttggggccccattgattctttcatctttcaggcgtcttactgtttgaaccttgaattttaacctgggacatgtttgactaaaatgatgctgttaatattttctgttgtgcaaaacacaaagagaactaggctccagggttgtttctatttgctaatgctgtttctgttgacttttgacttttctagtttcccagagctatggggacttcccatccggcgttcctggtcttaggctgtcttctcacaggtacggagcccagtcctctctgagttccttgtttgggtgtcttgtttttttaagctttgtgctgcatgggtttattaccagtactctgcatacacagtccaaaagagtgaaaagaaatagaaaactataggacgttatccagaatgaccacaaaccttcagttccctttgctgtattgcacttactccatttcaaaaggaatgctctccagtggcagttttagtacatatataatgttggcattgaaatgttgttagtaataatgtctaaatttacttactactctcttccttttcctaggacaaggcttctattagagctggattagataaattcaggaatggtcagctgtgggaggtggcacatctgttgtcccagccccttgagcagctgaggtgggatgatcccttaaggccaggagttcaaggttgcagtgcactgtgattatgcctgtgactagccaccacactccagcaacatagcaagacctcatttaaaaaaaatgttcaaaggaaataaataatagaaaattcttgcccaagaaatcatacttgtcttaaatcataactctcttgaggaaagatgcttacattgcttctaaatctcagagtcacctttatcttctctaggaatcaaattgatagatgaatgtttggctcttggaaaatcttaaaaactttcccaccaaaaggatcattggggtaatttgttgaagtgtgtattggactgtcttagttttcctccagatatttatgcactgcagatgttcgccatgaaaccagtgctcttctattctgaggagttagctcagcccgttagtgtctttgtcttacccatttggatatggtagaattgagcaagaccagagattcaacagttctaagctccactaagtataccccatctacagagtaataggtgatccagatgtacttacaaatcctatcttaacaagctttaggaattatagtggtcatatattgaagttgggtgggagtctcacaccaggttccaagggagattacaaatcactaattaataattaagtcataatatctcttctatcagtctcgggtttcttgttttctaagttctgtgctccatgggtttattatctgtactctgcttacacagtccaaaagagtgaaaagaaatagaaaactacaggacgttatccagaatgaccacaaaccttcagttcctttgctgcattgcacttactctattgcaaaaggagtaagtgcaatttcagtctaaataagcgagactgaaatttgagcttcgaagatgaacttagagttttcactcttgggttttacttaccaattgtgaattaaaatccgtatcatctggcaccactgcactccagcctgggtgacagagcaagactccatctcataaaaataaagaaataaataaacaaataaatccacatcatcctgctttggccctggaagtcatgagggagagacggcatgcccgagggctataagaaatggaagatgtggaattcttgagcacagatgtgctttgtgttttcttcagtctgtgtccttgcctccattcttattccatgtgggttttttttttttttttttttttttttttgagacagggtctctcgctctattgcccaggttggagtgcaaaggctgactgcaacctcaatcccctgggctccagtgatcctcccacctcagcctccaaagtagctaggactacaggtgtacaccagcacacctggctaatttttttatttttttatttttgggggagaccaggtctcactacgttgcccaggctggtctcgaactcctgagctcaagcgatcctcccacttccacctaacaaagtgctgggattatagacatgagcctttgcgccccagcctcttttttttttaactaaaggaaacctttgcagtgattgtgaaccataaagaacccatatgtgcttgagcccgtgccatcttgggatatttttatggttacacataagagtctgaaatatggaattggaatcagacatcctctgtctatttgagtgtttggaggggtgaatctagtggggcttggtggagctatttggaacatttgctgctctcagcagatgcagtggctgttataatgggggagctttcatgggcatccaggctaacggatttttgtgtagaaatggtcattgttcatctaagctgctactgttgcttctctcagttgtcgggatgagactgtcctttctgactgcatcctattcagagcgtgcttccttttgcagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccaggtgagttggctgggtctccaggaccaagcttcttctcttcctgtctctcctgttaaatgtactaaggttttaaacatatatataaataattaatatttattgcgggaagtttgaaaaatgtaagcgaacacacacaaaaatcatttgtaatattatcaagaaatattcattgttagcatttcagagctgtattaagtttggaaagtcatctttgttatgacatgtcctgtattgatactgtataaacaatctgaaatatactcatctctattcagttcattcaagttgcacacatactcacagtgtgtccagcactgggctaagtgttgagtacacaaaaattaataggtaagccctgtcttggagttgctgatagttcattataatatcttccaaataaacactcgatttttcagattcactatcaacatacatttattcttggagagttggaaggaattttctttttccttttaaaaaagttacatatatatatatatatatatatatatatatatattttttttttttttggtaacagggtctcactctgttgcccaggctggaatgcagtggcatgatcatcatagcttactgcaatctcaactcccttggttcaagcgattctcccacttcagcctccccagtagctgggattacaggcatgcaccaccacgcccagctaatttttatattagttgagacgggggtttcaccatattgaccaggctggtcttgaactcctgaccttaagtgatctgcctgcttcggcctcccaaaatgctgggattacaggcgtgagccactgtgccctaatttttatttttatttttgtagagatagggtttcactgtgttgcccaggctggtctcaaactcctgggctcaagtgatccacagccacctcagcctcccaaagttctgggattacaggcacgagccactgggcctggcctactcctgcattttaattaaaaggacaaaagggtcgagcacaagtgatggcaatttcagtatgcagttgggtaaattaaaaaggactatggctagaatccttggttttagaacaaaacctaaactgtttatgattcttgccatccttgctgttttggcataggtgtgtcttcctacctttctgccttttctttttcagtttttaatgggctcctcttcctaccctctataactacgagtgtccccagggatctagaccctctttactttttcatgatactcttattcatatgaaccttccttcttaacaattaaaaaaaaccaaaaactttgttttgaaaagggaaggtatttagaatgtcactccaacttcattcacacttagattccttcaggaaaatcctctaggtgtggagggattttcccctgctgtgaagagaatggtaggaacgtgaatgtgttaaaggcacacgagtccctgaagttttaatccgtgtaagattgtccaaaaattcttcttgttccagcacagatgccatccaagtagcccctgcatcgctgtctgactgagatctttttattcgcaatcatgcagacgtaggggccctttctgcagctgatgtttgagactgttagaacttcttaccaccgtagcttaagtagctgtttttcttttggaaaggaaattctcaggctccttctccttctttaaattttatgtatttctcaaaggattactttttaataaacagatttctatgctatttttgaatcatactgactataggtggtaagagtttttaaaagcatttcataataaaactcgaaatattttttcctgttttaaacagagttggactgtattattttattgttaatttttgtttttagttgtttaaattttgatttagattcctggttagtatttatttatttatttgtagagacagggtctctctatgttgcccaggctggtctcaaactcctgaacacaagcaaccctcccaccttggcttcccaaagtgctgggattacaggcatgagccacaactcctgtccagtattgatatttatcatcagtattatccatcaggagacaggcaatttggtattattcatacttaaaaatcactttgtagctgtcatgataactaatgccagtggggcaattcttctggatatatgtgtaaaggtgaacttcatacctaatatcaataatgccagtgggatagtttttctggatttatgtgtaaaggtgaaattaatgtctaatagagtcttcattcttttttaaaccacagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaaggtacttgtatcatctccttccttctttaaataagagtaacaggcaaaatcataaggtgcgtgtaggatttttttttttttttaaatcatcatcactggtgatcctaaattctgatttggggatttaggaccccagctaatacaatgtctgtggctataataataagcttaaaattactaaaggccaaagcttgattacccatgcaagatttcatgtttcatcagttgacttcaaaatactgtaaggaattcttttcttacataagcctcttactttcattcacattcctgactatggcggccctaaaaacaaacatacacccagggggttagatgcctagattaattttagtaacttaagaaaagtgatttgaagaaagtagtttagacttcaaccctttgatgtccacagttagtacgcttggggaagtataatacatgctgaggtcaacagatatttcctgaacactatattacatggaggaatgggtagcagcaagagtacactgttttaaaatcagagcacagctaattttgtgccaggcactgtgctaggttctgggaaagtactgagaataactgaggagcagagtggaagagaagaagagaagaaacaattggatagaaacaaagtgtctagagcagtgtggatcagcaaatgttggttgattaaatgaataaatttattagtcaaggagattgtggacgagtataaccataactaacccactgctgaggaatgcggtgttctgtttgattggaatttatttttattgttattattttgtaattctgtattataactatatgcctaattgttgtacaccatctcacaatcaagccttgtgagattttccaaattttatcttgatcaaactggtttgcaaattatttttcagggttttcttaaaaaaaaaaaaaaaaacccaaactttataagatcctggctatcctgtggatttttaggcccttgtatttgttcttttttatagcaacatcagagctggatctagaaatggaagctcttaaaaccgtgtataagtcaggggaaacgattgtggtcacctgtgctgtttttaacaatgaggtggttgaccttcaatggacttaccctggagaagtggtaggtaccctcaaaacgtgcaatggcttggagcagagcaacagggctcagaagacctgcatttgagctcggtctgtcactgatgggcacatcactgagtttctctagaccttagcttcccacctctgggatgaacacatttgattaaatggcctttaggactccttgatcaatgggagagtttgaaatgatagttcctggaccaggcccttcagaatacataaagagtgtgccgtaagccttctttttcagaagtcagacagaaataggaaggttctctggctacaagatatcaaccaaaaaattagaagagcaaaaaaaccactggattttactattgcggagacagtgattgattctcatcgtcttggcttctgtgccctgaggtttgattcatctgatagtgttgattgcccgcaccccttcctcttctgccttgttggcacccaggacaatgtgtcttcctgttccacctcctatgtgcctgacctttgcatggctcaccttcagtgaaccgttatgatgtaatcattcagcaaaggtttaatgaagtttgctcaatcccaagcactgtaccagaagctggttcagtattgcaggaagaagggaggaggggagatggaagtggggaaggggagccaccatgctgcctcttggtcactggagatttacagagtctcagtcattctaatgcattgtcactaagtgtgtaagacagccatgtgtaagaggctatgaatgcccaaatgcaggaatgactaatattcttatggagaacaaaaacgagatatatatatttcttgcctccactcctgacttgtaaatttctgctccctgttcttttaggcatttgacagctttctgtccttctatccattgatctccctccttttatccgtttctctctcccatgcatttgccgctgcttttcatttgtcctggggcatctgataggaagttgggcattttcactattgcctcacaaacttcacacagtgaagggacatttacagtccaacaaatgtacatcttccctgaaatatgaagtgatttggttcttctgttcatacttgattgactttaatccttaacacataaacactgctttctatttataggagacagcaatttttttttccaaaccgaagtacatgctatttggcttacaaatatataatcaaagtattgtttcatacagtatgttttttccgattataaaagtaatgcaggtttattgcagaaactttgtaaaatatggagagacaaaggaaaggctacttcccagagcatcactgtttatattttagggagataaagcttttatttttcatttgtatttctttcttttttttttcttttttcttttttttttttgttgtggagatgaggatctcactacattgcccaggctggtctcaaactcctgggcttaagtgatcctcccaccttggcctttcaaagtgttgggattgattacacatgtgagcctctgagcttgactgagataaagctcttaagtatttcttatccatagataaacattgaataataggtgttattctttaaatggtaatttattacattctttatccttcagcagtatagcacaaacaccttatatgtgtcattaactgtccttttaaaaaatgggctgggtgtggtggctcatgcctgtaatcccagtactttgggaggctgaggcaggagagtcacttgaggccaggagtttgagatcagcctgggcaatgtatcaagactccgtctctacaaaaatttttaaaaattagccaggtgtggtggcatgagcctgtagccccagctactcaggagactgaggtgggaggatcacttgaacccaggaggttggggctgcagtgagccatgattgtgccactgcactccagcctgggcagcagagtgagattctgtctctaaaaaaattaaaaacaaaataaaaaatctcatgattttctaagcagctagcttttattctttaggttttatcttttagagcagttttaggtttacagcaaaattgagaggtacagagatttcccatgtgttccctacacccacacatgtgtagcctcccaccttgtcaacatccctaccatccatttgttataactgctgaacctccattgacacatccatatcatccagagtccatagtttatcttagagttcactcctaggagcgagctttttaaaagtcggttttcttccccttttgctgtagaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatggtacattccgctttctaaaatgtcagttgtccatgctgctcgggatccatatgtggtaatcattatttaatggaaactcttccctgtacagagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtaaagaaactctctgcccaagtatgcctttttttagtgtgcatcagaggcggactgaggtttgtgtgtgtcttacaacccagacccaaagtcagtctagaaaatgtaacaatctgagttaagagatgcttgaaatcacatccctttaatgataacattgcaaagtggtattagtatgctggtaagtatttaatgagaagatgagaagaaagaactaaaagctctggcccctggggaaagacaggtcactggattcagctagggtggaagaaaggaagtaaaattggactcaccaggattgaatagattgaatatattccctgatgttcatcatccatatcgcaagtagacagatatggtgattacacccatgaggcagttatcacatcaccttacgtgaaagttaacgtcataggcttaatctggaacccatttgccctaattgaggactccacaggaaagaagagtagagcctggctaatcaggagagagatgtgcagtgagttgcttggatccctaccttttaatcagaatggtagattgctctcatctcttaattggtggtggagttttgaatgagtcacccctcagccacagtttcctcatctacaatgtaggataaacaataccttatgtccttcaaggcaaggaattggatcagatgatatcatgaggcctcttaaggttttaagctgtgattagaacccaagagtcagaagatacatctcacagcacccagctaaccagccctatacttttgtcagaaatcatctcagaaagacaaagtcagtcctgtatttcaagccttcaggaggaagaacagagcctttctcatcagttccattcacctcaggatttgctttcttctttgtgaactaaattccacgtgtaattgagaagcaatgtctgagaaaatggaattttacagcctctatagaatagtaaaggaaaaatgaagtgggatactgaatctggaaggctttctgttgacacaaaatgaaggtgtacaacaaggagggcagctttccacgaggaacttccatgaggctgtgcagccagagaggaatagggtaacaaccctggtacagctaacacctccaacacgtgtgtgagcactgtctgcaagccataatccatagcagtggcaggacaggctcgccaactgagtggttctggaaagctgccttttccttttagtgattcaaggatgcttcaacgtggattttttagttcctgttatgagccagtgaatacaaagatgaacatggtagatgggggatctggcttcctggagcttaaaactccaggatgggggatctggctttcctggagcaagaaaaccagtggttttcttggccgaagaagtgaagagaacaaacagcagaggataatttggtaatcagcatcctagtgtgccccagggtactctcttaaggaaatccagtcctggagcacacccagtatggtccagcctgctgtcttcgtaggtctgagtgccccagtatttgcaaagtgttttggagcctatgaaatgctttcacacatacaaatctcctttaattaactctcacaatgactctgtgctatgtgtacaattatcacgttttacacacaaggaaactgaggcatggagcattgtaataatacccgagatcttctcactccatgaccaatgcttttcttctccattccagttgctttttcaactgtgatgatttataaaggacaatcaaatgggcacatactatatttatgcacatacatacacacacacacacacacacacacacacacaaccagatgtcatttataatccatgtaaaatatttttggggaagtttctctttaataaagtttgaagagacatatattttttttttttgaagaggcatattttttctaacttttttttttttttttgagatggagtcttgctctgtcacccaggctggagtgcagcggtacgatcacggctcactgcaacctccgcctcctgggttcaagcgattcttcagcttcagcctcctgagtagctgggattacaggcatgtgccaccatgcctggctaatttttttttttttgtatttttagtagagatgggggtttcaccatgtttgtgaggctggtctcgaactcctgacctcaagtgattcacctaccttggcctcccaaagtgctgggattacaggtgtgagtcatcacacccagcctataacttttttttaataggtgatagaatcccgtgcttgaaaaataatcaaacaaaaagagaatgcattgtaagaagcctcactgtactcctgtccccagctgcccagttctcccctcctccccacagggaaacatcttcattagtttcattaggttcttatgaaaccttccagagtttctttaagcaaaatacaagcaagtaggactgtcatatcctgcagaccgctacatacaaatacatagaaagtgtcctcattctatcctccagtgatattccattttttggctgaaccacctaaatgatggatatttaggggaagcaagtattttttaaaaaaggtaaaaatcaaaggtttttattttttatttttttaaagaaaagttggtaggctgtgtttattcattcagaagtcaggccgtggctgaactgatagctcttggagatggccattgctcatctctgaatgtctggttttctcttgtaagaattgtgtgtatgatccagaccttcagtgtgtgcactatatattgagaattccagaagagatgatatggacaagaaaaaaagatgactttactttttacagtaaaaataaaacttaaattgaagagtacaattgtttaaacaattggaacttacttagctactgcttgttgaaacaaaatcctttttttaaaaggtatcgaagcaaattaaagctgatccgtgctaaggaagaagacagtggccattatactattgtagctcaaaatgaagatgctgtgaagagctatacttttgaactgttaactcaaggtatgtaaagggagtataaagataatgctagctctgtagatgagtgtcttccaaggaaagcctggcacttttctccccggtcatggaagaaaagcagcacttaggggagaagcagtgtctgcatatgtcacatatcgggaatacctctgctggactcatgaattcaggtatttctgggaggttctgggttactctagagtaggcgaggaatccctaggctccaccagctagctttatttttgtagagatggagtcttgccatgttgctcaggctggtctcctgggttcaagctatcttcccaccttggcctctcaaagtactgggattacaggtgtgagccactgcacctggcctccaccagcttacttagcacctgcttctcaatctgagaagagagaagcagatgaccttagattgttctggagagttttgctacaagttttccttatagacattgtacagtggtccttaccagaagggagtgcccaagtctgtttacattcaggctcagcacctatccagagtcccagccatgagccaggtgctgtctgaggtgcgctcatgtgatcctcacagtaaaacctgtgatacaagcaacaccgtatatctaatttatttgaccacagatttagaaaagaatctttaaaacctaataacataccacagatgcattttggtaaatgctgctttagattatactttagctgaatccattagttgaatcctaagctataatataattttaagaacctccttgcctttcaagccaaataaccaagggactttctctctctctttccctccctcccttccttccttccttccttcttctctccctcccttgttatctcttttcctttcctttctctccttccttccctcttccctttttcctttctctccttccttccttccttgcttccttcttccctccctcctttgttctctcttttcctttcctttctctttttctttccttccttccttcctcactcactcttttcttttcctttctctccttccttccttccttcctccctccctcactctctcttttctttgcctttctctccttccttccttccttttcctccctccctccctcccttgttctcccttttccttccttccttctttcctttcttccttccttccctcttccctcactctctcttttcctttctctccttccttccttccttcattctcccctcccctcccccctcccctccccccccccctcccccctccccccctcccctccccttcccttcccttcccatttttcttctcaccatgttgcccaggcttgcctcaaactcctgggctcaagtgtttctcttccacctcagcctcccaagtagctggggctacatgtgtgaggcatcacaaccatggacttttcactttcttcactccaggttaaaaacatcacagggataaatctcaaaacaccaaaactgtgaaaatgctgctaaccatgtgggtctgtctaaactggagtgttacttgtacaactggtttcagcccctccggagtgttttgaatgccatgtagatgagttgtgaactcatattccactttgtagtctcatatgttctgggacacgagctattccattctgacttctttctgcctcttgcagttccttcatccattctggacttggtcgatgatcaccatggctcaactgggggacagacggtgaggtgcacagctgaaggcacgccgcttcctgatattgagtggatgatatgcaaagatattaagaagtatggaaaacagatgtgtcttcttctttcgtggtcagaatatttctcccttgacacaaatgatgtcaaatacattttacttattgactataagatagggttttgggtgtgatagcttcagggtgtgtatcttttgtcatgaatagctgtgagaagaaggtccagggctctcattagaccttcaaaatgtctccaatctaaaaacaagagtgaattttaagaaccactgttctaagaagatttttactaccctggctcacatatcttatttggtgaactttgtttggtagtcggactgcatgtaaacataaatgtgactgcttagtcccttatctgcccacctgctgtttggtgggttaattcgccattccctcctccctcccccgagtcctcagccttcttaaatgggcacatgagcaatgtgtttacacttcatccatggtaactggttgtgttcagaagcctcagttgtttcttcctctagacagagactcctcatcttaacttctagggctaagaacagacttggatgttgactggggtttctagtagattccagtgtggagcaggattctaggtcttataactcaatctgaggatcatcgcaaccctagtgacaccctaggggctcttcccagtgtgagtgttgagaagggagggctccaggcctttttgaaggggtgggagattgagatcattaaatatggttgaagttgaactgttcagtttgctcataggttcaagattggggaatggtagtcatattttattaaacttgattatctctgcctgctatgtaaacacttagctttcagttgttcatgtgtgagttattccctcttcagcacatgcagacaagttttaatgttcatctgcatgtaaaataaatcagtgtgtattgccccgaaatgcagacaaggtcccaactccttgccatcttagagtgttcccgtggctccactcattgccatgactctcaggaattggccctatacttaggccctttttctctctagatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccagtgagttcctcaacagtcaggacaactcatcagctgagccgcatctgccccaggcggaactttgaatcccagataggggtcatatagaaatgaaggtcccaaggcagaaattcagttacgaatgctcttaaaggcatgtgggactttgttttattttgttttgttttttgagacagagttttgctctgtggcccaggctggagtgcaatggcacaatattggctcactgcaacctctacctaggacgttgttttagattcagatccaaaactgcatttttgcagaggcccctcaacattttgcttgtctaataatatagctacagtctctactttgaatgtctgtgtatgtggatggagtgtggggaaggatcttctgtctcattgctccttaaaagatagatgaagccaaaagcaatataagcaaaatgcaacttacaaaataagctttataataaagcatatgaagtagaggtgtctgcccatatagtagctgtcaattgcatttatcctattcaaattctgtccacaaggttactgttggagcaactttggagaaaatactgagttctcctgattgaattttgtccccttcttgtataaggaaagagttgatgtagtttcctgggtgtagatggtttgagagatggtactgcctatccctaaaatgaaccaggcagccctcacacttccccaccagcagtgagagattcctggctcagacacagccacactaccttgctgcccctgtgcatgtctgccaggaaacttttcattgtgcctctctctcttgtcacgtagccctgcgttctgaactcacggtggctgctgcagtcctggtgctgttggtgattgtgatcatctcacttattgtcctggttgtcatttggaaacaggtagatattttctcataaaactaaagatctttgaagccaatgagaacaagcatagcaacctagttcagtgcttggcacagagaaggagctcagcaattacatgtggagtgaacgttgttggactctactgtgtccagtcactgtgctgcttcagtgaagctctggtgcactgggactttggtaattcaccagttacctgtcctggtcatttatagaaaccgaggtatgaaattcgctggagggtcattgaatcaatcagcccggatggacatgaatatatttatgtggacccgatgcagctgccttatgactcaagatgggagtttccaagagatggactagtgcttggtaagttccatggggtaacctcccaagactcccttttcccttgcacacaactttacaatttataggccttggcagaatagagatctgagcttgtgcttagtaagaactaggcaatggaaatttgctttcagaaatacatttctgtcttgacagtaagttaattggatcattgcaatgatttttttaaatctctttccataacaaattatagttaaggaaaattttacaaagggagaagagaatatgaagagggctggcaaagatacccaccaaaattgcttttctttagaaatgacacaaattgaaaatgaatttctgtgactaaaaatgagcagatgagaaatgaatgaggacaaccacaaaatgtattttgattcagtacattctgaagatgcattagatactcctttttacatatttggaatatggaatataaaaatataggtacattttgaggcaaaatatgtaaaaataagcaagccaacttatcacaagcatttcaagtatttcaatcctgggctgagaccaagtatatgaagctttagtccaagggagtatttcttttttaaatcacattcctaatgaatgaaagcaagacaaaggcaaatgaaagtagaggtagaggttgtgttatgatgaatgatctaacagtatatatgttaaagaatgccaaatgcaggttttaattatccaccggtctcattgcaaaatacagaagagtttaagtcttcttagagagttaggtaaactgaaatcaagcaaggcaccagagtgaaatcacctttgcaaaaattgtaactgaggaaattatgacagtgaatgagatatgacctaaccaactccattttgctttagcctccaagttgtccttgttccttcctgggcataggccgaactaactttgagaggaacttagtttatagtttgactttgaaaaaaagacaataatagccctttgccaaaacaaaccctctttttgcctgggaactagactgcctttgcgggactaacgaattagctacaagattagaaagtatggtttaggggtcactgttgtaaaacctgaggtcagtgcttgagatattttggagaccctgtatttcgatgcaccagctgacaccacccaggtcaataaactggctcatctgatcttggggcccctacctaggaactgactcagtgcaagaggacagcatcagctccctataatttcatctttgacccaaccaatcagcactccccttttcaccccctacccaccaaatcatccttaaaaaccccattcccccagtttcagagacactgatttgagtaatagcagaatagtagaaattcccccagtttcagagacactgattcgagtaatagtagtaatagtagaataggtctcccgtacagctggctctgtgtgaattaaaccctttttctattgcaattcccctgtcttggtaaatcggctctgtctaggcagcggacaaggagaatccatggggcggttataagagctgccccccaatttcaaatatttatatctaagctttctttattttcctgcctatttcccaacaagggatgaggagcttagggagttaaaaagtagtaaaatatggggaaaagggcataattcccattataccaagaggcattgctggtgaagcaatacctttccaggtacgattttcagtaacacagacgtgcagtaagaggcagtgttggctgttagtgtcttttatgagccaagtcttttcctggcttggctatccgtggtgagactgacaccccgggaaatgtttctctcagggtgagctctttcagggtgggacaacagcttcagtgtctttacgtatgtctcctcccaacatgaagctaattgctgtgctctcgggcatgtttagctcttggtagagtggctttcctaacaaatagggagcagtgagcccagcctgaagtttttatttagtcactccttagaatcagtgatattttgaatactgaagtatttccagtggctagtaatttactaagacaaaagatgcccctgtttgcatatggaaaacagaaggggagagagccaggaggtgtgggtgagagccccgaaggcaagaggatcccaggggctggcccagcacggagctggtagacagcgcgctcacaccagggagggctgcaccctcctttctcccgtctgtgttttctttcccttgcaagtgttattcgacaaaagcaattatgctaatttccttccctgtgggctcaattccttttttgacacgatgacttggaggagtcattatgattactccaaacaggaaagacactcgcccagctgtccgcccgcagagagctggctacggtgcagaaagctgaggaggcgtctggagtttttgggtgttaatgattctgcctgcccacaggtcgggtcttggggtctggagcgtttgggaaggtggttgaaggaacagcctatggattaagccggtcccaacctgtcatgaaagttgcagtgaagatgctaaaacgtaagtgctccttcctggggattttttgagcacggggattttttgagcatggggatattaagggaatttctcaaaatcatgcagctagtaaataagacatttaggactaggtcctgattattttgactccaggttttatgtgtatttagattaggtttatttagattgctcttgctgcctgtatgttggaaaattaagagcttgttatttccagtgacttctttttactagaaagaccaggaattagttattagcactgaggccaagtagctatttgcttcttttagacttctggtaaatagaatgatatccaatcacaggattagtcatattcttggtttttttctgagaacaggaagttggtagctcagctggactgatatgtgatttattctttcaacagccacggccagatccagtgaaaaacaagctctcatgtctgaactgaagataatgactcacctggggccacatttgaacattgtaaacttgctgggagcctgcaccaagtcaggtgggctcactgacctggagtgaggattttcactggacacatgtggttgtgaaaactgttcaatcaggcttaaatcctccactctccatccccacacatggcagggaatagaagtcccttgaatggagctgactggtcccttgaattgatggaagctcattggtttttgagcaaaatctgttgccagtccagtcatagccattcatggctctttattaaaaaaaaaaaaaaaaaaaaaaaaagcttttttggtatcttatttttttctgcgccatatggtctgcaggacaattcatggcttttctgttcttcattttcatacccatctcctaacggcttttgtccccataggccccatttacatcatcacagagtattgcttctatggagatttggtcaactatttgcataagaatagggatagcttcctgagccaccacccagagaagccaaagaaagagctggatatctttggattgaaccctgctgatgaaagcacacggaggtgggtgcaaagagagatgttgctgtctatcattatcttacaggcatcacaaatggaaagacccatgtcctgatagatatcatgtctgcagattcagtgcccaaggtagcaagacttagagtcaaaccaccctgtccagtctttccatggtcatgcagagagatgcatgatgtctaaaggtgttttggactggggtgtcacatgggaaggccttgctgataggtttgaatgagagtgagttagaatgactctgggagctcttctgctatttacatgtgatccacttagacctataaaatgcagctctggccagggatgcttgagttctggaaccttgcaagaactgtctgtggatctccaagctcgaggtccttgctgaacctggacctataaatgacgtcaatgatagtgatccctactgcagaaatctacaagtggctataaagaactctgtaggtaagaaattctgtaagatcagaaagtacaatgaattcacttcataataaattacttggtggacaccaaatgggtgctaaattgattgggtagaaggaattgtatgcccaagccacatgaccacacggctcaagttccaaccaaggcttgtgagttgaaaaactgagaaagaataatgacagacttaatgtagtgaattcttcaaactttaagtgtaatggacttacaggtccatgggagcacagccccactgtcttagatgtggctcttcaggatgtgcgggctcctgctaaagatgtgcagggaactggctctgaaaacaagtgaacagtagtcatcatggcagctgacatttgtggagtcctttgtatgtgccaggtgccatgacaaatattccgctagtctttcccatctttgtcagtgggatccattctacgtcttctgaaaagtgcttccttgacccccagatcaagtcattttccttacaagctattgaaacctttcttccttcacaacacagctgagtttgagttgatctgtgtatttattttgttttttacatttctttttttccctatttaaaaaatttttttatttccataggtttttggggaacaagtggtatttggttacatgagtaaattcttcagtggtgatttgtgagattttggtgcacccatcactggagcagtatacactgaacccagtttgtagtcttttatccctcacctgcctctcaatttttccccgagtccccaagtccattgtgtcattcttatgcctttgcatcctcatagcttagctctcacttatgagtgagaacgtacgatgtttggtttccatttctgagttacttcacttagaataatagtctctaatcccatccaggttgctgcaaaagccattaattcattcctttttatagctgagttacatatatatatatatatatgcacacctacacatacatatgtatagatacactgcagtttctttatccactccttgattgatgggcatttggggttggttccacattttttcaatatgtgaattgtgctgctataaacatgtgtgtgcaagtatctttttagtatgacttcctttcctctggtagatacccagtagtggaattgctgtgatgcatgtatttgtgcgactatttgattaatgctcatttccttgactagatcacctcatgtgaaaggtatggattggttttgcttttacccagttagctcccatgcctacctcagtacctggcacataatcatcatctactgaaagtggaatgaccacttcagaagggcaccctgggtaagatttctctttctgtttttacagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttaggtaaaagtgtctatactcactctgggtgttgggactttccagtggtttaatatgatacttaaagtatttagagggaagtgtatagggatggtaagtgaacctggcagcccacgtggtctctaaatgcaggtctgcacaaccagttctgtgacatgtttccaggtttgtggcctgtaaattgaaaagaataaaagctgacaatgtaacaaattttttaaactttaaatttaatagttttaaagaattttcttggtgtgttcctgcagtaaacattttaaaaaaaaaataattatttattctgatataatgaacttccttttttattgctgtctttttcttttttaatgaaaatatggtgattgattttttttaatgcccttacttggcagaattacaagttggctgtcttatgttggttcctcaccttgctttttttcccttaagttttagaagtctctgatgtctatgagttcagtaacccttgcttttacttttcctaacattcaatttgtgataggaactctagagtagataatttgcagttatattttctggaccagtgtttctgttgaatgtattttgaaggtgggtctatctgtttttcaagtacatgaatatgtggcagggttaaattgatttataaactccagggagtccagctgatgcccagaccagatggatcacttcacatctgctcagggtggttcctccagagccctgaactggtcacagacatgaagctggaagtctgacattggcttgtcctgtgagcttgcctttttgggtctgagccttcccattagtcaatgcaaaaaagtgttgagctgccctggacattgttttggaaattattgatgtgctctgaatgttttcaggttcttaagtgaaaggtacaatccatttaaaaaagaatgtgtttgttttgcaaagctcagtacacaatattttccatttctgcggttccaagttccattcacttctcattgccaaatgggtgaacttccaagcgcttttaaaagattagccagtgagagttatcggaaccagtacttcctctcccctcccatattgttaaaaatagtttacattgcttcccaggctgggctggtggagttggcacgagatgtcagaggaacctgagtcatgctcaggcccaagccctgttggcaggcagaccactgctttctggccttccgtgactatctgaaaaaaatcgtgaatggctagagctactcttcacttgctgaacattttcaaaaagaattgagaacttctggattaaattgccttcttcctcgaaaaccctgggacccttccagatgggactaactggggaaagtggacaagttacaaacaaagaaactcaaaggaaagtcattggcactgatctctaagatgctatcacatgtgattggtggttgattttattaacaaattataagcaaagtactacaaaggtggctttaaaaagaaaataaagcaattcacagaaactactttttcatgtagcttgtatgtgtgctccatgtatttcatcatggaagattttagtgtgtgtttatgtgtatgtgtgttttaaaggtagctgagatgatttgctaattatggttgaaaaaaagaaatttaggaggtaaacaaaataattatgtgtaagattggtccttgtggctgtgtgtgtgttttgtgtgtgcgtgtatgtctctgtgtgttttaggctgttcttttattgctataaataaatacttgagactgggtaatttataagggaaagaggtttaattagttcatgattctgcaggctttacaggaatcaagatactggtagatctgctcagtttttggagaggcctcatgaagccatgaagtcatggcagaaggcaaagcagtgcaggcacatcacatggccagagcaagagcaagcgagagagagaaagagagaggtgccacacacttctaaacagtcagatcttacaagaagtcacttactattgcgaggacagcaccagaaggatggtgctaaattgttcgtaagaaatctgtccccatgatccattcatctgccaccagtccccacctccaatactggagattacaattcaacatgagatttgggtggggacacatattcaaactatatcatactgaccctggaccctcccaaatctcatgtccttctcacatttcaaaatacaatcatccctccacaatagtcccctcaagccttaactcattccagcatcaactcaaagtccaaagtcttatctgacacaaggcaggtcccttccacctatgagcctgtaaaataaagaacaagttatttactttcaagatacaatggggttataggcattgggtcaacattcccattcccaaagggagaaatcggccaaaagaaaggggctacaagccccacagaagttcagaacccagcagggctgaaaactccaaataaactccattgactccatatcccatatccagagcacactgatgcaaggggtggagctcttgggagggatggaacaccctgtggctttgcagggtttagcccctgcagctgctctcaggggctgttgtcgagtgcctgtggtttttcctggtgcagagtacaggctgttggtggatatattattcatggaggatggtggccctcccctcgtagcttcacgaggcagtgccccagtggagactctgtgtggggacttcaaccccacatttcccctctgcagtgccctagtagaggttctctgtgagggctccaatcctgcagcatgcttctgtctggacaccctggttttttaatatatactccgaaatctaggcagaggctcccaagcctcaactcttaacactctgtacacccacaggctaacaccacatggaagcggccaaggtttatggctgtcacaagctgaagcagcagcccaagctgcacctgaactcctttgagccacggctggagctggagtcatagggatgcagggagcagtgtctcgaggctgcacagggcagtggaccctggggctggcccatgagaccattcttccctcctaggcctctgggcctgtgatgggaggggctgccatgaaggtgtctgaaatgccttaaaggcctttttcccattgttttggcaatcagcctttgcctcctttttagttatgcaaatttctctagcaagtggttgcccagcagccctctttaattctctcccaaaaaagcttttactttctctgtcacatggccaagctacaaattttccaaccttttatgctctgcttcccttttactttttttttattttaaagagatggggtctcactatgttgtccaggctagtttgaactcttggactcaagcaatcctctcactcatcctcccaaagtgttgggattataggtgtgagccactgcgcccagcctctgcttctcttttaaatataagtttcaacttcaagtcatttctttgcttctgcatctgactgtaggctattggaagcagccaggccatatcgtgaacactttgctgcttagaaatttcttccaccagatatcctaggtcatcactctcaagttcaaacttccacatattcctagggcatggacataatgtggccaagttctttgctgaagcttaacaagggtgacctttactccagttcccaataagttcttcattttcatccgagaccttggcagcctggatttcattgtccatatcattatcagcattttggtcacaagcatttaaccagtctctaagaagttccaaactttccttcatcttcctgtcttcttctgagccctccaaactcttcttatctctgcctgttacccagttatctttacagcaattccccattccttgataccaattttctctattaggctgtttttgcattgctataaagaaatacctgagactgagtaatttataaagaaaagaggtttcattggcacatggattctgcaggctatacaggcatttgcttctggagaggcctcaggaagcttccaatcatggtggaaggtaaagggggagcaggcatatcacatggccagagcaggagcaagtgagagagagagagagagagagagagagagagagagaggtgccatacagttttaaacaggcagatcttgcaagaagtcactcacttttgcaaggatagcaccaaggggatggtgctaaaccatttgtgagaaattcacccccatgatccagtcacctcccaccaggccccacctccaatactggggattacacttcaacatgagatttgggtggggacacatatccaaactatatcattgcgtgtgtgtgtgtgtgtgtataatttttaaaccagatatatgtttctgcatatctctttcctttctttcattctttctttctttttttttttttttttttttgagacagagtctcactctgtcacccaggctgcagtgcagtggtgtgatctcggctcactgcaactcattgcaacctcctcctccctgattcaagcaattcccctgcctcagcctcctgagtagctgggattacaggcacatgccaccatgcctggctaatttttttgtattattagtagagatagggttttaccatgttggccagactggtctcaaacttctgacctcaggcaatccacccacctcggcctcccaaagtgctgggattataggcataagccaccatgcctggcctatatatctattttctaagatagaatctttgcatagtgatattcatctgtgagatctaaacattctacaaaaaaattaagaaaatatttttggatgtgttctttgggcatgcctctgcaacctgatgatttcctgctgcctgccagcaccaatacatttaatttcttttctgcagactcagaagtcaaaaacctcctttcagatgataactcagaaggccttactttattggatttgttgagcttcacctatcaagttgcccgaggaatggagtttttggcttcaaaaaatgtaagttcaaggaacacagacctttttagacccagatttcagtgagtggagtgtggaaggagatgctaggagatagatgttggaaaggccattaataacaggggcctcttacttacctgtctctctccttcatcccctacgcaggtcagggagtctgaaatcatcaggcatctactcttctctagagctttctctctgttgggagtgggtggagtgagaacctgggagaaggccagccctttatatccaggcagacagctccaagtgccaccatggatcagccagtcttgcaggggtgatgctatatcagctacagatggcttgatcctgagtcatttcttccttttccatgcagtgtgtccaccgtgatctggctgctcgcaacgtcctcctggcacaaggaaaaattgtgaagatctgtgactttggcctggccagagacatcatgcatgattcgaactatgtgtcgaaaggcagtgtacgtcctcacttccctcactggtcaggctcatcctccttcactttaatctctaaagtcaggtgttgcttctagagattcggtgcctgttttttaaaacatcaatagatttcaaggggtcagtacactgccttggcagcagattgcccaggtgtgagtgccagctccaccacttacttaatttggatttggggctagatacttgactgttctgcccctctgtctccctgattgtagtgggaggtgataatagtacctatttgctgagttgctatggggattaaatcaatgaattcatgtaaagtgcttaggacagtgcctggcatatagaaacagcactcaataatgttagctattttatttatttatttatttatttatttatttatttatttattttctttttttttgagacagagtctcactctgtcacccaggctggagtgcagtggcgcaatcttggctcactgcaaacttctgcctcccaggttgaagcaattctcctgccttagcctcccgagtaggtgggattacaggcatgcaccaccatgttcagctaatttttgtatttttagtagagacagggtttcaccatgttgcccagactggtctcgaactcctggcctcaagtgatctacctgcctcagcctcccaaagtgctgggatgacaggtgtgagccactgcatctggcaagtgttagctattaatatgtcaattgcgtgtatgcatggacaagcatgcattcccaaggatggtgtctttatattttaagcttttatcagattttcaaaagccatctgtgacccctaaaatagattggaaccatttgggtttatgtatcttggaggcacagtttccttaaagatactcattttgttgtctacttgaaccattcttcccatcccttccacttctcagcagatgacatagctccctgtggggatatatctgctccctgtaggtacaattccaaatcacctcactgcactggatgtgagacagcttatggcagctgctgcttccacctagagaaagacatgggcctgcatccatgctgtgtgtgattcatgtactcatgtggccgtgatagctgtaatcggctcatagatcattggatctgttcttagttttgttcccaggaatatctaaaaataggaaactggtccattcagggcttacaccttttgggtgaaaattcaggattaatgtttttggatattattcctttggaggacataaaaggcaatattgaccattcatcattcatctagtatttattgagcacctactatgtgccagggactgagagttcagtaatgaacaaaacacatgtaaaagacactcaaatgggacaagataattagcacaagttattaagagcccaaggggaacccttttctatttccactgctgtggatcatcagtgagtagacatgggtttaactgtctccctccttccttgcagacctttctgcccgtgaagtggatggctcctgagagcatctttgacaacctctacaccacactgagtgatgtctggtcttatggcattctgctctgggagatcttttcccttggtatgggcctgacattgctgcttatttgggctgttctgaaacaccactggaaggaaaatgtgttctttcaagccccaggatgtagacagtgttaagataacctggtgtgaggccagtatgctgcagccgcctcaaaccacatgttgtgccttattgtgtctgagataggcccatgcaggtggagatgggggtttttgttgggggttgcgtctcactcctggcctctgcccctcctctcctttgggctatgccagagtgacttcctcccactggaagtggtcccaatgacattcgcatcccagctgctttttcattttgggctttgggtcacatgggttcacccatggagagtgggccctccctcacctggtggcgattgatgctcaggtgaaaaggggtacgtggcgggaagggcagggctctcattcctggttgtcattggccagtcttgacaacccaggtgctgaacaacccaggtgccctgggctatccggtgaggtccctaagagaaggatgagccataaccctgacatctggatggttcatctggggagatgagacttacacacttagggataaacagtgtgctgctgatttaaaattgtaatttgagtcttgagtaaagagaaaggagtcctggaatagtgtgggaaggcttcagagagggaacttaacttgacctggccttggctttgaaagtgtgaaatgtttcatgaatttatctgtgatcaggatgtaatagtaaagtgtgtcttcctgccccgtctcctttttcatcctagttctccctccatggatgatcacaatggatcatccccgagtggcttaatggagtcctgtactcccttaaaagcagagaggccacaactttgatttttgctttagctatttgaacatacctggtgaaaaagactctctgggttttaatgattcagaatttctccttgcttttctagttcattttgtctgtgttgatccagtagtcatacacattgaaaaacacttgaacgcttatttctaaagatgtagaatttttgtgatggtacttggacttgaccaacctggagtcctaattaaacttaaggtttgagctggtctctgaagtcaaggagatgatgacactgaattttcttgaaaaaaccagtgcttcaaggctataggatctgaaaggttttctaacagtgttctatcatgccaagtgtttcagcaatgcactgagcgtttgttagtcctggtgttttattgtttggcttttaggtggcaccccttaccccggcatgatggtggattctactttctacaataagatcaagagtgggtaccggatggccaagcctgaccacgctaccagtgaagtgtgagctccttccccatcccgggggcctgtgttcacagtctgtgggtctagggggagggaggggccctgagacttccccctgtgcccactcttgagttctgtccccacagctacgagatcatggtgaaatgctggaacagtgagccggagaagagaccctccttttaccacctgagtgagattgtggagaatctgctgcctggacaatataaaaaggtgtgtttggatctgtgggtggaaaggtctggataaagctggaagttataccagtgagctgtgctgttccgcagttctagaggagcattttcaaaagaggcaaaagactgtgtgatccagtggctgggcttcatggcggtgctccacgagaccctagtagcaatgatgaatgaaaaccctccccttcccgtggggctttcctttcatcttatatgtgcagtacctgtaagcactattctccagatgtttgagtatcagaagttagtgtgcagttagaagactcagggcatccatggccattacatcactaatttgagtgcacttaaatccatgcgaaattggcttttaccagcggactggaaggaacaacctcagctgttatctgtggcaccagctggttttttgtggaataggaagcattgttcaaaggaacaaatgtaatttcttggaaccaggcaggatatgtaaatgaatgaaacaactttctgctgaggtgttgagaggaaaactcagacataacctcagtttcttagattgagattagtccctgtgtagactttttatacttatcatttttcttccttcttctcaaggaggaatagtgttaggagattgtgtgccgaactggaagttaaatgcttctgtctgttaattatctcactgcccactacaactttcacaggtgaggcagtgaggaggcagaaggaaattaaccctcagttggtcaaagatgctctgactggtggaaatgtgttggtgggaagagattgaagttattgttgaaaatagggtcttttcacatccaatgtgagacctctccaatgtttaaggatcatgaaggctttgggtattatccacccaatagaaggcctcactgcctctctatgggacccatccaagccctggaaaggcaacgtgatggggaccagaaggattctcagttgtagctactgacttggagaaggggctactggtatcttagcacctaatggcagaagctctttaccattggtggccccttcttcatgttctatgtctctggggatagttgacatgactctccttcaactaagtcccacatcttccaggtagtttggaaatatgtacagttaaataatggtaagttctgagtgtctctattcatttttgaggtttggttgttaacacttgattaaatatgttcaatgaatgtttatagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacaggtagctgtgggggcagcctcggtgtctcacctttcccctcccctataggccctgaaggagaggacccattttcccgataatggtgcactcccggttggtaaatatgtactcagggacaagttgcagaatcctcaggaggtccacgtggttttgaaaatgcttcccagatgattctaatatgttccccctggggctgggagagggatgtgcatgttgtggggagagggacatgcttccctggtggagaatctttgagctaaattctcaggtaatttgatcaaattgatacagaactgtgattactgagatcatataagcctctcctgccattgtcttaaatagtcattgaactggggaaaaagtgaagagaggcgggactgggtcctttgacgctataccctacctgtgaatttgaatcacctgcagagatttaaaaactgctgatctacaagcctcacccaaaacaacaaattagaatccctgggggtggtggccaactgctccctggctgatttgtttcttctttcttttaaattttgtattatggaagatttctaacgtgtgcacaattcacatagtatagtgagctgttcagtattcgtcacccagcttcaatgactatgccctctgccagcctggatgcacacatggccatgtctgtctctcctcagcctcctctggattgtttggaagcaaatcctagacaccttatcatttcacccataaatattccagtgtgtgtctcttaaagataagggctctattttaaagaagaacaacagttattaaaaataactacaatgccgttatctcacccaaaacagggacaataaatcgttaaggcatcaggcagccagttaaagttcaaattatctcacaaatattatcatactccattaaaaagtgggcagaggacataagcagacacttttcaaaagaagacatacctgcagccaacaagcatatgaaaaaaatgctcaacatcactgatcactagagaaatgcaaatcagaaccgtgatgagataccatctcacaccagacagaatggttattattaaaaagtcaaaaaataacagatgctggtgaggttgtggagaaaaggggaagcgtatacactgcttgttgaagtgcaaattagttcagctattgtggaaagcagtgtggtgatttctcaaagaacttttaacagaattaccattggatccagcaatcccattactgggtatataaccaaaggaatataaatcattctaccataaagacatgcatacgtatgttcactgcagcactattcaacgatagcaaagacatggaatcatcctaaatgcccattgacagtagactggataaagaacatctggcacatatacaccatggaatactatgtgttgataaaaaagaacaagatctgagataccatctcccaccagtcagaatggctattatttaaaagtcaaaaagcaacagattgtggcgaggttgtggagaaaaagaaacacttttacaatgttggttggagtgtaaattagttcaaccattgtggaagacagtgtggcgattccccaaagacctagaggcagaaatactgtttgacccatcaatcccattactgagtatatacccagagtgatgtaaatcattctattataaaggcacatgaatgtgtatgttcactgctgcactgttcacaatagcaaaatcatggaatcaacctaaatgcccatcaatgatagactggataaagaaaatgtgatacatatacaccatggaatacgatgcagccgtaaaaaggaatgagatcatgtcctttgcagggacatggatggagctggaagccgttaccgtcagcaaactaacacaggaacagaaaaccaaacaccacatgttctcacttataagtgggagctgaacgatgaggacacatggacacatggagggaaacaacacacactggagcctttcaggggttggggattgggtggaacatcaggaagaatagctaatggatactgggcataatacctgggtgatgggatgatctgtgcggcaaaccaccatgacgcatgtttacccatgtaacaaacctgcacatcctgcatatgtacccctgaacttaaaaagtggaaaatacaaaaatgaaattaaaaaaagaacaagatcatgtcctttgcagcaacgtggatggagccggaggtcactatccttagcaaactaatacgggaacagaagaccagataccgcatgttctcacttataagtgggagctaaaacaacgagaacacatggacacaaagaggggaacaacagacaccagggcatagttgagggtgcagggtgggagaaggaagaggatcagaaaaaatacctatcggatactgtgcttattatttgggtgatgaaataatctgtacatcaaaccgccatgacatgtgatttatccatgtaacctgcacacgtgcccttgaacataaaataaaagttaaaaaaaaattatcatacacttgttttgttctgtctgagatccagataagagtcacacattgcacttggttgctatgtctctgtaagttcactatgcctctattttttgccctcttacatattatttgtgaagaaaccatagtgtttgcctgtggagttcccacaatcggcattttgctgattacatccttgaagtgtccttctcaggtgcttctgtcttctctatgtgttgtaaactggtagttagtctaggaacttaacctgactcaggttagatctttggcaaacatgcttcatagatggttctgtgtgcttctgtcaagaggtatgcactgtccagttgtctgccttttgtaacattatcagtcattgggtgatcattacctagaatttcttttttttttttttttttttgagatggagtctcgctctgtcacccaggctggagtgcagtggtgtgatctcagcttactgtaacctccacctcctgagttcaagccattctcatacctccgcctcctgagtagctgggattacaggcacatgccaccatgcccagctaatttttgtatttttagtagaaatggggtttcagcatgttggccaggctggttttgaactcctgacctcaagtgatctgccggtctcggcctcccaaggtgctgggattataggcatgaaccacctcacctggcctagattctttaactcagcaccaaggtggagctaatgcccaggcaggactgagaatcactggttgacgtggtcagatggaggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgtgtgtgttttcctcttctttcccatcagaacattattttggaggcttatgactgtgacctttgttaaccaatttaggtataatatgtagacagcccttgtttatttgtatggactgggtaattttgaaagtatggcttttctattttgttttagaatatgttatgtgatttgaagatgggacacagtggcccatcagtcttcggttttttattatgctttgctcaggccagtttttataacgtgtttatatctcttgagcatacggtgttcctccaagttttgggggtctgcgatggaacttcacgggggtcggggaaggctgggcagtgaatctagggctctctgtctcagatcctttctcaatttggttactttgtgtttgtgggctctgaataatatttgagttgtaagagggttctgcttttatataaagttagaaagtcacattggaataaataacatgagaaaggtgcccagaagttttctagggctacaacaggctgagctgcagaatttgacacgccaggaattgaactttctcagttgaagttcacgttcaagttaagtaacttgtgtggcatcacacagctagtaagtggggggaccattccagacctaaggctttctgactccagaactcccctttcagccacttctctagtacgtaaggagccgtcacctgggccctcaagttgggggttggtgggggggcatttgatgtcaagagagaggggaagagggcattccaggcaagtggcaggagatcctgagaacacagtttggatgctcaggaggcttccgggagagcacctgatgggcctggctgcagcttgcaccctgatgggcctgacttcaccccctgctctgccttcccaggcctttggatcaggcattgcttatgttctcttccactaggattgagtagggaaagtagaaattcttgcagcttgtcagtaactttgatgaaagacccagcagaaaagcaggaaagctgaagagtaaaaatgatgggtggaccttggttttccacgtggcctaccacagcatgtcaggcctgggggcagaatcttgccatactgtgcagcccaaatttgaatgccaaaggctttcgtttgtctctggggggccacagtctaggtctagttctgtgtaggagttgtaatatttgctcttctctccctcctccagctcgcagacctctgaagagagtgccattgagacgggttccagcagttccaccttcatcaagagagaggacgagaccattgaagacatcgacatgatggacgacatcggcatagactcttcagacctggtggaagacagcttcctgtaactggcggattcgaggggttccttccacttctggggccacctctggatcccgttcagaaaaccactttattgcaatgcggaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaatcaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagtttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggaattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgggtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagttatactaaggtttcagcatttttgtttttagtttaatcataagaattaaagcaatcctgttctatttactttcttagcaacatttgtaggactctatattaggccttttttttttttttcctgagatggagttttgctcttgtcatccaggctggagtgcagtggcgtgatctcagttcactgcaacttctgcctcccgagttcaagcaattctcctgcctcagcctcccaagtagctgggattataggcgcctgccaccatgcctggctaatttttgtatttttagtagagatgggggtttcatcatgttggccgggctggtctcgaactcctgaccttagatgatctgcctgcctcggcctcccaaagtgctgggattacaggtgtgaaccaccacgcctggcctttattaggcttttgatgaaccaatagaatatctaaggtttaagacattatatgagctagattgttccacgacacagtatttgacttaaagatgattggcacttggctcatctttggtctcatcatttttttgattgttcatctttatcctgtggtgttttcttcccctgcataaggaatacaggactgcagtaactctgtacaacattcaactgtcgtaaaagtgtaggaagtaaaatgttaaattatttttttcaccgtgtcttcttccctgtccctgtcctgtttccaagaggcagagctgcaccacttggtgtgtcttttaaacttccagttccctttgtatgcatctgtgtatatatattcccatacacacatctctacgtttgcttcatatctacctaaatgggttctcactttatgtaatcctttgtaatgttcttttttctttcctttttaaaactatttattaaagcagttttagatttgcagtaaaattgagtagaaggtacagagatttcccctgtgtgccctgcccccacaccaacatagcatctccatcactaacattctccacctttgctacagctgatgaacctacattgccaaatcattacccataacacagtccacagttctgttttttttttaatgctgttttagcgatctctgtgaaaagtatacagaggtattagctccattggatcccattatgtaaatgtaccataatttatgcaatcatggtcttgtaaaatggatttacagtttccagttctttgctattaaaatgatttcatgaacatttttgcaacatacatatttgcatacaaaaatgtgttttgtagaatggatttctacaaatgaaattgctaggccaaagggtgtgcagaaataaattgatgttgagctgaagtcttcagataggattgatacataagttcttgagcatctgcacgtgaatcactggctttgcacattacatgcagttttctagtctctgctccacattgcccaggaatcatggtcttcaaaataggattggaagaaatacaatgtggtaagtgtgagagaatgtgggttttgtgttctgaagcatactgaagcaagtgactttaggaatttaaaaaaatggtacaactcaccttattttgagctcacggataatgaaaattgattatgttgttaataatcagaatatagcaccctattccaatataactccttatccaaattcaagtagcctgcagctggaagcatacttctttggagttaaacctccaaggagggattcagaagatcatggcatatgagaggcaagactagattgcagctcaggacagagcagcatgcagcagcttgcattgtgaattttagctccagatcctgagaggacccacagaccctctgatggaagtggacttctcctgcaggaccggggagacaccccaaatattgtgagttgccccaaatgcggaagtggtacagggagaccctcctctaccgaatgcgcagtcccactggagcagctgaagttttgcttgcgggagaagtttctgactttacctcaagctgagtcaagttagagagctgagcaa

SEQ ID NO: 12575 - DNA, 23672 bp, Human
accttgcacttagtgaggtcggaaattattaaattggggcttccacactacacccagactacaccaggagaaacagaatcatagttcacaacgcaaacgaatgccaggaatggtcagtgagtcaaaggaccagtcaaaaacaatcacacttgtgactagactcgtggctgcattaaacattgactcattggggttccaggggccaaaagactggcctttctgcctccctgggactgtgcttgaaaacgtctatttgccacttcagaaagcacagtatgaggtcagcatctgggcccagggcagctgcctcattcaggtggtggcagtgtaaggaggagtcgtgtaacgcgtgtcatcagattccagttcagttcctgggcatacaaatatgaagacttcattcctgccttcattgtaacaagtattcattgcagttgggagacagggtggggtgtgagacacacagccactgaatttcaaagcaacgtgataatgctagattatctgtaccttttcaaacgtgtatgcctagaacccaggactgtgcctcgcaaataaaaagtgttcaacaaatactggctgaatgaataaagacagagttgtatagacatagagagggcaactagagcactctgggagttgtaaaaagccttaaagaggagataactgtttgaacttttggaagaattagtttaattcccaggcgaaggaggaataaagacatccctgaatttatatctctcttttccaagaaatccatactcattgttctttatccagccgggattcagacagcaagtcccacttgccaagagtgggtttatcaagcatcaaacgggcccgctggggcaactatgaaaagtgtagttcacttggtgcaaactcacctccactgtaaaagactttgcttctgaataaattatatgtaatgtttccatcttttcacatctttcatgactcaatttttttttgctggtgcaattttcctccttggttcttcaagacgactgcaacggatgatacagcctgggttagggggtaggtaggagggaaggtaggagtggttagaagtccaccggggtggccgggcgcagtggctcacacctgtaatcccagcactttgggaggccgaggcgggtgaatcacccgaggtcagaagttcgagaccagcctcatcaatatggagaaaccccgtctctactaaaaatacaaaattagctgggcgtggtggtccatgcctttaattctagatactgggaggcaggagaatcgcttgaacacgggaggcaaaagttgcggtgccaaggtcgtgccattgcactccagcctgggcaacaagagcaaaactccatctcaaaaaacaaaaaccaaaccaaaccaaaacaaaaaaaactccaatggggtgtatgggtgggtccagggaagcttctggttcaacgatgagagtggttgattttcttaggtcacagcgtctgacctgtggagccgggtatgtatacaccctaaggcataattagctcaagtgttgtggtagtttattctagcaaaaacatctttaaagcttacgttcccatttatggatctaatgaggttctgctgggattcaggaatgagagcgttaatctttgcagcattttctcgtcacccggcacacccgctctcaagacgcctaccgaatagtctactctcgcgagagtcagaaaaaagtcaagctttttattaacaccgcccccagccctattagttaccaagcaacagtgccaccaggctcctcggcgctgggaaactcaggagcttgtgatctctctggttccgacttccagccgccttcccgagccagttaggcgattgcgaccctgccccgccccctgggtcctgcaggcgcccgattggtggatgattctctccaggtgaggacctacgcgcgagggggcggggccagacgggctcacatgatttgccggcgactgtagcgccggtcccggccacaagctgtcggctcggttcggtcgcgttacagggcaggcgccggggccaaggcagggagggatcttaggagagatcgtagggtgagccacagctgcgcagccccgggtagggtctagcggggcgggatgtgggggctgcgtgcccccggatgaagtgcggggagaggtgctggtccccaggcatggcaggcagcgcggacgttctgggaccgggagccacagtctgtgtttgggttggaggatttgtgtggtcagtaaaggaatcgtgtaaggctcttgaaggcgcaggatcttccgtcctcaccagccccctgttgtctgaattgggggcatgagctcaggactttcccactccagtttgaatcagggcttacccctcttcctgaggtgaccttggggaagtcatttaccacctcagcgctccggcgttctttagactgagtcccgggggtaactagggagagggtgcggagcagggcttgagaatgcactagaggagaaatgacgacgtgctagggctgtcttggggtccagttactgtttttccttcagggaatatgttcgagattttcccacgtccctcacttttttcttttctttctttctttttcatttttcattttttttttttttttttttgacagagtctcgctctgtcgctaggctggagtgcagtggcgggatcttggctcactgcaacctccgcctcccgggttcaagcgattctcctgcctcagcctcccgagtagctgggactacaggcgcgcaccaccaggcccggctaatttttgtatttttagtagagacgaggtttcaccatgttggccaggatggtctctatctcttgacctcttgatccgcccgcctcagcctccccaagtgttggaattccaggagtgagccaccgtgcccggcctcactgtttgcaaaactgagtcctaccgttagattggagttaatttcctggtaatgtacttcgtctatacataacccaccccaccccaactgctgccactactctgcccagattcttaaaactagaatctgaggtcatgaaaccttgagcaggacacttaattcgatgaatctcaaattttcaatctgtaaaatgagaagaaataatggtggcaaaatctgcctaattacaagattattgttaggactgaagaagataacgtctgtaaatgtagactcgtaagtcagaagataaatgtaaggttctagtgcaactctttttataggtgaggaaacagagggctagagaagtagctgctaactgggagaaacaggactgaacctgcctcttggcccagggtgtttttacttataccacacggatccaatgcactgactttttttaagttatgtcttctttcttccccttcccttttttacattctacttctctgtttcagacatctgaagagctgccatgtctggggcatcttcctcagaacagaacaacaacagctatgaaaccaaaaccccaaatcttcgaatgtcagagaagaaatgttgtgagttctggcagagaggagggactgctctctctcagcattttatcttgggaatatagttataatcctggactctgctgcttggtgggagtgataaataattatttgacatggaaatttaatgcaaagtctccagggtagaatgtcctgtctaaaacaagtagacttagtgaaatgtctgttcttggggcttgactactggtgtagtccagcagtttcttactgctttcttaaactgaatctctgtctcctgggatgtttgcacactggcttgctgatggaagttagaactaacattattgtacacacaatgagtaaggcacagttgcaggtgcaggaattacttggagctggtaatgttaccagctttatctgttgggctaagttttgggagagtgctgctcattgtagaaattgcagatgggagccagtgctgcttggtttccttcctacaggcctgaggggaatgagccctgacacttggcttctcacagtgtcttgggcatcttactttctcacaggtttagcctttgtactttgtaaactattttccctataggttcatttttttgaggacagctttcacatgagcattttcatttctatgcctgtcttttagatagaaacagcaggagggtttgcgaggagatgaagcatcatttcctgtccccaagcatctgtatttctaagcatcataggctgcatagcttcccaaaagatctgggactctgttccccacatattttggggaacttcaaggaatgctaactcttgcctctgcttctggatggcaccattcctgcagaatcctgtcagtcagttcttctcacttcagtggttatatatatatatatatatatagccagttagtcaaggaatatatatatctcagcaggtggaaacagccgaccagcatgagaccaggaattatctcatgttcaaagcttttcccagagcctcgaccttgatgtcatgcccttgtcagtttcatgattgacaatgataatctctcttcacctagcacccatggagcctgctggacagaagcagctggctggatgtgatactggggttggcagagttagggtctacaattagggtctcttttctctgccagggcaagaagccaggtgctaagggcagaataccccatgagagataactagtatagcatgatgtttgagtatagcctctggagtcagactgcctgagtttgaatcccgggtttatgacttcttagctcttgaacaagttgcttgttctctccatgcctcagtttactccttttaaaagtgggaatactaacagtgtctcccccaagagtgatgtgaggattaaatgactaaatgtaggaaggcgcttagaagagtgttgggcatatatctaatgtgtgttatttttcacaggtgactcaatctgcctgttgtatttattcctgaaatgtttatattgaatcatactcaaatgctgtattggaagctcactatttaaaagagggctgtgaataattattttttcagtaaaaaatgttttcttctcttatttgacaatattgtaacccagatttggggatctaggatgcacctcttacagggaggtacactaatgttactagggtgcttgatccaaaagagagctggggctggggggcaggatcgataattgtgggagtctctgactacacgatgccatgtgtcagtccttctagctttgcttttttctccatggtaggaatctcttctacctgctttcctaactcttctgtagttcctttgccttgagggctttcaagtcagggaagcagtaatccctggtttctttcctgtcttctagactctaattcctgctctgggctctaatctctttttttccatactctagtttctctaaatgcctttttcttctctaagaagaagaaggtgtcctaaagccactgtgatttatttaccctattctctcctcacgtcacagtcgggctgtgagactgttgcagacatagtcaaaggagaaaataaagttatgagtatatgtgttaacttacttccttttcctctgctatagagctgtactttggagctggttcacctggcagcttagtgttcacatcagcggctgctttattaatagcttaaccgttgttcccttgctgctcattacacctgtgttggctaactttgactccgggaagtgactgggcttgaggatttcagggctgaagaatgactttagggagccaaaacctccgaaggagcattactgggacttcaactgctccagggatggggcgaagaggggctactggccgaggtgcctttacggtgctcagaggactggtttcagggcttatgaaagcagaaatggagggccgggtgtggtggctcacgcctgtaatcccagcactttgggaggccgaggagggtggatcatgaggtcaggagatcaagaccatcctggctaacatggtgaaaccccgtctttactaaaaatacaaaaaaactacaaaaaaaaaaaaaaaaaaaaaaaaaactagccgggcatggtggcgggcgcctgtagtcccagctactcgggaagctgaggcaggagaatggcttgaacccgggaggcggagcttgcagtgagccgagatcgcgccactgcactacagcctgggtgacaaagtgagactccatctcagggggaaaaaaaaaaagcagaaatggagaaatctacatgctttttttttttctttttaatttttttttttgagtagttctggaacagacaaattcttccatgtacctttccctaaatacaaaagcaatgtatgttcataaaaaattcaaactacagaaaggatttagaaagcgaaaagtaaaagactcctgtttcttccaaatttgattcttttagacatcttattctggtatatcctattaataaaggtaggttcatattgttcatattctgttcagctgccatttccttttttatttttttaaataagttactgtcttgtggacatccttttaatgttgataaatgcagatttacctcattctgcattgtatggatatgccagctttccacggataggtatttaaattgtttccagtttttcatcatcacaaagagtgctgcagtgaccattcttacacgtacacctttgcacatttgtgacagcaacttttcctacagaaataatagaaaagatagacacattggaaatgttcatcagtattactaatttgctctcctaagaagttctatattgtaagctgttttcaatattttaagatatttgatggaaattgggcagcatcaactatagccatagtggttaactgaaacatcagctttcttagtgtttgaccgtagttatacgaacttggttatttcatgcctgtcaactggcaggagataatcagcagttctgacttctgatgaataaagataaaatgtcactaatgaaacatgctttatgggcagcatatttctaaatattaggcctctttagagccaataaaagaagacgtcctgggtcctgaaaaggctgggaaccattgctctcctagaccatccttcaggattagaatggagagcaagttgtgtttaccgtgagggaacctttgtcaagtgctgacatgaggcacaggagctggcagctgggactgaatgggcagtcatgagatcaggagactggtcagaaccctgaccttgactgtctattgtgggaccatgggcaaagctcttaatttctccaggcttgagtttttccatttacacgagggaagttatcaagtcctcattttttttgtaaatcttttttttaaaatacatttatttatttattttgagaccgggttatgagactggctaatttttatatttttagtagagatagtgtttcaccatgttgccaaggctggtctcaaactcctgggttcaggcgatccacccaacttggcctcccaaagtgaggattacaggcataagccactgcgcccagcctcaagtcttcattttatctaagcaagtttatgaaaggaaaatgagtttaagtttaagaaaaggagttgaacctggcttaaagaaggtggaagagaatttcaggattgaaacagttttccattgtctatcaagagatgggttacattgtctctgaaattaatcaggtggcagtggcaggtggttttgttttttaacaggcaggacagaatgttcctacttttgccagtgtggtaatttgagataggaagtgtggtttagttttgtactccagaaaatgagaagccctggttgtagcaggtgtgcttaagtgtattctggacagaggcgagaggtgcgttgctggagggctcttgggaggtcccagtggatgcagttttttgttgttgttgttcttagcattctctgtccacatgggtaaacaagagcagctggttccctggttgccttcagagcagctcccaagtatcagttcattttaaactttagggagggtaataggaccttcgggggaagtgcctaatgggctggaaggtgcggacaaagcaggcctagaagtgcaggtaatgagccaaatcatgggggattgagagcaggcattgagccgagctggagaaagtgaagactcaggggattttactacttaaacctgagacagctgatcccatgcagaggctatctgcttgttaggggccagtgatcagggattaatgccagctgaggcttcagggtacagtttgcttgcctttaagctccctatttgaacacagatgaaaatcacttatgttgctcctttacctaccttggaggggctcctgctgagactcaggaattttccatgtgtgcagtgggtaaaggactaaaagccaagccctctgaccccaggtctgggcctccatttctccctcctcaccactagggtcactctgagtacttcttgccaaacacccttaggaaacttttccttccgagggtggttctctacctgggcccctcctcccacttctccattgagatctttctacatttatttctcaaaaaatgaaagtcatatttcccatccaagtacctccattttacagaactgtttcttaatcttacaaggtcccttagtaccaggcagaggggcagccgcaacttgcagggcaccttctgggaagcagtggtgggaagtgggaggtgaaggtgtttcttcctttttcccccatcctgtgcagggccttccctcattggagccggcagagcctgagctatcccagatgacctcagtgtggtttttggccccgggacagtggctggcagcagttcaggtccttctcccacctctcctctgcagcaagatgggccgggaggagccagcccctgtgagcaaagtgatgaggaacctctttttatggagaaaagctgcaaggaagcacaagatctgtgttctagtgccagctgtacccttgactcattatgtgtccctagacaagtcacctgtcccctgaacatgtagtttgccctgcctgtccagtgagacttatctctgcaaatgagcattcctgaagtaagttaatttactaaggaagggtagactgaggactgttaatgcttctcaattgtcttgcttttacgtgggccatggtggcagattggccctgatgccctttgtgggctggctctaccctgaagcttcctgaggtctattcagaatgtgtatcaagtaagctttgccaactcaatctcactatggtttagaaattctggcttaaagaggagctcatgacctgagtgaaaaggccaaaacagcttgaggcagggctttttgcagtgggcaagctaattcttgcccatggttctgaagggatgagtgggatcctggagacagaaactctgttggacctattataggagccagctcagttctgcactggtagaatctccaagcattagaccttccttcacagctctgtcatttttatatttctaggcattcttatgttaaggatgatgtcattgttacttttctttctttctttctttttttgagacgaagtcttgctctgtcgcccaggctggagtgcagtgacgggatcatggctcactgcaaccttgaactcctgagctcaagcaatcctcctgagtagctgggactataggtgcacactcccacatctggctaagttaaatatatatatctatatatctatatatctatatatatctatatcttaaatattatatatttaagatatatataaatatcttaaatatatatattttatatatatctttatatatatctttatatatctttatatatatctttatatatatctatatatctttatatatatctttatatatatctttatatatatttatatatatctttatatatatatatatatatatatatatatatatatattttaagagacaagggtctctctatgttgcccaggcttatcttgaactcctggcctcaagtgatcctcccacctcattctcccaaattgatgggattacaggcatgagctgtcatgtctggctgcagcatggttattttctttcttagccttgctacttttttcctctttccaccttgggtactgcagtgaagacctcagacatgtgggaaagacgtatcttggtttgggcattttctggaagcctgcataaccttttaactctatttcaggaggcctgcctgatatctccttatttgtcttcccagacttgctgaacctttgctccacaggtttatgaagataaaatgagattatgactatgaagttcgtagctcagtgtataaaccttactagaccccagcggggctgggcgcctcacgcctgtaatcccagcactttgggaggctgaggtgggtggatcatgaggtcaagaaattgagaccatcctggccaacatggtgaaaccccatctctactgaaaatacaaaaattagctgggcatggtggagggcgcctgtagtcccaggtattcggaaggctgaggcgggagaatcacttgaacctgggaggcggaggttgcaatgagctgagatcacgccactgtactccagcctggtgacagagtgagactccgtctcaaaaaaacaaacaccaaaaaaccttactaggactctagtcatttcgttttattttgtttcatttccttctagcatgggcctcctacatgaccaactccccgactctgatcgttatgattggtttgccagcccggggtaaaacctacgtgtccaagaaactaacacgctacctcaactggattggagtccccaccaaaggtaagtgtggctcattccctaggaaagacaattattagttcctgggcctcacaggtctctgggagacttattcttcctggcatcaatgctatagggtgcttttggcagaaatagcagttgctttctggtttactggagttattctctattcccagacttgtctcctcctggcgtgggtggattggcctagttttgagggaatgcctttgataggactgttaagatttagatgagcatagggctgtaccttttcagaagccttacatggacatcatcttatataaccctagcagtgtctctgtgaaatagacagagtggctgaggaaattgaaacctcagacagcttaagacttgtccaaggtctagaaagtcagggcttgaacccaactcttttgactcttaatctgatattgttcccaacctaccatgctgccgcttttttcatccccttggtcactccgacattaggccaagaaacaagtcccatttggtggggccatcatattattttgctgctgaaggatttgggtgtcttctacagtgtttaatcttggggtgtatcggcgtgaagcagtcaagtcctataagtcctacgacttctttcggcatgacaatgaggaggccatgaagatccgcaagtgagtcttgtttaaggcctgatctccaggtcagctctttcttggccgtcatgagacttggtgtgacagggcttggtttcatctcagtaaatatcttaaggggaagttaaatggaagttatctgatgggcaagtgaccttgggcttgggtggtcagaagaacagggctcagggtgattgatacctgtgtgcttgtaggagaagtctaaagagggctaagatctgtgcattggggcaggggcaggaaggggttataggatggtgtgaaaaccctcagtgagaaagttgaaagatctagttagagaaaggttttgaacagtgggaaactaagtgggcagggatgtgacttctgtagccacccgaatgtttgtgtctctgactgtttgagcttagctctccttgctggtttcatttgctcttatggcagacagtgtgctctggtggcgctggaagatgttaaggcgtatctcactgaggagaatggtcagattgcggtaagctttatctgctgcttcttctttctggtccccacccttgcagcagcctggctacccagccccaccttgagtctgccctggtggggttctgtttctctgttcctgctcatttaccttgtgtactttcttcacaggtgtttgatgccaccaatacaacccgggagaggagggacatgattttgaactttgctgaacagaattccttcaaggtaggatctgactccatgttggaggaaaagggatgagtagaggtggggagtcaggctacaggcatggatctctcactctagtgggtgaggacaggatgggatatctgaatctcttctctcagagcattcccccagtccttgagtgttttcattcaggtcctttctcagactgttagcctgtatgtttgaggcccaggggctgtggtaagagctatgaggaggacttgagggccactttcatgaagaaaatcctgggagatgtggtggctgggtggggtagatgagcatgtgctcttaattaacagcctggcatttttgacttgcttatcactgccttctctccatggccaggtattctttgtggaatccgtctgtgatgatcctgatgtcattgctgccaatattctggttggtgacacccctacatatcatctcctcttcaccttttgtgctgtgtgtgttgtggggtgtgtgtgtgtgtgtgtgtgtgtgtgttgttggggaggggtgttttcgtaatgaaagagagaaatagacatgtttaacatcacaaagagatcttttctatctgccagagccccatctggtacttctacactcttctcttgggagaggaaactgaggctttaaggaatcaagtaagaattagctgttgaattgaaaccagggtttaggttgtaggattcttggccctgtgctctaggtattatctggatgttgagacctagatgttggaatagatcagccgggcacggtggctcatgcttgtaggctcagcactttgggaggccgaggcaagtggattgcttgaacccagaaggatcaccttagcctgggaggttgaggccacagtgagccgtgattgtgccactgcagtccagtcttggtgacagagtgagaacatgtccagggaggttgaggctgcagtgagccatgattgtgccactgcagtccagtcttggtaacagagtgagaacatgtctcaaaaaagaaaaaaaaaaaagaatagatcagactcttcgtttcaggacttacctacaggaaggttatctccccagcaattgtccaaagttctcgtcagtgttctatacattgagctccttattccctgtggggtcacaatgtaagccagtccccattggatgggttgtgctctgctggaccgagtagatatctgaacatggtcttatgcaggtgctctcccagccgtaggaacttgggatcatctgaggaagagccatctggtcccaagtcaggcactggggtcatgcaccctattctgagtggtaatagggaaacattggagcctgttctgttttctcaggaaagtacataaagggattggggcccaggagcagctttggctgcgtgactgcctctgtccttcagccaagtgcaggcacatgactccccagttgtcttaacttttttggttgccagggtcacaggacggggcggggcggggcggggggtactcaatgagtggagtgccaatgttccagtgaaaggcgacatttatggacttctttttcttttttttagcagtggctatttgtaggaggactgttacgggcagacctctgatgaggcctttactggttcctatgatttcaggaggttaaggtatcaagccctgactatcctgaaaggaacagagagaacgtgatggaggacttcctgaagagaattgaatgctacaaagttacctaccgacctcttgacccagacaactatgacaagtaaggtttaaggccatggtttgaagggcccaaggcaaaggtctcatctgggaaaataacctttctccctgagttctctaacttccttctgataatctagatctacagtgttaacatcatcccagagaaataaggtatggatttgtggcttttatgtggattgcatcttgtacatgaaaaattgaagtggttggttttgttttgttttgagacagggtctcactctgtcacccaggctggagtgcagtggcaaaatcagggcccactgcaactgctgcccccggggctcaggtgatcctcccacctcagcctcctgagtagctgggaccacaggtgtgcgccaccatgcccggctatttttttttttttttagtaaagatagagtttccccatgttggccaggctggtcttgaactcctgagctcaagtaatccacccgcctcggcctcccaaagtgctgggattacaggtatgagtcactgcgcctggctggaagtgttttttatcatcaattttttctctccagtctctagagcatgatttcctcaatctcagtattattggcactttgaactgggtaattctttgttgtaggacctgtcctgtgcattgtaggatgttcagcagcttccctgggctttgcccactagatgccagtaacacctccaacctgtgacaaccaaaatgtctccagacatgtcagaggttccccggggggcacagttatccctggttgagaatcactgctccatatctgaatgggggtgttgtaggataccctttggagatgtgtcatcagtttttaaagtttatatatattatatgatattttacatatattaatgcttgtgtgtatatcatgcatattatagcataacatatatattacatattgcatatttttatatctatctctctctatatataacatgcaaagccctcaagaacatgcctgactcagagaaatgtctgatcaatgccagctgttgttactatggaagcatttgttggcagtatggtgtagactatagattaacttgtcatgtgtgaggtatatgagccataacaaaaccaagtctatgttgaagaaagatggtgtacacatggaaatctgcaagaatgtggcctcatgaaagagcatgcattcagggcagttaacagctctattcacataatacagacctgcagccaagcaaatggcacatttaatgtgcatggcacacttaatacagtggtctgtttaatgttttgagcctttcagttccttcaagtgggtttcccagaatccccttaattcagaggctgaaaaccacctctagatatggcataaaagtattcttcagttggaacaaagtcccacctagaaaaacatacagaagatctacatatatatacatgtgtatgtttgtatatgttatctctggtagtagggtgatgcgtgatttgcatccttccatcattttttctgattttttgatttaaaataagcacttatgactttttttttgagatggagtctctcgctcttgttgcccaggctggagtgcagtggcacgatctcggctcactgcaacctcccccttcctgggttcaagcaattctcctgcctcagcctcctgagtagctgggattacaggcacccgccaccacgcccggctaatttttttatttttagtagagatggggattcaccatgttggccaggctgttctcaaactcctgatctcctgatctacccaccttggcctcccaaagtgctaggattacaggcatgagctaccgcatccagccacacttatgacttttataaagagaacaatctcatgttggcctcaaagcaagcaatgtctgaaagtgtctttgagagaagcatgattaggtagatgcagggagtatatagacatttctgtctgtgcttctgctgcctcttcccttcccctcgttgctcgtcgtgccatattctggccaggtcttaactgcctcaaaaggggcctattcttctcaccaaattttgggcttagcaaaatcttcaggtcacctagtctagcccctgatgggaaggctgaattctgtttatcctatttatctacattacttgtcacactacaggcactgaggaaatggtacaaacttactagaagttcaggaaattgtacttcatcttggttttaaggagtaattaatctcctaccatttggttccataaacgtgggtgtgacagaggaggggaggaagagcagctgtgagcctgcaagtccctgtagaaatccttttccctctgattcttattctcagatcttcttacctagggaattttttttttcctttcctgtcccagggatctttctttcatcaaggtgataaacgtgggccagcgatttttagtcaacagagtccaggactacatccagagcaagatagtctactacctcatgaatatccacgtccagcctcgcaccatttacctttgccggcatggagaaagcgagttcaatctcttggggaagattgggggtgactctggcctctcggtgcggggaaagcaggtgagtaattattcagcacactggattttctaggcttagagttagaagggcatgactgaggtcatatattttatctccttacttaaatcccatttggacgtaggctgtggtttcatagtcaggcaagtgctcaaggtgtgttcttgctcactgcgtctagctctgtgttaaagagtagataactttgacccatttctgctgtgatcattcaaccatcagatattcattgggcacaacttgtgtacttagcaatgtacagggtgctccagttaaagttcatttccttttgggtttatattaactatgtagcaccttatggattttgaccatggttatgcacgttgtcccttacagaccaagttagcaggctttgtgtatgtgtgtgttgagtgtgtgtgtgtgtgtgtgtgtctgtgtgttttctttttacccttaattttcatttttaaaccccagtttgcccaagctctaaggaaatttctggaggaacaggaaataacagacctcaaagtgtggacaagccagttgaagaggaccatacagactgctgaatctctcggggtgccctatgagcagtggaagattctgaatgagattgatgctgtgagtaggaagctctgaaggcccagaaaagccaacaagagttcaggcaggaactctcagaagtcactatttagacagttttatctaggaaactacaaccaacaagtaaaaactctgaggaagctgactctatggccagcccgggggatcagggaggacaattgtacccctaatcaggggtttcctgcctgattcagtacctgtgccaatcatgggacccaaaccaatttttgagccagcctttctggcacctggggaaagtagggctaacaaggactcattttgttcctttgtatatttgcctcctgggaaaaataaatagctaacaacccacttctttgctttctgcttagatcatttggtcagctattcaggaaaagtttttcccaaaatttctcttggctttctctcttcttgagtacaaaagtagacatttctttctttttttttttttgtgacacggagtctcgctctgtggcccaggctggagtgcagtggcgtgatcctggctcactgcaacctctgcctcctgggttcaagcaattctctccctcagcctcccgagtagctgggattataggcacctgccaccacgcctggctaatttttgtagttttaggggagatggggtttcaccatcttggccaggctggtcttgaactcctgaccttgtgatccacccgccttggccacccaaagtgttgggattacaggcatgagccaccgtgcccggccgacatttctttttctttccttccttctacccttttatttttcatgcaaggtctccagtcccttcagtttccctccttctctgcttcctgttccttttagcctcttgactttcttgacctgtaagttccccccagtagtaggagaatgtggtagcttgagctagagaagttgcctctttccggcagtggtcctcacccggtgagtcacagacactctgtgacactctggtcacaggcagctgcaatacatgaaaggacccagcacagtgcctggcacgtactaagaaactagcattcttcaatgtcatcttccttatttgggatggggctggtgtggtacagtctatctcttcaagccagcttcaagtggctttttgcagggtgtgtgtgaagagatgacctatgcagagattgagaaacggtacccagaagagtttgcacttcgagatcaagagaagtatctgtatcgatatcctggtggggaggtaagacgcccctgtcatgtaaagtgactgcctagacccttgctgagtgtttaactttaatttgggggaaggattgaatgtgatttggagggtctaggcatcatttatcttccttcccttgggtcattttggtttcattcagcttagacaatcgaatgcctcattaattgttaagattcccagggataagggtgacaaggcatcctctgttcagtatgttttagaatcaacacaatcatttttacttctttttttccttgtactctctgaatcccacccccacataagtaagtggagtcaccaagtaaatatatgggataggaattatttccctgtcatcttgagtgttttaggctatttccttgtctaagtggcttccatactctagggatgtgtgaggcaaaagtaaataaaactgaatggcagaggtacaggaaacccctaggagtctcttgtctcactgcctgtattaatctgtgggaagaaaaaacacaacacacacaggttgaactcacacttcctcttcttaacctgtagttttcttggtctaaatattgcttttgaaagatctgagttttctcaagagataccagggctgggggcagttagcaggtgatgtaaactcactgagcctccaggaggaaagccagctgaggaagaagaagtggcccttagtctccaaggtccagccactgacttggctgccagcttgcacctgggctcctgccagcctgccccatttccctccacagtcataccaggacctggtgcagcggctggagcctgtcatcatggagctggaacgtcagggcaatgtcctcgtcatctcccaccaggctgtcatgcgctgcctcctggcctacttcttggataagggcgcaggtgcctttgagggaggggctgggagacacatccagtgggagagggctggacttgcagtggcaccaggattcctgggaaacagacctccctgtctccgctcaaattagagtactttctccagacagcagtgtggggctcccagcagccactgagtcaatgacttgctgagttcactctgctgctacgaaagcttccaatggagagtggctgctgctggtgctccttgatcctgcctggctcaagggccagtgtcatgctgacactcctggcagcatcaggacagtggttgaatattcccagcctgccacgctgcctactaggagggtggtatcttaggagcagcagttgtttctgggtaagggcagtaagaaggtgccgttgccttcttccatacttcgcttcccgatcttcgggagctcctgggaagcctgcattgtggatgctgagctcagcatcctgagctgcttggaagctgttgtggtcagaccttattggcctttgctgtacccaggtgacccccttccattgggctctctggctacaatacttcctgtttttgcctgcgtggaaggatctaagatggccttatttccttccttagccactcagaaggttgggtggctttgtggtctggggtttaagggaggagttgtacaactctaagaggtggtcaaagtaagggaaactcattatgagctctgtagattctttcttccactaacttgaccttactccataatactaagagacttccctcgcctggtctttctgttttcagatgagctaccatacttgagatgccctctccataccatcttcaaacttactcctgtggcctatggtaactatgcacataggggctggcaggagctgggaattgaggaaggtcagaattttctctgaagtttgtctagagttcagcttcattatccctatataccagggaagctccatcagtgccttctgttttgaaagggatgtatgcatgactgtgtgtattgcagaatgcgtacattcctttgtggtatactttcccataactaaggaattttccattgaacctttttctttaagtcctctctttcctctgttttctcagggtgcaaagtggaaacaattaaacttaacgtggaggctgtgaacacgcaccgtgacaagccaactgtaagtattttcccacgatgaacacaccagtttccctgccaccttgagtctctgaagctttgacatcaagagactggggtttcttttatgtacaaaagggaaacagattcagaacttacgtccaaacgtagtttgctacgtctgaaactgatgttggaattatttttttttttaaattagtacccctttcatgagtcttaaccttgaatgttggctcctggaaatccaattaaatatggaaagtgtttggctgaagtgaaatgcaaattactacccccctccaaccccaagtgtccctttagaaagcagagtccagaggagcctataaggtgggggtcaagaggtgtaggtttgttcctaggtctgtcactggtaatctgtgtggtcttcaataagccccttcctttctttgggtctttttcctgctttggaatgttatgctcaaggagcttctcccttttagccccctgatgctaggaggccaggccatgggccatgccctgtgagggaccctgtgtgcagaggagcaggagtgagggaagctgttgtggttacaagcgcattattaacctgtatgagtgagcttttggcttggctttcatttgtgtggtgtcactccatttccaatcagaacaacttccccaagaaccaaacccctgtaaggatgagaaggaacagctttacgcctctgtccagttcgaatacaataaggcgtccaagaaattacagtgttgggagccggcccctcaagcccctcagccctctccgtgcccaggacatgcaagaaggggccgactagccgaagacccaagtcagcattccggtggtgtaactgtgtgtttccctccagccctggcctcctgcccttgtcactaatcaccaaggagtcattaacttcctccctctatgcccacccctgacacttcaccattaatcttaacacagaacatgaggttatgtgtttataggacaacttaagctgttcttcagtttgaaacatcttttcacccaggggcaagttagcaaattgagtcttttaggacagattctcagatgggatgatctggaggaggaggaaaaagatacgctcccttggggctgagcatgccccacactcttggatcttctctctgttccctggtgtcttcactaatgtcctcatgttggtgaagtgttgggggatggagggcgggtgagcagtcgggggacaaaaagtctatttttccttcacttttgtctcttcaatgtgtgttttcctcacactccttacttgactgctttcttcccccactttcatgtcccctctggattgtccagtgtaatgcatggcattgtggtgtctgtctaggaaggaaggggtgattgacaagagacaagtctggcccagttaatgctttctgcagtgggtctaaatggatctggactggaggagtctttcctttcctttctcccttcctctccagccaggtcctgtaagggccagcccagactacaggacatccacagaatattctggagcttgcaagtagacatagggtgagagttcttgcctcctttcatgagaaacagttctaagtcttcgatgccctgggagaatctggctctgagcatgtgggaaatgtcttggtttttatttttaatttagagtcaggcctgggtcttttgaggtctgcagagtggggtttaggagagtagggtgggctctagctcttgcagggctcttagagagcagtcatgtcttttctcccatgactctcaggttctttgccaatcacagcaacttttcctgccaaagccagtatcctctggggctgtttagaagggcagttagattcaggagtcaccactgatgtttgagttgctcaaggcaagaggcagagaagagttcactaaaactgcttatttttgaataatttcagcacactgtccttaagaagaaagaaacatcaaaacaaaatagtttttacatgaccatttttttcccaaatgtggaaaagcttgatgatgaatttaatctctctcattggagtattcttttgttcataaagagaaactatctcatcttgatgtccagagaagtccttggaaccctgtgggatctagctcgtaactgtttgtatttctctattcacttctgtcatttcattttctttgtagggttaaacagaaaatgtttagggaagaaattcttagccccttgatgaccatgatggcttattctctttcccaattttgcatgcaaaatgtacgaatatatgtatgtttttctgagaggcaagtttagggttctcatgggattttaaaaagagataggtgactccccaccttaaagttatctgctggtcttttagaggtaaccagtgagaaggagttagctattttccaagggtgttttcatttggtaatggaagactttttgctgtggttctcatccaggagtattccttagaattgcctttaggattgttgaatcataaacatgcctgtgtccaccttatgcttaatactgactcagaatctctgggatctgggtctggacatgcatgtatttaagtagcttcccggatgattctgattcatagctcgggttaagaactccaccttaggaagttaggtggaaaaatactggatagtagtttctcagacaaaagtgtcagcctaggaattctgaattcctcatagtcctgaaaggacagttctttgggtttgatgtttgagcagatcataatgttaaatgatataaccccctggaaggcaggctgctgtgttttagagggttattctaggttctagtcccatctttaaccctttacattgctgagtgatgtggaacaaatcactgaattaaataattgtctctagagagcagctggggattttaagcaccctggagagaggtgcagaccctgccaggatgataaaggttgtcatcactggcaactgactcctgaccccgggtcctttactcgtatgtcccaagtaggataccataggcagcttctaaaggctgcttacctagattcttctcaaaattgtgtccaagatgttaagtaacctgctattcctgtttagtggttacataacatgtacttagtgtctttgtggagctttgggctggtaggggcagggataggggaaagctaaacagaagtagaagaaaaggtccttgtccagaggaaggttattttaagagacaggacatgtaatttataacaaatggacatttgcaatatagcaacagtctgagtctagaagtgttcaaccatcacatcgcttctcctgacttttctgttgtcctatggctatgagactacaggggttgggggatggggatgcccccaccaccaccagtgtgagaatgagatatggttggggaggcgtgtttggcactttta

SEQ ID NO: 12576 - DNA, 9008 bp, Human
acgtgtgtggcagggacctccgactcatagcggggcaactccaggacaggctccaggggctggggcacaggctcctctgtgggcacagcccctgagtctccctgggggctggcattaagccctgggtcagggaggaaccttatggatgtgagagctccatcatgtcagtgaggagatcggctataggttcctgagacctgggacagcagacgcagtgcaatcctggggaccctaaacagggcccccatcccagaggaatggacatcccacacggcctgggcccaggcagattcacatgggcctcacttgacttaagtccagtctgaaggagagaagcttctgtccaattaggcaagaggagaccttcaagacagccagggtgatctgagcccccaccccaggggtgctccacaggggcaatcagcaaggccaggggatggtttatcaccatccctgtgagttgagggtcactacatgactgtggttttcttgagaatgttgtcaaacatcctaggatgcaccacagagtcccccacagcatagcactgcccagcccaatatgtccaaacggccaggatcaggagccctgacgtcctccgggcctggccaagagcagcatccaaggccccagcctctgaggaggcagtactacagctctacgcaaagcacttggccagcagctggtggcttgtcggctcccggttctgcctgaccagctatgtggccttgaacaagttactgaaccactctgagttcacctttcccatcctatgaaaatggaaattacaagacatatctttagacgaaaggcaatgtctgcgattgcccctagaaacagggctgtcatgtgctttaatcagcagcattccccaggccaggaatgtcacagggctcagacaataatcaaaccaggctccagggtcctataaagtgaaggctatcacagttgggaggagagggagatgcatgaagtgtgtggaatctggggagagcctaggcagaattcaggtaggctgggtttacacagcgcctctgagccctggctgtgtgtcacggtacagtatcccgtccctctggggacagagcttctctgtccattaaataagggaggtcagtggagatctccaaggactgttgtggtgtgtggaagtcattgctgatcctgacttaacccacttccttagtaaccctgggcaagtcccttatgcttcccgtgccccagtttcctattttctaaaatgggggccagatgctgtggctcatgcctctaatcacagcattttgggaggccaagtagggaggatcccttgaggtcaggagttcaagaccagccagggcaacatgacaaaaccctgtcttcactaaaatacaaaaaattagcctggcgtggtgtgcacgcctataatccccgctacttgggagactgaggcaggagaaacgcttgaacccgggaggcggaggttgcagtgagccgagatcacaccactgcattccaccctgggcggtagagccagactctgtctccaaaaatataaaataaaacaaaatggggctgtggcatttgcacctcaaggtcattacagaggtaagtggagctgcagagagcaaggactcaagacccagccggccaggctgagggatgcttgcttttcctgtttgctgaccttgggcttgagtctcacctctctgggctttggtttcctcatgtgtaaaaggaagatagtagcattaccacctcacaggattgttacaagaaagcaatgagttaacacacgtgtgcttagaacagttcttggcataagctaagtaccttacacgtgcttgctatctttcttattctttcaatgatgatggtgtaggaaagtgtttgcaatgggctgggcacatggtggatgtttaataattcatggttgcaatcacacaatgtcagtccctggtcactgggagtcatcatgtgccctgacttggggcctggccctctgcctctgtcttgcaggacaatgccattctctgtctcatggggcgtcctcctgctggcaggcctgtgctgcctggtccccagctccctggttgaggatccccaggaagatgctgcccaaaagacggatacatcccaccatgatcaaggggactgggaggaccttgcttgccagaagatctcctataacgtcaccgacctcgcctttgatttgtacaaagagctggctgatctatcacaaaccagcaatgtcttagtcaccccaacaagcgtggctatggcctttgcaatgctctccctggggaccaaggctgacactcgcacagagatcctggaaggcctgaatgtcaacctcacagagacgcctgaggccaagatccacgaatgcttccagcaagttctccaagccctcagcaggccagacacccggctccagctgaccaccggcagtagcctgtttgttaacaagagtatgaagctagtggacacgtttttggaggataccaagaagctgtaccactcagaagcctcttccatcaacttcagggacaccgaggaggccaaagagcagatcaacaattatgtggagaaaagaactggaagaaaagtagtggatttggtcaaacacctgaaaaaagacacaagtcttgccctggtggattacatttcctttcacggtaaggtagcactacctgtccaagcccgttccactgaaataatccaaacatattctcaaattactagttcttaagctttcctagacaatgtactatgagatatggcagggcatttaacatggattctgcaattttccaaacacaaacaataaaatactttccatgatcaaacaagattgaagaatgatgagtttaagacagccaaaccatcatcttctctacagaccttgtcagagcctttattgtcctaatactcattggaaatccctaatagggagggggcagaatatgaaatgcttcccacatgctaaagccagaaaaatattttgtggcacatgcataaaggaatagtttcatggaacatactttagacgaccctagtgtcccagaagcagtgtcagctttgccgtctaaaatattggggttcaaatcctgcctctaccacttactagcttttgataaaggacaatgcattctacctctctgaggtgctaatttcccgtcttagcatggacaaaatagcatccttgctgtcaggttgttttaaggattaaacaagtgacagagaccatggggatggtgtgtggcatacagcaggtgatggactcttctgtatctcaggctgccttcctgcccctgaggggttaaaatgccagggtgctgggggccccagggcattctaagccagctcctattgtcccaggaaaacagcataggggaggggaggtggaggcaaggccaggggctgcttcctccactctgaggctcccttgctcttgaggcaaaggagggcagtggagagcagccaggctgcagtcagcacagctgaggtccgggctctgctgtggccttagggcaggcccaggcccctctccagcccccgtctcctccttctgtccaatgagaaagctgagctcaagggtccctgaggcacctgcccacttggcatgcctcgatggtgaagctttcttggtacggcagaggggagtctgcctaggcatctgcatctcccctgctcatccagggaaaggcctcaggagaagtaagcacaatgctgtcctcgtatctcaacagaaccagccctctgcatgagatcagaagcctccagccaaaggtggcaaggcataaggagttccgattttactcattaactttcattaaccatccccaagccgctatcgaataaacagagccaaatataaatgcttcttctgtggcaccaggattttgccaattagttcaagtatatagaaactctggattcttctttatcttcaggtgattctcacaaaagctctccagcagccagatagttccatttgaatcccattttacagatgataaagctgaagcagagggaagtgtcctgccaaaggggctcagggctcctttcattcacacacttccacccttttatcccacacctggctgatgcccaccttccttttcttccaggcaagtggaaagataaattcaaggctgagcgcattatggtagagggcttccatgtggatgataagaccatcatcagagtgcctatgataaaccacctgggtagatttgacatccaccgggacagggagttatccagctgggtgctggcacagcactatgtggggaacgccactgccttcttcatcctgcccgatccaaagaagatgtggcagttggaagaaaaattgacctacagccaccttgaaaatatccagagagcctttgacataaggtgatttccagttcaggggctgagtcagaagctgcccagacctttgagccatgtcaggactgaggcccaacaggactggccagagggctggggagggtggacctcacatccctgggtcacagctactgcagaggccaccactgagttcaggcaggaccatccatgctccatgaggaggacagtacccaggggtgaggaggtaaagatctcgtccctggggacttcccactccagtgtggacactgtcccttcccaatatccagtgcccagggcagggacagcagcaccaccacacattctggcagaaccaagaaggaacagatgggcttcctggcaaaggcaacagtggagtgtggagttcaagggtagcatgtccttcaggggacgggggaagagcctgtgtggcaaggcccagaaaaacaaagttcggaattggaacagccaggccatgttagcagaaggcttgcgtttctctgtcgctttatcgatgctgttagattgggtgtcctgtagtaaatgatacttgagcataagccatacattagtgtatgtgtgtgcattcgtgattatgcccatgccctgctgatctagtttatttttatttttacaccgtaaaaccaagatgaaaatacgaaagtctcaggttcataataggaatcgaggctggaatttctctgtcccatgcaaacgcctcctgaggtacctgctccaggggttgagaaagaacaaggaggctgagagaataactgatcagagagcccagagccaggctgcccgctcacaccagaccgtgcttggggcggctctgtcttcccacggaaaaccagaggggagcattcggcctggtgtgatcactcttctctcatcccctgaacgggtgtcactgcgcactgctgccccacgttcccctgggtgtagggccctggggatgttccaggctgggggcccggtgacccaacactacacagcaggatgagacacgcttccaggacacctagaatctgcctgaagggcttctcaaaggaggtggcatttcaagctgccttaacaagatggttagtctgatactaacattctttgattctgggtatagaggagctcaaaggagaacaaaccaaggtcaacttctgattgttttatttttttttttaacttttcttttaggttcaggggtccgtgtgcaggtttgttatataggtaaaccctggggttttgttgtatagattattttgtcacccaggtactaagcgtagtacccaatagttattttctctgatcctctccctctgacttctgatcttgatatgggtgaggacatggcactaagtgggagacgcaatcagaagagaaagcactggcactgtggtgggttccagaagaacaggagaaatgctgctccatgccttgattctctttcctgcatggcaggtctatcaatctacattttcccaaactgtccatttctggaacctacaaactcaagagagtccttaggaatctgggcatcaccaagatcttcagcaacaaggccgacctctctggagtcagtcaggaggcacccctgaagctctccaaggtgaggtcacccagaagaccgtgttgtcccctggtgtcggctggcagattgtgtggaggttgcagttctgtcctgaggctgaagaaggggctaagagacacaaatgaagacccaggccgagctcctgaggatgcctgagattcactgagatgggccatggtcagacggcggagctggggaggcgcctcctgtgcagctggcactttcagggcctcccccgctgttgtgtcattgaccctttgcccagaaccttccagtttggggccttaatttatccgtattgatacaagaaagcttaggctcatttcaaaagactttctggcccctttcatctgtgaggttttgagtttctggtgcatcaccaagcccgaatcaatgaatgatttgagctaaagatgacgctaatttaggaaaactaaaggtggccaaaggacaactttggcagttctgtgaatggctgcgttctcttggggtctgggcaccatgaaggacactgtcagagtccatgtccccaaggagcttcaagctgtgtacaagaaaggagagagccctggaggcagacgtgcagcggggatgcccctccactttctgaattgtgggtgcaccctgagcaggggagaggctcttatagggaaggcagacggaggggagccagccccatcagccaaagccttgagggggagcaaggcctgtgtgacagggagggagaggacgtgcagggtcagtgccacccgagtggagaaaggctggagtgagttcctcacctcctaggatgaggctgtccacatgggcctcgctccaggcctgggctggggcatggctcagcctcggaacgtatctctgcttctctccccttcaggctgtgcatgtggctgtgctcaccattgatgagaaagggaccgaagccaccggagccccccatctggaggagaaggcctggtctaagtatcagacagtcatgttcaaccggcccttcctggtcatcatcaaggatgacatcaccaactttccgctcttcattggaaaagtggtgaatcccacccaaaaataactggctgtcactcctcagcccctcccctccacccctggccccctccctggatgacattaaagaaaggctgaattgccctctgcctgcgtgtgactgcaaacccctcccctgttgtttctgagtctccctttgtgcactgaggctgtgtgtggactccaggtcacagtgctgtctccgggcctcctgaactgtgttcatggagcacctgactgggcaggcatgtgctaggccaggatggagggggctgaatcctcagtttaagggcctggacctgggagcttatggaagagcaaggggctaccaggagcggccgccaagtgcgggtcacccagagagagccaggccagggcctgagtgctagaacgctgtggcactgtgtgacccagaaaagccactttgctgagcctcccgttctcagtggcagcatgaggagagaatgcccccacctgtgagtgcaaagcagcccgtcagaggcgacggcggggacactgccacaccttgcctccctgccaggccccaacccggaggttggggaagtcagatgtgcagcctttggtggcgtctgtgtggcccagagtgagagggactccaccacgtgtgtttgtgtgtgtctgtgtgtgtgtgtggctgcgtgggtgtgtctctgcgtgtgtgtgtctctgtgtgggtatgtctgtttgtgactatgtgtgtgtgtgtctctgtgtgtgtttgtgtgtgtctgtatatgtgtgtgtctctgtgtgtacatctgtgtgtctgcgtgtgtgtgtgtggctgcgtgggtatgtctgtgtgtgtgtgtctctgtgtgggtatgtctgtgtgtgtccgcgtgcatgtgtctctgtgtgtttgtgtgtgaccatgtgtgtctgtgtgtgtgtgtgcgtgtgtgtctgtgtgtgtgtctgtgcatgtgtgtctgtgtgtctaggtagttctgtctttgtgtctgcatatggctgtggatatgtctgtgtgtctaagtagttctgtctttgtgtctgcatatggctgtggatatgtcctgtgtgtgtctgtgtatgtgtgtgcttcctgtgtttgtgtgcccctgagtcaatgtgagtctgagagtctgtgtgtctgagtctatgtgtgttagggtacctaggtgtttcctgtgtgtttgcatgtggttgtgggtgaggctgtgtgtgtgatgtttctctgtttgtctgagtctatatgtgtctgtgtgtctaggtgtttctatctagactgaggatgtgtctgtggctatgtgtctgtgtgtgtgtgtttctgtgattgtgtgtctctgagttggtgtttgtctgtgactgcatgtgttacatgaaacagaagcagatgtagtgagaatgaaggggtcttaattctctttattctgaaacaaggacccctcactggagtggagagaatgagtccttcccagtcacaccctggagcccttggatggcacttgtcagctggtgtcaccaccctaagtacccacacaaatgggctaggaagcccaagctacatgaatttcagctcctgatgagagattcttgggccagggtcttggtagacacaagcctggtgacttcaggcagctggcaattactgggcatctaccaagggtcagccacggttccaggcccctagcgtgtatgaattccttggctcctctcgtcacctctctgagggtgtgtcaaggagagaggaacctggatcttggatggccatggggctcccttccacccacatccccacatgactgcacagcacaggctggttctgctggactgagcccatccagggaagaacagcgagaccctcaggtgagatcgggctcactggagacaaacagcatggcaggagctggaggtgccccaggctgatttccaggatagggggttcctggacacaggcactgagcatccccacagccccctagactggcccatgagcacgagaagccctgagagtgcgtgggggtggcctgtgtgcaaggcagc

SEQ ID NO: 12577 - DNA, 30221 bp, Human
cagcactttgggaggccgaggtgggcagatcacaaggtcaggagatcaagaccatcctggctaacatggtgaaaccccgtctctactaaaaaaaaatacaaaaaaaaaattagccaggcatggtggcaggtgcctgtagtcccagctactcaggaggctgaggcaggagaatggcatgaacctgggaggcagagcttgcagtgagctgagttggcgccactgcactccagcctgggcgacagagcaagactccgtctaaaaaaaaaaaaaaaaaagctttcctggaaaccccacccaaggacctgcagcttaatgctcattggcaacccttggtcaatgggaaatgtagtcttttagctaagtgcattgatgcctggaataaaatcaagggtaccgtttagtaaggaagaacagggaaatggggattgggtaggcagcctgcaatatctgccacatcatgtatgaaatcaggttccaggcctgagacactgaagtacatcaggatgcaaaagtgaccccgtgtcagtcagtgaacatgctggtttcccaaagagtccaaaatggtagctgcgacctgcagtgtaaggtttgggcaacagagatctaagtgaagaatcatgagtatgctggtctcctgagcccttttgctgtgaacacagacggaagggaaattttattctcagaacctgttgctcttaacctgagcagatgtttgctgtctttttcctattttctttttatggagatgtaattcccataacataaaatgcaccattttaaagcatacaatttggtgggttttagtattcttgctatgttgtgcaaccatcacctcagtctaaatccagaacatttccattaccccaaaaagaaaccctataccatttgcagtcagggcagatgcttccctcaatccttctccacccagtcctgggtagaccagagagctggacttaaccacatgaatgagtgcttgagctccttggatgacataggttcaaaccctgggattctggaatattttagaccctcttaggaaaaccaaggacagggtcatggtgaaattcacctaaggtaaggaaacgtggggtccacaaggatgctaaaccctcaagcctgtgccttcagcctgtgagctcctttcctgcagcccacaacccccggcggctgtagaagacaaagaggctctgcagtaagggacagggaagcttccagagcttctgagcctccagggccctcggtagtgatgccctaagttgcagaagctttaaaagctctctgttgtgacaccagacactgatatgggatttctacatccaggtggtactaatcagtgtgaaaagcgggctgagaggagagggaggatgcagcacattcattaagggcctcgtgtgttgtagattcaaacagaatctcctttttctactcacaaccatcctgggcagtattagactcattttccggaaggaggacttgaggttcacaaagagatgtgccttgctctgactgtacagccgaatttcagacacttccatctgagcctcgagtctcagcattctccattgcaccatgctgtgggcacctgtggaaatgcctcctgacctggcccagggcaggtgcagccacctcttgagtggcctagttaggggcaatgacattaggtcagggcttggcttagctcagccctgggctcctccgagtcggtaggagcttggcatgagctcccctcccttctgcctgcctcctattcttcactcctcaggcaaaaaggttgctcaaggagactccaggatttggggtctgcctcgtcactgtcaccaggaggctttttttctgacttgccagagctccccgtcagtcctcacagagcctctggaagcacagggaaggcagctgtgggatcctggctgaacagagtccaggtgaagcaggcttgagaatggattgatggggaggtggggatgtcacaggtctgatggcagagccgggggaagggaacagccaggaaggcttgcaggttctgctgtttggttgctgaagggggtcagtgtgtgtatgtgtcatggaggtgggcagggaaggggagggctgtgcgtgggggagaggatatatatgctggtgtggctgagaaagcggaaccgagcctcgcatccatcggagggagccggggactgacagctctcaggtaggcaactgcacggggcccccagcccgaccgcgactaactggactaactgagtggagctccgggagggcagggccaccaggggctggctcctcggcctctctcctttgtccagtgtggatgctgctggcctcttgcgagatggtttcttcattcatctcctttgtagcgcttggatggtggggaacgggggagggctgagtctcttttttaacctcagacagacgcagaagcagaaagaggggaacttggaaatgaggaaaagttttgcttccccagctgtggcccctacgtggttgttgctctgtgtcgagaggaggctgctggaggagtgaggccagaggaggggcaggcacttgggagggggtttgccttccacggggcggcccccaggaagaccctggccccctcatgagggtttcctctcagtggcttcctttcctctcagatgcggtgcgcaggctgcttctccgcctatcactgaacttgatgccatccagatgggagtttttaatccggagggagcccttctcccttctgcccccagcagaaattgctacaaataatggggaagcgccagatctggggagtgtgcttcacctgtatacacacactgctgagcgccacggcgtgtgaattccagagagcatttctacgggcgtgaccttggtctcccagaacccgattcatttagagggctcttctcttgcttggcatccctctccccctgcccatctcccccacctaaaggtctttgcccaggtcatgcagaatactccgttcatagtcaccgcatcccaactctcgaggctctctcagccaccttctttcttcctcctctctttgtgcatctctctccctcgagtcttgcttccccggcttcactacccagcccctcctccccgaatctcgctctgaacatgggcaagttctgggggaatttcaagtaaggcaggatgattcgggaaatggactatttaaagcaagctgctttggacttgaatacccccatcctgcgcttaaacatctgtgtttagcttcctcaagcagcccataattgccccaattataaccaataacattgttcggcagactaacaaaagatgagctttgcacggcattcgccagcaagcccaaaccagagttttcaacatagatgggaaaagtaactgcctggcttcttatcaaaacctcccaaagcaaatactgctctttttcgctgcttgtgggtggctactgcatgcagcctctttttttctcatttgtaaagtgtggcagggaaatattctacaagcttacactgaggctatgttacctttaacaaaaaggattcgtgctcctttgggcttgctgagtcttctgcagaggagggtccctggaaaacccatccccaaccatcaccacctctgtaaaagcatgtgccgcctggtgctgcctggcgagggcgctgtggtacagcctcgggtcattttgagggcgcagttttgttgcgcacagggcagcagcccctgctttatcagctgaaggctgagagtacttacggatttgtaaaatgcaggcgagtttgcattgtcagtgaagggagtgattgcaggattaggctcaaacctgtgctccctggagcctatgacaagagctgtcactaagctatcctgtattcaatcaatcaggtagttaccgtctacactccaccaggcagggaggcttgcaggggctctagtagattcagcagaggtgataataacagcactttacatttgtacaacgatttaggcgctttcacacctattatcccagcaacagccctgtgaggtggtgccattatctcggtgttgcagttggagaaactgaaactgagagattaaatgatttattcagtacatggcagggtcaggactgagccaaggcattgtggctccagttcatctccccgttacggtcaggggtgcttatgaactcatagtggggtcgggggtagaggagagacgtaacacaaacatgagaaacaattagaggaccatgcaaggcagggtgtaattcagtcctaaatcacataatccagagagcaagtgctagaagaattcgggagaaggagcatttcctccaggcattcctgggatcctaccaagtgagaaggcaggtggaatttggatgggtgaagggctttgaagagggaggcagcagccaggtcaaacacataaaatgagggcaaaggaattaacatttcttgaaacccactctgtgccaggcagtgagctaagcttgtctacgtgcttatttcatgctaatacacacatgcacatatgcacactggtaggaatgggaagtttcaggtgagcgttctctacttgcactgacacggttcagtgatccctcatttctccatccagctccacagctcccaaagcccacgaaggaagctttgaaatatcttgcattccgagtctgggtggagctactcctcagatatcttaggaaagggacgggcccttctcagaaaacgggagccgtcctgacaatgagtggctggcagtggcttgaattgctgggcagtcatgaagcaaactggattttctaaacgcctttatttaaatcccacagtcgaacataaagttttccatctaatcacaaactagtcatgagatttggagcacatcgatttcaggggcaagccagttttctgggcatctccctggataggctacaattagtttcagtctcaattttccacgatcctgtggggttttttttgtttgtttctttctttctttctttcctttttttttttttttttttttttttttttcaaaatactggcagctgcttcaacattgcagaagcacaaaatcatcagcccgggggcccagcctggcaggtggagtagatagcatgcctcaccatgcaccccagctctgccatcccacagtggctcagatccaacctcccctctttccacactggcctgcaatcttccccccaccctccttccccattcatcctttcattcattcggccaaggaacgtgtgtggggttcctgataggagccacacagagcaagtgccaggagcacagggcggccagagcgctggcttcctccaaactcacaatgggcttcaggagactgagacttttgtttttatcttacctttcttaatttgcattttagtggattttataatgtatgtaacttataaataaattaggaatgtgtactcaaaatcgactgctaggggtacaaagttaaagaagtttggccgggcgcagtggctcatgcctgtaatcccagcactttgggaggccgaggtgggcagatcacaaggtcaggagatcaagaccatcccggctaacacggtgaaaccccgtctctactaaaaatacaaaaaaattctctgggcgtggcggtgggcgcctgtagtcccagctactcgggaggctgaggcaggagaatggcgtgaactcgggaggtggaggttgcggtgagccgagatcacaccactgcactcctgcctgggtgacagagcgagactccatctcaaaaaaaaaaaaaaaaaagaagaagaagtttgaagattgttgtcctagattcattgctgtttctctgtgttttccaatattttagaaaagaacaccgaatgattttattacataaaagtaaataaaagcttttctttctttctttctgagttggaggtcttgctatattgcccaggcaggtcttttgttgttgttgttgttgtttacagacagggtctcactctgtcacccacactggagtgcagtggcacaatcatagctcactgcagactcaacctcctgggcccaagctatcctcctgcctcaaccttctgaatagctaagactgcagatgtgcaccaccacacctagctaaattttttttttttttttttttttgtagagataggtgtcttactatgttccccaagctggtctcaaactcctgggctcaagcgtcctaagttgctgggattgcagttgcatgccaatacacccagctaaaagtaaataaaagctttccaaaatctatttaaattatgttgccagtatatgtgggagtgtggcccagaaccaggaagatgggagttgagagctaccttcccacctgcagtagccctgaacgtgtgtcttttgccccctccacactctttctatggctttcctcatgctgcccggaagctacttccccataaagccttcatctccttttcctcttcccttcttccttccatccttacttccaggaaaggacaaatatctggccattcataaaatcagagaatatcaaccatctcatctaactgcctcttcttatagagggaaaagctgaggcccagagagaaaaggtcttgcttaaaatcccacaggtaacgacagagccagactagaagccaggactcttgtttctgagcacagctctcacgcgttcatttctctccagcctggggaatgcttgacctgtgctgggctgggcaattgttctttcctccacctcctctatgccgtccccctctttccaggtggaaatttagatgagaggagagacacttgaagtgtaattgtatcagccagaagaggaaaagaaactaaagcagcctctctccataatagctggtaaacaagcataagctccattgtaggagtcttatctgcaatgggtctaagaaatggggcatcgggaagacccacctatcttctgatggacatgcagctggtgcataatgaaggatccctgtgtggactggagagaagccaccataaagaggttgtcatcagccccggcacagtggctcatgcctgtaatcccagcaccttagggaggctgaggcgggaggatcattcgaggtcaggagtttgagaccagactgaccaacgtggtgaaaccccgtctctactaaaaatacaaaaaaaattagccaggcatggtggcgggcacctgtaatcccagctactcaggaggctgaggcgggagaatcatttgaacccaggaggcagagtttgcagtaagccaagatagcgccactgaactccagcctgggcaacagagcgagactccatctccaaaaaataaaaaataagaagtaaataaaaaaggttgtcatcagacagggagtacagacttcaggacaagaggaagccctacatgaagacagctgctgggatcactgacaggcagggtcagacataagtcccagctctgccacttcaagttacatcagctcctcaagcctcaatctgctcaactataaaatggggatgatagcacttaccccatagggtgatgcttataaagcaattagcgcaaagcctggctcatagtgctctaaagtcatagcaatatgattgctatgaaatgcaaatagattccaccgcaatgagatgccatcagaatctggcaatcttccaaaagcagaaacagtgtgtaaagttgatggtttcccagaacacatggtttgaagtcaacacacctgagtttaagtcctggctctgctacttataaaccggatgatcctagtcaacttgcttaacctctaagagtttatgttcattttaaaaggtgggttgatattaaccctagattacagggttgtataatatatgaatataaaattttttggtaacctgtcaagaatattctctacatgtggttgatgaaaaggatggaggtgtatctgcctctagcaagagcagtcccctcttctctgctggcagcatcaaaattacaggacttcgaataggtcataagacaaaactcaattagggtccagcttcggctaaagctgcatatgtgattctccaaacagataagcaactaattatattgcccttggaagcaagattacatgcaaatcgattaaggccaagccatagtggtattttatctttataaacagcaaggcacaattaaatttatgaggtgtcattaccaaaagaaaaggcaattcaacatttctttattcaatatgagacgctcagaatatagtattgccacatagaagtattagctgagcttggctcacgaagtgaaatacaagccatggaaaattcagcctactcaggtaacttttgatttactgatgtttgctatggttgtataaaaatagcaacaacctgtcactattcccatttcacagttgagaagactgaggctcacagaagtgaaataatttgcacacagtcccaccgttacaaagtataaagtttcagcatcaatgtaacaacaaacctgttattatccccactttgtagttgaaaggactgaccatctcaggacttgtctgcagtcacacaggtccacagtgtaaggtttaaacacaaatacaactcgtgaattaactaagtactcatctccatttaaatacagaacatcatccagcatggagatatagtcaagacttcttacaaatgaaaaacatctactgagttttcaaagttcaaaatctgatttaacctagaacacagttgtagtaggtgttgggaagtgtatgagaaaatacagaatgctgtctctataacgatatttacataattttgagttttcactgacattaatctcattttaaagcttgcaagccacctgtagggtggatggaactatgtggtcatctccattttgcagattctgtgaattgcaggggggaatggatagcattgaatatggatggctcctcaaataatcagtggagtcaattgttaaaagtgaggggagacagagaagggtcgggaggttggagtccgaaaggtagacgtgcctctgacccacagggaggtcctggctagagccaaggacactcaacaaggtctccctaagtgccaagctgcagggcctcacatttcacctgcaggaagactatcaaatggaacatgtactacgtgtcccagaagctcatcttccttttatacctcgcccttaaatcccatttacccagattttggcaagcatcagtcaaaccagccaacatttcctgaacatgcaagttgccccagttaatgaagttcacaaaaaacctcagccagagagcattttgctaacatctgtcacagtttgtcagctcagcctatgcacacattctgtattacaacctcatattaggaaggaaaggaaacggctccttttctcctcccttccctttcttctgcgacgtatagccactgccaccatgtggctgtagagggcacagccacgctgtttggaacaaattctacaaaaatgtctagaaagacggaaacttagtagaatgagaaatgtaaggccaggcatggtggctcatgtctgtaatcccagcacttggggaggccgaagcgggaggatcacctgaggtcaggagttcgagaccagcttggccaacatggtgaaacccatctctactaataatacaaaaattagctgggggtggtggtgcactcctggagtcccagctactgaggaggctgaggcaagagaattgcttgaacctgggaggtgtgggttgcagtgagccaaggttgtgccactgtactccagcctgggcaacagagtgaaacatcgtctcaaaaaacaaaaaagagtgttagagtgaatgctgcatgccaggttctttccttcttttcctttcgtatatattcttattgcctgtcagttctattttaattgcttacaaacgttaacccactaatcatcctctgagataggtactaatttcatcccatttttgcagatgaggaaatgagaggtcaagtacagctagcaagcttcagagctgtgatcggaagcaggcagtctgtagtcattagcagatgagaaagcgcatatcaccgccactctgcagcgtgggtctgttgtgcctgtgttgatagatggggcccccgaggctcgctggcctcccactatgatgtgctcttccagatgccagggcagcagaggagactgatctaactcagaccagggggtggacatggcttcccagaagggatgatgctagaggtgtgtgtgaaggatgagttggagaaggatattctgggcagagggaacagcaagtgccaagataaaaagacattaagaagccaggcacagtggctcatgtctgtaatcccagcactttgggaggccgaggtaggcagatcacttgaggtgaggagttcaagaccagcctggccaacatgtgaagccccgtctctactaaaaacacaaaaattagctggatgtggtggtgtgcacctgtaatcttgctactcaggaggctgaggcatgagaatcacttaaacttaagaggcggagtttgcagtgagtcgagatcgcgccactgcactccagcctgggcgacagagtgagactctgtctcaaaaaaaaaaaaaagaaaaagaaaaaaaaaaaaaaaaagacattaagagcctgatacagttgggagctacacgtgatcggctgagactagaggctatgcaaggttaggtgccaggagatgaagcaggagttggtcagtgctaagtccttggagctccccctgacagcaacaaggttataaaattagtttaaatataaggtgacatcatcagattggagatggcttggggggaagccagatcattaggtggactaattaggaggctattacaataaccaaggcaataaatctcaactaaagccctggtccttgggatagagaagaaaaattaatctcaaatgcatttgcgatacagtcatttatgtaggcactgtgttcattatttgtttcaaaacccgtctcaaatgtgagttcattggccaggtgcagtgacttatgcctgtaatcccaacactttgggaggctaaggtgggaggaacatttgaggccaggagttagagaccagcctaggcaacatggcgagacctcatttctgctaaaaatttaaaaactaaccaagcatcctgggctcaaacaatcctcccagctacttgggaggctgaggtgggaggattgcttgcgcccaggagttcaacgcttcagtgagccgtgattgccccactacacaccagcctgggcaacagagcgagaccatctcaaacaaacaaaaagtcaattcattgatttaacaaacacttattgagcaccccagtagtcatcatcctctgggtatgaaatgctttgatgacgcacaagaagaactggggtgggctcagctgcaggtccctcctttgttcacgtccttctcataccagcacttcccaaactttggcatggatacaagtcacctgggaatcttgctaaaaatgtggatccttacaaaaaattagcgggacctggtagcatatgcctgtaatctcagcactttgggaggccgaggcgggcagatcacaaggtcaggagttcgagaccagcttggccaacatggtgaaaccctgtctccactaaaaatacaaaaattagccaggtgttgtggcatgtgcctgtaatcccagccactcgggaggctgtggcatgagaatctcttgaaccagggaggtgatggttgcagtgagctgagattgtgccactgaactgcagcctgggtgacagagcaagactctgtctcaaaacaaaaacaaaaacaaaaagacctgcagatcctgattcagtggttctggggtgaggcccaagagtctgcatttctaacaagattccagctggtctgcagggtgcattggagtaccaagaccttctacagttcctcaatatcatctgaagaaaaagcaataaaggcagttatttttggttttctacactgaactctttattaagggaactgcatacagtgaaatgcacaaaatgtaaatgtacaactcaatgggttttggcaaatggatacacccctgcgacttcagtcaagaacatttacatttctagaaagttctttgttccttttccatttaatcctctacctaaagatggttctacagggacccaaaatgatacagtacaggcaagcatctttcagatttagaagccttgatcaaaagataagtttcaaggagaaacagtgaaaactgcacacctttcaggcaatcctacataagattgcaaaccactgatctaatcaaccaatccttggagctactatcttggaatagtttctttgttcggttttaaatagcaagttccacatgccagggcctgtgcttggcctggaatgccaaggtgaataacatgaccctttgctcgggaagccaactgtcttagtctgtccaggctactgtaacaaaagagcgtatactggatggcttataaacaacataaatttcttttttttttttttttttttgagatggagtcttgctctgtcacccaagctggagtgcagtggcatgatcttggaccactgcaacctccgcctcctgggttcaggcaatttctggctaatttttgtatttttagtagagatggggtttcaccatgttggccaggctagtcttgaactcctgacctctagtgatccacctgcctcagcctcccaaagtgctgggattacaggcatgagccactgtgccctgccaacaacagaaacaactttttcacagtcctggaggctgggaagtttgagatcaaggtgcctgcagattcagtgtctggtgaaggtctattcctggctcttagattttgccttcttgctgtgtcctcaagtggtggaagggactagctagctctctggggcctcttttataagggcactaatcccattcataagggctctagtcttatgatctcatcatctcccaaaggttccatctctctctctctctcttttttttttttttttttttttgagacagagtctcactctgtcaaccaggctggtgtgcaatggcacaatctcggctcactgcaacctccacctcccaggttcaagcaatactctcgcctcagcctcccaagtagctaggattacaagtgtgtaccaccacacccggatatatatatatatttgtatttttagtaaagacagggttttgccatgatgttggccaggctggtcttgaactcctgacctctagtgatccacctgccctggcctcccaaagttctgggattacaggcatgagccactgtgcctggcccaaagatcccatctcttaatatcatcacgttggaggttaggatttcaacataggaattttagggagacagagatagaccatagcactagctcacatctaacagggataagaggcaagtacctggaagagagagttcggggcataggggggttgggggcattcctggctgcagcagggaaggccaggaggatgaaaggaagcacttgagtcattaataaatgtcgtattttactcatcttacttttgcacagcactttgcaaaactccccttacagatctcatttcatcttcacaataggcctgtgataaggcaggtgccactgttccccttttatgggctatgaaaactgaggctcaaagtggttgatttaatgtcacatgctggtaaactgcaaagcgatgcctttagctcccaagaaagctgtctctgccaccacacagctgctcccaaaagtgcctatgaggtgtcgaggccagccaggtggcaggaatcacaggggtatcctgccacccaggactaacccaggaacccagacacactaacaagcctctgcatgaacactgagcctaggtgataggccgggtcgcctatggccttgacaatttacacccctgcaaagtgaatcgcaggcccctagtgccatcctgccagagacagcagagaagtgtctttcctgcattctctgggttaggtctctggccctgagcagccccccgagaatggctgtactcattgccatgcttcctgtatgttccagcacctgcttcctgctcctgcaccatgaaagtcctgctttgtgacctgctgctgctcagtctcttctccagtgtgttcagcagttgtcagagggactgtctcacatgccaggagaagctccacccagccctggacagcttcgacctggaggtaggtctccaaggcaaggcagagaggctgtcctcctccctgactacctcctccctccctactccagagcagactctgagtgagaagccaaggcctctcccacagctcacaggacttgctcagcattacatggcccgtaggaaacagatcagacaggagctgctcttctgacccagaaccttacgatctttccaccttaccacctgcaggaagagccctgcctgtgatgccaggtcattcccaggattaaaataatgttactcatttcagagagtttggcaaattcagaaaagtataaaacaagagaaatttaaatcctccttcattacaccagtcagagaaagtatcctactttttttcacttactatattataccaggataaatttctcatgttattatttctttccatgagtatagtctacagttggcccttggtatctactggtttcacattcaaggattcaactaaccatggatagaaaatattcagaaaaaaataaaaaatactaatacatcaatgaaaaataatacaaataaagcaatacagcataacaactacttaaatagcatttacattatattaagtattataagtaatccagagataatttaaagtgtacaggaggatgtgcatagccattttattgatcatttttatttttatttattcattttttttgagacagagtctcactctgtcactcaggctggaatgcagtggtgcgatctcagttcactgcaacatccacctcgcaggttcaagcaattcttctgcctcagcctcccaagtagctgggattacagacgcccaccaccacgccccgctattttttatatttttagtagagacgggtttcaccacattggccaggctggtcttgaactcctgacctcaagtgatccacccacctcatcctcccaaagtgctgggattacaggcatgagccaccgtgcccctccgcatagccattttatataagggacttgagcatctgcagatttagtatcctgaaaccaatcccctgtggatacagaaggaccgtgtaatttgtttaaccactgaacaggtatgtgccctttattttattttattttattttattttattttattttttttttttttttgagacggagtcttgctctgtcgcccaggctggagtgcagtggcgcaacctcggctcactgcaagctctgcctcctgggttcatgccattctcctgcctcagcctcccgagtagctgggactaaggtgcccaccaccacacccggctacttttttttttttttttttttttgtatttttagtagagatggggtttcaccgtgttaggatggtctcaatctcatgacctcatgatccacccgcctcagcctcccaaagtgctgggattacaggcgtgagccaccacgcctggcctgtgctctttatttttgatattgcagataactcaacagtgaaccccttagtaccaaaatgctctcttatattttaaatttccaacttaaggtgcaaatccagtattaactttttcttcattaaataaactgctttgtcaactatctacatttcagtccagatagttactcctctcctattaaatccagtatagctcaattgttttttactttatagtcaaataacttccttcaaaagatgccatcttttaaaccccttaacctttcaaaaacaccagaagcaccacagttccttaaggcaaatgtacaaatgtagaaccgagtatttgcagggggactaacacaccctggtgtctcccacctccagataacagaggaggagataaaatccagcagacccaaagcaccaagctctcgggcttagtggttttcaagcccattttccaaccagtcataactacccagggcatctccagttaaccaattcacttactatattataccaggatcaatttcccatgttattaacattattactttccatgaatatagtctacagttggccctcggttaagtggttacagtaaatgtctcctcttactcatccaccgtgtttctctctgagctcctaccttgctgatgatttcctccttcaggaacaccagccctctctcggtccatgtgcctcattctcttcctcactctggctactgtgttggttccttgtcctctccccactccctacacataaaggatcgccaagattctctgcttttcacctccctctgagaacccacccatacatcccaggccttctgctcctcccaggctgcagaaaactcctagaggaatcctcctgaactcctctcacctgggctccagacccgtgttcccaatcactttccatagttcccagaaatcctgccttctcttcctgccctgccattgtgcctgccacagcctcctcccccatccataaatcccagtcgcacttcaaatcccagattaagtgtcctctggtaagagaacattgcactgattctccacccaccccagtggagtgggccctccttcctcatgttctgattgttagttgtatctgcaggactctctctccccatatggagtgaggtttctttactgatggatctgggtatcccagcactcagtacagtgtgtggcacagagcatagctcaataaacacatcccatcccgtggaaattggaagattctaagaccattagtctcctaataggcacatctgctgcagtctctgtaaaggttttacatttccatctttcagagactcaaaaatttggagcatgtctgcatctctccatagcatcttaaatatctggggtctagacaacattatcagctctacttctttgaaacaagtcagaaaatggacctgtaaaagcctcacaatgggggactaacaccttcacagtgctcgctaaccccccggaggatgtggctgcctgcttgtttttgtttctagtttgtattcacttttaacctatgtttaagtttaatgaaatgcctagaatgtaggcactcaaatccatttccaaatctggcagcctttgactatgtccattctgtgaatgatcaggggactcatatttcagcaagggtcacttccccagtccttccaccaaattacataatcctgagctattcccaggatcctctggatccttggcttcatcaagaaactttttatttctgctcctagtagactatttgagtatggctgcttgttgttagactataatttttattggtaaatgactcacacccaaatccattgcaacgtcctggcctttaacctaattgtgaatggtacttacttcatcagctcaaggagaaaaaactggattcactgagttgttttagagacaaaaataaggcaaccaatcccaagaaagagtgtggggaaatttatttcaaactccctaaaatttggcctggtgcagtggctcacacctgtaatcccagcattttgggaggctgaggcaggtggatcacttgaggccagcagttctagaccagcctggccaacaaggcgaaaccctgtctctactaaaaatacaaaaattagctgggcatggtgatgcatgcctgtaatcccagctactcaggaggctgaggcagaagaatcacttaaacccaaaaggcagagatttcagtgagctgagatcatgctactgcactccagcctgggggacaaagtaagactctgtctcaatcaatcaataaaattccctaaaattctactgcaaaacgagctaccttctggtagttctttctatcttcatgagatgaaaattctaatgaggtgacttgcagtaggagttccttatatgtttgtcttctatgctcatctgctgtatttgtcctcagatattctagcaggacctcacaaagcaaatagctcccaaatgtctcttggtcagaagtggtgtgactctttagtggcagaaacttgaccacctttgtgagctgctcctttcatccccaatgggttcatatgcctgtttcccactttgtaccctaatctttgagcccagacacccaaatggccatttgttcactttccccataagcccagctttacagatgaatttggcagccatctgagactccagatgcccatacgcattctggcttaatatagcaatgccatcagcgtgggctgccaaaacgtgtccagctcacttaataagccattaacccatctctggaaaaaggctggtgagttccccgcaccagagggtcaggcattaagctcctatgcccatctggtgctacaaatgcgttgtgaatttagcttcctcctatttgcccaaaaccctctcctaagtcaagagttgagatgattttgtcagcatctaatttatctaacagtgcatcaagtctgggtatggactgtggcatctggtttgatcacacaatttcattttctctgactgacacaaaatctaattactatctgggcttggaaacccaggggctcacagaagatctaagcacctccaagtttaacaactcttccacttgtttccataaactgacggagcagaacaattcaacaagcagtttggggctcctgttctgcaaggattgggccaagcatgctcaaaagtcagatccagctcccccactctacccttctatgactttcccagtgctagccacacttctctgcatccctgttgactttgtagagcagagtttctcaaacttgccactatgggcacttttgactggggaattatttgttgtgggggttgtcctgggcactttaggatgtttactggcatccctggcctctaggtgccagtaacacacacacacacacacacacacacacacacaccaccagttctgacaaccaacaatgtctccagagattgccaaatggccccttagtgggcaaaatcactcccagttgagatccacgcctgtagagtactaactcaacaggattctgatctgaaagaatatactacacattgattctagctggttttcttccaagtatttcaggagcaggctaagtacagacccaggtgactctttctctgtaggagtctttaaccaccgtgttctgtgatggcttcttcctcctcagagcaagttccaaaacaggatttctccaggtatcatccagtctcagaatcacctgagctattgctaaaaatacaaatttctgggccccacccttgacttagtggatcagaatctccaatgctttaggctaaaaatttgcattctaacaaactccagtagcatttttttttctttgagacagtcccgttctgtcaccaaggctggagtgcagtacagcaatctcagctcactgcagccttgacttcccaggcccaagcaatcctctcacctcagcctcccaagtagctagaactgtaggcatgcaccaccacaccccactaacatttttatttttgtagagctgaggtctccctatgttgcccaggctgctctcaaactcctgggctcaaaggcgcctccctccttggcctcctaaagtactgggattataggcgggagccaccatgcccagcacagtagcaatttttatagaatactccagaagtttgcaacttcattgttcttaaggcagccctccctatctatggaagttacctatcattttttataatcagtaacattgcaggtgtgaaaaagtagttcccttcctctccctgctgaggtcattctgtcagcaactaggttccatgtgttaagcatctctgagcaaaagctaaatgaaaaagccatgctcagaaaaaccacggcgtgagcatcactaggggccagtgtcacctcctgtgactaataggtggacttggacaggttgcttcttggaaaccctgccagggaaggaaagggacactcctgtcagacctagtccctgcctgtcccttccagtccagtggaacataggcaatactcccatccaaacctcagctcttggtctcatagaatccttcttcttgcattaattgccaccaattcatattgcaagcacacagaggtagctgagtagatgtcttggactgggccacaaggcatctttgagttcttgttcaggttatactgttatctaaccgtgttgttttggacacattactcaaccacatcataaaatgcaaaggttgaattatattcatgatttgcaaacccaggcaaatatcggaattacctgaactttgtaaaattaagtttttaattcctttgtaaaaataagttttaatccctgcttctattcttcagagatttagttgagtcttgaaattctgttttgtttttttctgagtaggagtttcactcttgttgcccaggctggagtgcagtggtacagtctcggttcaccacaacctccgcctcccaggttgaagtgattctcctgcctcagcctcctgagtagctgggattacaggcatgcaccaccacgcccagcttattttttgtattttaagtagagacagggtttctccatgttggtctggctggtctcaaactcccaacctcagatgatccgcccgcctcagcctcccaaagtgctgggattataggcatgagccactgcgcctagccgaaattctgtttttaaaagctctgcaggtgattgggactcacatccaggtgtgggaccctttagaccaggtgtgggctctgtctccaaagaaaaaaaaaaaagaataaaagaatcctggaatcctggactaatgggacagataagtaatcagataagcaaagggtggcagcagggtgacaggagctgcctgcaacagtgcgcatgctaagcactaggggcgtcccagtcctggttgcaactagctgcgacccctgttcttccagggactctttctcacctcttttcattcccttcttttatactctcagctaaatatagagtgacttcttgattaattcatctcagttcaactaacctctactggaaccctactctttactggaaggagaagattcctgcaagggattcacacatgagtaagatgtggtccctaacttgtcatattccgccttagaaggtattgcaatttaatgacataaagcattaaaatttccacaagaggaatacaaagttctgtgggaagacagaggcaggagagagtgattcttgccagggaactagaagttatcagagaggggcagcactggagcttgtctgggtcccaaaggatggatgaaaggatgcaaggaggtcattgcatccaagggacagagagaaaggcatgcaggtgcgaggagctttgtggtgtttaaggcactaggaacagcctcataggcctcaaggggtgtgtgatgaagaatcggaaataagacctagatggtgggctggaccaggtggtagagggatttgaatgctttgctcaagagtttggagctgttttatggatatgataaacaattagacagctgtgagcaaggtaatgacatgattagttactcttcaggaagagtatcctgccaggggtaccacactgatgacagtggcaaagaccagagatgcggagatcagttagggacccacttcacctaagaggcacttaggcggtggtagagggagtgggaggaggggcagaactgtagactggcaggatgggggcagtgagagaggaggaaaagatatgcccagggtttgaaatctgagtcaactggggagtgaggtgccactcagagacagggaccgagaggccaagcagaaggacaaatatatcagataagaatgaaattcacctgctagtaacaaacatctaaagtgacagcggctgaaatcaatagattcagttcctcacaaggagtgagaagggaacagcccagggctgcagtggcagctccagtctcctctctcttctctgccagtcggcagcttctagcccatgactcccatcctttgagtcgctgcatggtttctagatggcaaacacaatgtcagcccaaatgtccacattccaaacagaaagttggaggaagaggaaaacggaatgttcttcccacttaagtcagtctcctactttcttggaaaccccatctgatgcccgatcaccttttttttctttttaggcaaagtctcactctgtcacccaggctggagtgcagtgacatgatagctcaccgcaacctccgcctcccaggttcaagcaactcttttgcttcagcctccccagtagctgggattacaggcacccatcaccacacccgtctaatttttgtatttttagcagagatgggtttttgccatgttggccaggctggtctcaaactcctggcctcaagtgatccgcctgctttggcctcccaaagttctgggattacgtttccttttttttttttttttttttgagacggagtctcgttctgtcgcccagcgtcaagtgcagtggcacgatctcggttcactgcaagctccgcctcccgggttcacgccattctcctgcttcagcctcctgagtagctgggactacaggcgcccgccaccacgcccagctaattttttttttttttttgtatttttagtagagatggggtttcaccatgttagccaggatggtctcgatctcctgacctcgtgatccacccgcctcggcctcccaaagtgctgggattacaggcgtgcgccaccgcacccggcctacacttccatttttatgtcgtcagctacttatggctccaaggaagcttgggaaacatatacgttgcctttaggaataaaacagtgttctgtgcataaggagaaggggagatgaataagggccagttgcagcctctgccccagaaggtgacctggaagccaggcaggagctccacgctatgatgaggagctctgcctactgagtcacagcagtaaggtcaggttgaagtggggtttccagccggctaaggccagaaacctggactgaaattaggggtgaagccaaaacagcaaataggaagaaaagctgggggcagaggcttccaggagacccaatcagaaccaagaacgtgggaggtggggggccaaggtcagaaccagccaagagggggtggagaaacatcgtggtccagctggtggctagaagtcagggttggcaggagaggcagagcagagtgttcctaggagccgagcgggtctgctgggctctggtctgatgatggcatctctccccacacctggaactggatcacaggttcagccccgcacgtccagccggcctaccaccccacagggtcttgaccccatttgctataaatgatacacagatagtgacgactgctgtacgcgggatgaaaaattaacaacacctaggtagatctttacatggtgaccttaaaataaacctgcagatttgactacatactttcacatccccaatttctttaacccatgtgacctcccacaagcctgaagagagaacaaaataaaattctttatgggtgacagtcatgagctgtgcttggctccaaaaacccgactaaagatgtaacaaggtgcggtgttgggcgcatttatcctgtgttaacttcctatgttaacgtgctgtgacaccagaggtaagttacgctcacctctctgagccctggtttctttgtaaaatgatggagctgggtcagatgattctctgtttgtttccaattctgaaattctacgaacctaaaacctgtgtaaaactgctccacgttacttgataacttagatgcttcagaagcacttgcactggtgcagtgggccagatctcctccctcgccctggattaacagaggtccttgttccttctcccctcctctcacccgtatctttgcaggtgtgcatcctcgagtgtgaagagaaggtcttccccagccccctctggactccatgcaccaaggtcatggccaggagctcttggcagctcagccctgccgccccagagcatgtggcggctgctctctaccagccgagagcttcggagatgcagcatctgcggcgaatgccccgagtccggagcttgttccaggagcaggaagagcccgagcctggcatggaggaggctggtgagatggagcagaagcagctgcagaagagatttgggggcttcaccggggcccggaagtcggccaggaagttggccaatcagaagcggttcagtgagtttatgaggcaatacttggtcctgagcatgcagtccagccagcgccggcgcaccctgcaccagaatggtaatgtgtagccggaaggggcgctcctcccagctgtaccggccactgcaacccatgagtgagttgggcaccaataagctgggggcaaggagagacctcacacaccaactgtcttagccttgctcccaggcctagaagcacattcatctccccgccccctccccactccacacacacacaccccgcaaggagtccagcccaccctttctctaggcagcagattttcctatgattgcaccttgaagctgaccacttccggctagagactggttaccatggggataatagtagtatgttaagataactaattcctctatcactccccaggagcttagttactatggggacagttaagtggaccaatacgcccatccagttgccacagcaaccagtcagctcacctttcctcgagattgtctctctaaacaccaagagtgggacctactcttagccattagcagagtccaattaccacagctatgatggtgctatttcatcttcaaagacggcttacctatcccctctcctttccccagctctcagggtgcctggctccatggaaacattaaagtttcccattttacctggacaaagagttcctgttaagattaggagttgtggtttctgctcttcctccttccacaagccatttgtccatcctgccaccttgccagagagggactgattccttgtggtcaacggtatcattactgagcaagacgtggagaatttggtccaatggacctagtagctactagaatatggactaaaggggttcatcttctttcctccatttcgcttctttccagcgtgccatttttgttttggttttgtttgcttgcttttattcctctctttcttccttgttctctctttcttctgctctgttcctatacccacaggcaccttatacaagtccacatgtctcataatatacatcaaataccctaactgattgcctgttcattcaaaacccaactttccttaggatatcaaccaatacatcactttgagtggcattggcaacctagcacagtagaattttctgaaaatttaggaaactcccaaccatcaaggctatgtgccttaatttgtatatgggaatatgatcatctgcagagtcccatacgtctccttaaatagctaagaaacttgccatattcatccattttgcattgctacgaaggaatacctgaggctgggtactttataaacaaagtttatttggctcacgttctgcagtctatacaagaagcatggcacccgcatctgcttctggtgaggccctcggggagcttttactcatggcagaaggcaaggggagctggcgtgccacatggcaagagggggcaagagggggaaaaggggaggtcccagcctctttaacaaccagatctcccacgaactcattaccatagggtgggcacaaaggcattcctgaaggatccacccccatgacccaaacaccacccactaggcccacctccaacattagggatcacatctcaacatgaaattggaagaggacaaacttctaaactgtatcattgtcctaacacaaagaaccagtcagatcatcaaaatcaccccaaaacattacccaagtggggcttttccctgagtccgagcataagagaaaaatgtctgcatgtgctattttaagttgcgtcccatgtgtcagaggtagccgtgtcactaataaccttccttgatgatctattagtacatatgctaatgtttggtgcccacactttagcatggagacggcccctttgcaggtaggccaacatgttcaccacgggcctgttaccaaatatggacacgtgtattaagttgtgaagagaaagctgatgtgtttattttagcaggatgactcatctccaaaggccccaaattaacctgcactgcttttgaagtcatactcactcttggatccttcacaagcctcctatttctttctaacacatatctgcacagcacctaacagtaaatcgttcagaagtagcatgggttgaattctttcaaatcttaaagacattcttctttaaagtggctcttcagggacactgaagctcatgtctaattctgaacgatggcaatgttctttacctaaacacagttgaaaatcaggcccattaacaggaatccatttattttttaaaaaatgatttgagcctctatccaggcaattggtttttctaatcttctattatgcttccaactgagaggcactgaaacaaagccagtaaggagcttctgtctgtggctctgctcaaatgtcaagttctggatggaaactggaaacattaaccagctcatttgggtattattgatgactctcctttctccttctgcaaccatctctctgcttcttttcccccaacatgcacagttggtgagttccaatatggatatttatgagtctataacagccggcttcaaccttgttttcatccacatacacacaccccaacctgccctacacatgatggagatgtctccatcttgggggactcttgttaccaatgctgtccttgacttctaagatacctaatactaatagacatggagaaggctgggaagaagtggggccaccttacactggaatgggataaagaaccctattcagggccgggcgcggtagctcatgcctataatcccagtgctttgggatgccgaggctggtggatcacctgaggtcagaagtttgagaccagcctggccaacatggtgaaaacccgtctctactaaaaatacaaaaattagccacttagccgggcgttgtggtgggtgcctgtagtcccagctacttgggaggctgaggcaggagaatcgcttgaacccaggaggcggaggttgcagtgagccgagattgtgcacattgcactccagcctgggcaacaagaaagaaactccatctcaaaaaaaaaaaaaaaaaaaagaacactattcagaaagtgtaatgatgtcctaggaaggaaaggtgttggggtgcaggcccacctctagacagaacttgtcacagctggtcttagggttctgccttcctttcccctgaccctatactaccttcctcttttctgctacccttagactttgacccttctaggcaatggaaactgagcacattcattcgtggtcaggttatcagtgccatcaggctcaaagagcacttgcaaagaaaagaactgtaaaacaagggcactatttcgcatgggctccgaataccagcaagaactgttccccgggaaggggcttgccactgtgcctatcgagtcacagcctacagacctcccgtttagtctattagtccagccagtagacccggggctgggggagcagatgtgcggagatgctgaggacccctctggctacgttaggaacgatttacttgggttgatagcttttctttgcctccctttcactgcttccgtctctagggggaatagaaaagggtcagaaaaaccatcaggtttgccattttttaaccatttctgtctccccaggcgtccaggtgatcccccaaacagcatgtgctcagccccagacctgccgcctgggaatcaggattccttcttccccaaggcactgagcgcctgcagatcccgcaggcttcgtttgcctccagaaccttcccgtctgattgttcctccccagccccctggcatgtttcaccacaaccctgttgctacatcagagtgtatttttgtaattcctctagctaccatttcaatagccccatctctcctgctcacccgcctcttgccccttctaggggcaggtgaaaggaataggaaattgaacctggggttttgacttgccactgccataacttgtttgtaaaagagctgttctttttgactgattgttttaaacaacgatttctccattaaacttctactgagcaaatggttaataaattggtttgctgtttttaagtgaagtgacagaagcagactctgcacacacacaaccagcgctgccgctcccgggaggcagaggtaaaaagcgcatggcactgctgtgtagaaaggaggataggcaggctgggctcagtggctcacgcctataatcccagcactttgggaggctgaggcgggtggatcatgaggtcaggggttcaagaccagcctggccaacatggtgaaaccctgtctcttctaaagatataaaaaattagccaggcgtggtggcacgtgcctgtaatcccagctacacaggaggctgagacaggagaatcacttgaactcgggaggcagaggttgcagtgagccaagattgtgccattgcactccagcctgggagacagagcaagactcagtctcaaaaaaaaaagagagaatgggcaaggtgcaccccgacggcacagtgcccagatccgagtgcaacaggtgggggaatgaatgcacatggctgtgtgaacggacagggtggagagagggcaggggctctccaaacccctgcgtgcatcagcaccgcagagaggcaggctgctggccccacccccagtttcagatggtagaaatctgcctttttaccaagctccaggtggtgcagatcctgctggtttgggtccaatggactgggacacacagcaaggagcagggcggagagaaacctgctgatgccacttttatctccagcttcccacgttagggtgtgtcactgccagagtccagccgagaaacacgaggcaaaccaaaccgagtctgtcggggagagttaaccgtctacacgaatgggcagggttacagaagatcagcaagggatggaaaggtgctctgttgggagccggagagccctggtaggggtaagggagttcctggacccacaaggactctagctctccatagctttcagtagagaaatacagccatttactcacacactgtgggagccaggattcaatacccccactttcaaactccagcctgatgtctgtcagccaaatccaaccagaagctggaaagttggggggtcgatccactgatgcagctgcgaaggtaggggtagggggtgagctacagatggagaaggcaggtagctaacttggagggggacttggtaaacgcagtagaacaggtaattctattcgaggtgttcttagagggatgagctggaacaaggacacagagaaggggagaaggaagtccctgactgcacccccaagatattaaaaaaaggccaaaaggagggaaaaagaaactgctttgtgggctgctgggcgtggctgactcaggccataatgaagtgcctgggcatgacacccccactggccagcaatgtgaagggtccctgcaacccgccccaagagacacttcacaatccccaaagctcctgcctctttgccttccctattccccagagcctcttcctatagctcctgcttctccccaccagatgactcagtgcggaaaagatcctgtggggccttccacctgccccaccaccacctcgaactcttattttaaatataccttaaacgtttaaacacatttccacaacttcctcaagcaagcctggtttatttgacttggtcttcttggaatctatcattgcttcactaagtggttcttaaaattcagcaactgaaattgcacaaaccagcccctgggtggaatgacgccttctgcttccaacagccttcccacctaggccagctctgccagccacttgggccatcgcagcacctggaactgatgtctgtatggagcagaccatgttcagaagccatttgataggtagcgtgtgactttattttctcccatgtcacttgcttgctcctcaaaagactcaggaatgcagtcaagaatatgctcccctttgtcaagaaaagcagcagaaaatgctgcctggagtgctgttatttcccagtttataaccttgagcaagttattgaacctctgtgcctcact

SEQ ID NO: 12578 - DNA, 31440 bp, Human
ttttctgccactgtacaagatctgatttgtcagagtagctctgggtctcaccttttccttccctctttccagaggacagaaatttattccgggggatatagcttctgttgatctgcttcaggttttaataataatgatcctatattactactaacaaacatggctgacacttggcatttactgctttcaacttaataaatatcttttattttaatgatttagagctctggctctagtcagatgaacttgggtctggcaccagcctataacctgatagcttggtgacattggacagatgaaattccctaagcatttgtttgtttctctgaacaatacaggtagacgtttccttgcagcgttgttgtggtgactagattaggtaatgtatttaaggcttaacatggagcctcttgcacagtaagtggttatattattactttgtggaaatcatcatgctaggcctgtggggagaaactgagatgaataagaaaaagttctgaatttcacggacttggagagaataagacatgaccaaaagagacaaaagacagacccgtgggagagaggaccagcgaggccacatatcctcctacgaacctgtgagacactcacagaactggttcttcattttatagatgaggaaactgaggctagaagagttatgtgacttgttgaaggggacacagtgagtgagtgtcagagccttcatgggaacccacgtctcctgtgactgaggcaggcctgagggatgtgcctctgtttctcatggaaactccttggcgcagcccaaggccttgagatgctgccccctgccaggccagggtgtgggctgccagccaccacagcatgggggcctccactgtcctgaacttcagaggctttgcggggagggcttataggcagccaggagacagccttctctggcttttaagtgaatcattgataaaatgttgacagcatttctcctcaagacctgccctcaaatcagcaaccgattagagacagtaattcataactttatcagatgaatttttattgggggtcactatgctccaggtcttgtgtggggcactggagaggcaaagatgaaacctccttgagaaactgtcagagtcatgtgacaattcaccatcacataatgaacaaagtgctctaagatctgagaagacgaacaagtattctctgggctgggggtttgtccttccggcaagagaggacggcaaggtcaaaggcagggaattgcatgggtgtttggtggtgcttagagggcactgggaccagtggtaggagggcagttggtggtgaggctggaaaggaaggcaacggctcgattgtgggaggccttctaggcctccagctctgtggctgaagggagaaggtgaatgctttgtaggctaggggatagcatgatcaggtctaggtggtgcaagatggctctgaggcagtatggacggcagagcagcaaggccccacacctgctctagggggtgtgccaaggggtcttgaccccaaactgactgagtccctggagcctgagcatgtggacctcagatatgcagtggcagaaggcttccaaactgtgaaggaaccggtagccaacaccatctacacttccagatggtgagcccatgacttacttaaagaagcttcctgttatcagtgggtgggcactcgcaaagaggctctgttcatcttgtgcctacaagcccagatccagtcaaagagcacgggcatgttctccttccttccttgagggttggcctctttctccgtgggcatagccgacatcagagccagcgcccccatatttcagcatgattaagccttgccattttgggggtggctgggggcgaggggaggggctactgtgtttcaaaatggaataaacagaaaagcaatattaaaagaatgaggaggttgtttactgaggcttgaagagatgacaggtgtttcctcccagttgagaaccagtgacccctgggaatcgcatttcccgctgagcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggccgtggctgcccgcgctgcgctgttgctctgtcccagctggctagctccgagtgtggagcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacgtaagtggtttggctgtggctgtcagacccaagcgagtgccagcggggcagggcgatcacagcttggcctggaattggggagctggtggtggaggtgatggcgccacggggggagggggtctgggttccaagccccggagcagggagcggggaggtgggcgggatggagcctggtggagaaaccagcctgtcagaggtgatgctgattttccaggctggaggggaacgaactagtgttccaaggtgggacggctcagggtacctccgcttctgtgtatgaatcactgtggtgaagaaagggcagtttatgattcacacaacaaaagccagatgtgggatgggtttggggttgggagggaaaagccatgcagttctttacaggaggggctttatttccataagcagtggctcttcagccttctgttgaataccctgggcctgtttctagctgagtgacttagctttctgccagggtgtgacttgttcctgtggataccctgggaggagtggagatctggcttggtgaagcgtgtcctcacttgctccactgtcttgcctttcgtcattctttttccccttctgtgacaaggcttgtccatcccactgcaaaggatgcagtgggtttatctttggccttgatttttatccccggagttggatggaacaattgtgaactttattttcctttatgtggaccaaacagcgacttaccttactaataactgaaataatacagattatttacaacattcttttcacgaggtaaacagcgtcaactcatcagcttctgagagttgaaccttattggggctagttctatacttcctcaagcaagaagaatgaccaaaaattgctctgtctttctcttaaagattcttggttccttaaaattccttttaattaatttaagtatgctgtgcctcaagcaagcttaatataagagaatctagatttacagaagaagatatattagggaatgtttttattttatggaaagatacttgattggatccactaaagttcggaaaatataacttcattgattaaaatgtgacactgtcatcaccaatttattgtttgctttatgtcttatgtaaatttctctggaattaagctgattaaccagtaacacagaagagtgatttcaaaatttctcaggttgtgaagacccaccattgtttgatatcaaaaggtcaattttttaaaaaaataaagagaaatgagctttaatttgggtttgagagttacggactccttccaagataactaggaatattcaagaattgttggcacgccactcttcccaacaggcgatggagcagcggcagcctatcctttctgggacaatggcagctgaccctgttgtgagtgctctgtggatgagagcaggtgggcattcatctttttactgggggcccctaagcatctgtgtgccctttcactcagggctgaatcatttgatttttgtgtgagcccctggaaggagttttgcctcagctcctaccttctatgagcaagccactttcctttttctcaatccttaggttttttgtatgttaagtgggggtaaaaatcatatccacactgaggatctatccttagtaagtgaggtgccaccgaagtcatgttcattgctctgtctgcatcagcctctgagatatgagttgcttccctgcattcaccatctgccatattctcccctcttggttctgtagtacattttttcatttctaattccttctaagagatgaacagactttttttgtttgtttgtttgttttttgagacagagtgttgctctgttgcccaggctggagtgcagtggcgcgatctcggctcactgcaacctctgcctcctgggttcaagtgattctctcgcctcaccctccctagtagctgggactacaggtgcccgccaccacacccagctgttttttttttttgtatttttagtagagatggtgttttactatgttgttcagcctggtctcgaactcctggactcaagtgatccacccgctttgacctcccaaacaggtgtgagtcactgcacctgtcccccaaattttttaaaggggatgctggagggcatgcttcctgctcacaccctggagaccagtcagatagatcaaaactccattgtaagggagaccacattgtaagctcatcaatggaataactggggtgaatgtttccacatgttcagatgaacacaaatcaaaattatcttgaattgtcctttaagccttaaaggaaaagtaggagagaccctgggctctggacccacccccttagcctgaacccaagtatgtggtatagagggcacctgggtgactaaaccgtgtgggaaaatcagtaaaaacagggcagcatgtcagcccacttagagtcacccgatggaagggcagggtttgaaatcagacaccaagagtgctgaaagggcactttcttttttcagaaaacaccctcgaggcatgagctgaaatgactgtactatggggttctggaaagggttaagaaaacattcactttgtgaatgttacctcctccctacctagcccatgaccctagtttgtggactaaatgtgaaccctggcttttggttaagattagagcataaagtgacaaagcccagaactgctggcacagagaagtagaaatcttcaagccccaaccaatggatttgagatttgcttgatgggccaattggatgaagaagtcactccatctgtagattctctccctgggttctggacttggacctgctggtcaggtgcacatgtgaagaattaccatccctccccagctagtaacagtgtagtggaaatagcaggaaccttggagggagacaggtctgaaagttgcctgtgcaacttagttctttctttgtgagaaggaaatttccattcatttccttatctgggaagtggggattctaatgtctgcctcccaaggtttttgtgagaattaaagtagagaatgtaggtaaaatgatagcaagtttcctgataagtagtggtaggggtgagttagtaccttccgtcctggaaacctcctgtgggcccatcttgaatgatcagtgttatgttaaattcatatattcttttccacactttgattagaatagttaaaaagccacagtctaaatattcttgggtgataggatattgcaaaattttccaagggtctaaaatagtggtctgcaaactatggcctctgtgccaaatcaggcctgccactccatttgtaaataaagttttattggaacacagctatgtctatcatttgaatattgtctagggctgcttttgcagagttgagtagttgtgacagagactgtgcagcatacaaagcctaaaatattttctctctggcttataatagaaaaacattgccaacctctggtctgagatgatttgcttggttcttcaggcattcatttccttaagatactcagtatcaggccgggtgcggtggcgggcgcctgtaatcccagcactttgggaggccaaggcgggcagatcacgaggtcaggagatcgagaccatcctggctaacatggtgaaaccccgtctctactaaaaatacaaaaaaattagctggggttgtggtggcaggcccctgtagtcccagctactcgggaggctgaggcaggagaatggcatgaacctgggaggcggagcttacagtgagccgagatcgtgccactgcactccagcctggggtacagagcgagactccgcctcaaaaaaaaaaaaaaaaaaaaaaaaaaagatactcagtatcctggggttgtacattgccaacaccaatgggaaataaaacttgcagccaattcattaaataatttgtacaatgccccaaactgatttgattgaatttcttccttaaaagtgatagaactgtgtataataaactgaactccatttgttagaaagtgaacaaattggacagttgctttttattgttgttgtttgtattagggaacaatctacatgctaatgaaaggcaggcttgactgattttctttggactggctgattgtcttggtgtcctgtggacttggccttggaacaggaaataattcgtatcagattattatgtcatggatatgcctttgctttcagacaacttgaacagagcagagatttagcaaacagaaaaattaaggacttaaaattctcatcaacatagaactctgctcttcagatgtactctagggttccactaaagagccaatattgtttgggaggcagttaaagataagtaaaatgtgtactatgcatataatttttggaagcctatctcctacataaatttaagcacaacttacaatgagaggtaatttaggtttctggacaacctctaatatttctattctatgttacaacctttgcttatttaataagcctagtgagcacctttacttcttaccaagttgattccattgattcagcagttctttttttgagatagagtcttgctctgtcacccaggctgcaatgtagtggtgcaagatcagctcactgcaacctctgcctccaacttcaagtgattctcctgcctcagcctcctgtgtagctgagattataggcacatgccacaatgcccagctaattttgcattttcattggagatggagtttcactatgttggccaggctggtctcgaactcctgacctcgagtgatccacctgccttgacctcccaaagtgctgggattacaggtgtgaaccaccacgcctggccaattaagcagttcttgctgttaagggcaagtagaatccaaaagagagacacaaattcacgtgcaccgtctggaggtgaaataaaggacaaacatcaaccaaatacacagatttaattggtaaaagagcagatgatgttcttgatggatattttacttcctgccccttatatttatttactaaagaaaatgccagatttgtccccaaagttactgactcagaagttttgaaagctctctcccaattcacacttgggattctgttctttcatgaggaaccaaaaaaaaaaaaaaaaaaaaaaaatcaagttttcctacagctgttcattaaatatgtggacatttaattcataaagaagtcttataaatatttgcttttaactttcccactacaaagtgttttttccccctttgacatctttctaaagtagtttatcttcccacttaatgaagatgtccacctatttcttattctgagccaaccaaaccaaagttggctaattgattatgaatattaacataattctcacctttatgaaatgcttaataacactctagttttctcatttttgtagaactgcttgacaactaagtgagcctacctgggatggggaggccttctctgaaaccctcttgtcccgcttgtgtgatactggggacaaagcacttgtaggcaggagccaggggttttactttccattctacagataattagatgagagaccttaagcaagccacctaaccactttgggtctcaaatgttctagtgctggaatggaacttgccttttcctggctaattttcctggagattgaacttgattgaggttctttgccagctctaattgctgagttttcctgagtgtttatacaaaaaataaattaaagtttaaaatcagaagtccttaatttaatagatgggattcttctatctgcttagggcagtgtttttataccttggctacacactggaatgctctgaggagatttaagaaacacagatgcctggatctcaacctagagcttctgattaaattgtcttgggcattgaaggagagctgcaaatggctcccaggtgagaaggctgagaactgctgacctggaggttgaaatggatggcttctaataaacctttgggcattgctaagagcagaagaatgctcaatccttttaacagtgataaacaaacatctctggggaatggagaacttatttggtgctatgcagtatacaaaatgttctgttggatcagtttggattacatttgattgctggtgaagagacctgaaataacgtagatttaagtaagacagtggtgtcctttctctcacataaaagaagtccacagtagggtgttcaggatcttatggagtctcacagtgccaacatcatcccaggctcctttttcctttctaatctgccatccttggcatgtggctcttgtcctcaagatttttttcatagttgccattgtaactccagccattacatctgtgagcatcacatcttcggacaagcaagaagaagaaaaaggaatagcaaaagatcatgcctcctgatcgctgccccttctccctcccaacacacaacttctgctgacatctgatgccatttctatctacaagggagaatagcataattgtttagctgggcacattgccaccctccataatgcaggggctgttagaaaggaagggaaggtggatgttgagtgtaacaactgccagtcttcactatgctttgagtgcattatctcatttaatcctcataaaaactccatgaagcagattctgttgtaaggttcattttatagatgaggaaactgaatcatgaagattaagttagtaactctcctacaaagcaaaattcatgtgaacagacctcaagtgttggcctgctaagctgtcctgtctccctgccacagtgcctgtctctctcacattgcttaggaagtattcttggtaaaagcacaggccttccatgtcagataagggaccaatggcaaaaaaagccctgcagatggtagttcataccatgagaaccccttttgtttaacatttacttcagcttacctgttgaagaaaacaaggtctctgcttgctgctgggcctcttctgcgggacagtttgaagatattttagctataataaaaggctcagagaaggatctagagtttgcccccaaataacccagccctactcttttctgggcagttttagtagagagcccgatgtagcaggcagcctttgctgggagccaaggcttctgcctccgtggcacttccttgattctgaactttctagactttggaaaagtcaggctgctccttcctctctctctctctctctctctctctctctctctctctctctgtgtgtgtgtgtgtgtgtgtatttgtgtgtgtttaggtggggtgtggagagtaagatgtagagagtagggtttaactttgagttagagagtgacacttctgttctttctttgcctttagtagttaaagcttagcttctggggcaggcagatctgagtttgagtcctaggtttatgccttactggttgtgtgacactggtaagtcctttttcctccttctgccaccatttctttataggcatgcaccagaggtgtgactcttaccttatgggattgtggtaggggttttctgctgtgcttggcattaagtaaacactcaataaatattagttgctattattattttcccattctgtcacaatctacctctgaagacaaaggttatgccggctaattttagattacaatttgtatgtcctctgagttctgaatttcttgtgaaatggcagggcacacatctccagtcttgtaacttgtggtgggttagtgatcatggttacttctgatgattaatctgaccattctgtgatcaaacttggaactcgcgtcacaattttcctaccgaccttgtaaggtagggtggcggcaagacttgtactgactggcaaactcgtgtttgtttttttaattcacaagattggactgagtgtttgtaatctagttgtgagcagaatgacacttgaaatatgcaagaaatagataccgaaaactgaaacaacaatgtgtggcctccttttcttagtaacagtttcattagtaccactttctgggaagagctggtcaccaaaagattataaaccagaatcattctcagaccaggtgctgggacaaaaaaggatttgaccagtcttaaactgaattactttttaatgcactagaaagagccatacatttcattggaagacagcaagcatacaggacattgttaaaactttccaggactaggaaatgctgaggtgacagaaaggaaagaaaagaagagaggcaagagagttgacaatagaagcaagtcttaatgttggatgaaaggtacaccaattcaggaaggaaaggtatagaaggaaaatcaaccatctattcatcatcccatgcaggtatgcatccctctaagcatccatccaataatggaattatttccagctagagaaaccaaccaatgaaataaattatcttcagcagaaggtggggatgatggaatcagggaaggtgtcatggaacatatagcattgggtttggatcctgaagaatagatggtaatcagacttcttgcttagatcctggggtgtgcagatgcatcttaggacataaaatattagcactgggaagaaaatccaaggattttaggctgatgtctataacatttttgctacaaactcccttattcaaaccaaatctactgtagaacttcagtataagaataaaaatcgtgcggttttggggggctatctggagctctgattgctcatgttcccccacatttccctgccattctcactctgttggcacctgcaggcaccataactatattccagggttcttcaggtcacagctggatccccctgacctggccaatctacccctctttttagcaagatccctgctagctggtcacagagagtggcagtgagtggctgtgaaacatattgcattggtcttcatcaagctctgaagctgtgaagactatgtgttcggtctttgtgggtctcttgtgaataaagagggggtaaattcctaaaaaactgaccaagtgacttctttctcaggcttgatactaacaaccactccccttctccaatgtctttcataaaggaatcccttgcatcatgagggccattggttagcaaagctgaacattatccagaaagctcctcttgaccagctgtgatgtttctcatgaatccattgttagggctactctcacttgcgaaggctacaccccaggccaccatgagccttggaacttgggcagttgggtctgaccccaaatacaaaactaatgctgggatctgaagagtccattctccaagaaagtggtccttacatgatggtctcaggaaaagttaagttttttcaataaagctctttagtcttgaaaagccaaaattagatattgcttgaatcaaggaacaaaaaatcggatatccatctgcctcctccagctgcctaactacaggttattcccatcctagctcagatgggcaattctagattcaagccttgatctaataaggaaagagacagccctttcctctgctccatccctcactatggtactgccttgctatagaattggggtggccactggggtaggtggactctcctcattcaccttctggtctgggacggtaggtctggagctctgtttaggccctttctctttcctgatgccccactctcagcaaatttgaggcaatgccaaatatgtaatccaggaatctgctttgctctacaaggtgataaaactcccatctatgggcactgaagagccctcccttgcccattgccacatttctattccatatgcgatatgtgctcctaggtttctagcccccttgagggagtatctacaacatagcctcagccatggctgtgtccctggcctttaggagatacatataggttccttaaggggctgcatctgaggtcaggacaagggaatgccatcatactctgtctgcaacctaatcgctgccattcaaaaatatccaaggtttttcatttctgaagtcatactttaaaaactcacatctgctgcaaacctaatcctctggtgacttctaaagaaagaagtcttctgctcagctcatcgtatctttataaaaggccatttccagggtttggcgtctcctgtctaggattgctgtacgaaagcgaagtcttttaccagcccctctgcagcatcattggcttccctgtctcctaagtaggggtatcttgctgcctggggattccaggtacctgagggattaattccaggagcataatgaaggcaggtagagacaggcctggcaggcaacagaaggccctgggtatgctgaagacagagacattcagtatcaggatgtagctgaatggaggcaagttagggtcactgtaccaaggctacttctccgatgacagatgggccatggattgttggctgagatcaaggagaaagggctatttgttgggagctcattatgcaccaggtgtttcattgtgttaatctcatacagttctcatgattaccctttgagatggatattattactttcattttgcagatggggaaactgaggcacacaatggttaagtgatttgccaagagtcacacaggtgataagcaacataacaggctttctaaactaggtctagtcccaaactgtaccacactgcttctcaatgacaaggattttagtgttgcactgggtgcttcttcctctcccaattgaagagggccctcgcttagatggaggcaggttatgacttcatcaagggtagctctagcctggcacaaaagcctctgcagatttggatcttagcaagtcacgctcgagactcagtatggaagctctgaaacctactgatttccatcttagaatctgagttccctggactcctcttctcttggtgggccgatcagccaagataggataggaccagctagtgacacacccttaggattcactcaggacctgccacttagagtgtctgggacaagggtctgctcatggtgaggcctgagtctctggccccagaccagcccctctgcactggagatccaacagtcatatctcttgcactcacctctatacagtctctacagacttggggccccagtttgctgcttgttcaagccttactaaaccaggtgtaggtggaaaccaaccaaacaaaccagaaccacttcagttctgaggcagatgcagctctgtcacagtttgtaattctaaatttgtttgtgcaattatttgattaaagtctgtgtaccccactagactagactgtaagctccaagagggcaagaacctcatctgttctgctcagcaagtacttgttcagtgaatgctctgccaggggtctcttggtcttgtcccctaccctgggacacagtgtatctgcgaaccctttctgctccggtgaccccagtttctgtaaaaggcaggcagatgcagctgctttctcaggtggacctgtccgctgtcatttcagtcgaaaaataccaaaaataaaaccttgcggggaattgtttgggtctctcagttctcgtcactcctcatgtgagaaggctgctgacaaggttctcgtggacagatctctcctctcttggctgggcaacaccatttcttggggaaactggcaattgagggagactggatcagggtagtccaagcccagactttaactggagcaaggagggttaggatggggccaggaatcatttgatgattaactgcagtgtcgctcagagaaaaaaatgggacttgcccgggcagagacaaggcaggcagtgaggcagaagtggagtgtccttggaatcacaggtcctgggcttggttgaggacactgttacttacaagtatagtcgtttggcaagtcactgaatatctctgagcatcaatttccttctcggtaaaggaagggagcggaagaggaatacgttgtactgagcctctatctgcaatcattagtgtcaaaatctctatggaacatcatgcaaataggagtgtggtgatttcagagctcccaagagttaagaatgtgaccaggaaacacatggacctttaccacccattcattcaacagacctgagtccctgggagcagagaatgggtacaaacagccttctgtgcttgacctgatctgcaggaggctcagaggaagggaggtgtggtgtggaaggtgcggagagcgccggggaaaggatccctgggagtcttgcctgtgagggaagggttagagggccactgccacgtggaaacctctcgcactcaaggcctttggctgcccctacctgcggttgtggggcgggacacccagaagtttagggacaatccaagtaatcctgaggccttagggtgtaaatgctcaggtctgagcttggtggagaagggtggtcttctgtgggtcagtgggatcttgacttcagcctaatacaacctagagggatccctgtgactgccctgggggtccatttcctgttggctatgacctctgttaagtaggaatcacttggcccctagaccacttttgtctggggctctgtggctctaagactgaaaaaccctctgctgtcacctccaacatactttaagagtgtcccctgggtctcgttgtcagggctcttctttctaggtcctggtggcttgcctaggtctggggaaattctcagtgaccgtggaccctggttcagcctttcccaggggacctgcctatggttgatgagtgagatcttcagggctgatgggaaggaatagtcttttagaatgaggacacagggagggcacatgtcactgtccctttatcttctccacccagaccagagaacgtgaggtcagccaccatctttgtgatctgatacagacatcccagcctaccaagcaagatattacaacttattcttcagctgtccagcagccttgcaggcaacatcaaattgtacatcaatcatggttcccctttctctcatgtcttccaaccacctttaacgtcagttttctccccctgctgtctttttctcctctgtcctgggtatcatccagattgcaggatatatgagtgatgtgtttataattcctggctgcagggtcctctcagttcaaatgttagtgaatggaaagtctgcgtttacatgcatatgggatttctttgttggcctacattaaacaccaacaacaaaggtcaactaaaatatagtgtaaatgagcgggaaagcctttctgtagtgtgtcaagtccaacctttggccaaaacccaacttctttcttcctgtttggaaaaaaaatcagccattgtccatgaatggaaagaacaaatttgaaaactttgactcagaccgtaactgtaagaaaagcacccacattagtgttccagttaaagatgtgaataatcctttagccaactggagttaatgttctctagaagtccttgggccacaagtacaaacaaaattctttgcatgaaaatgtaaacaaattttttttttttttttttgagatggagtttcgctcctgtcgcccaggctggagtgcaatggtgcgatcttggctcactgcaacctctgcctcctgggttcaggtgattctcctgcctcagcctcctgagtagctgagattacaggctcctgccaccgcacccagctaattcttctatgaaaatgtaaagaattctttatacgaaagtgaaaggtgacaacgactattgtgacttcattttcagttagaagccagggcaagtttgttggccatagtcttgaattcctattgtttgattagttttgctacaaataaagagaaaatcgtatttcttctcagtggggttttttttccttgaagattcaacagcagaagatatttccattgattacttagagtgatcaacagtgtgtcactattaacggtgtgtcacatgtccttctgggctaggggcttttatcttgcaaaatggccttgtacggctacaaggtttacctgttgtttaggtaagttcctaaaaaattgaccaagtgacttctttctcaggcttgatactaacaaccactccctttctccaatgtccttcataaaggaatcccttgcatcatgagggccatttgttagcaaagctgagcattatccagaaagctcctcttgaccggccgtgatgtctctcatgaatccattgttagggctaccctcactcacataggctgcaccccaggccaccatgagccttggaacttgggcagttgggtctgaccccaaatacaaaactaatgctggggtctgaagagtccatcctccaagaaagtggtccttacatgatggtctcaggaaaagttatgtttttcataaggctgtctttggtcttgaaaagccaaaattagatattgcttaaatcaaggaacaaacaactggatatccatttgcctcctccagctgcctaactacagatcattcccatgttattcctatgctagatcagatgggcaattccagattcaagccttgatcaaataaggaaaggtacattcctctcctctgctccatccctcactgtggtgctgccttgctgatttgaggttcaaccagtcagttgtgaatggagagtactctcagtaggtgagatggtgggacggaaatgcatgcttatcctgcagcccacctcgccattagagcaactctcttaactgttatccaccctggtgcctggccctggcagctcatgggacgtcacaagaggacaatggctgggagaaggaccttctctcaagggtgccttggaggctgttttagggaatgaatggcttctgacatgggctttcttaaagttgccccagaagagaagttaccattgaccaggccctaggtgtttgcttagctcagagccatcaggagggtcttagctccttagatgagcagctcctgcactgtggtgtgaacgtggtttgcaaggtgccattaaataaacaagtgctgacaattttgcatgtttcctgggtgatattttattatactttcatcaaggaactggagcaccatatttatttaaatcagtacactccatatgttcctagcttggtgcaaagcaggcacaaatgtccacatgcagccagggtgctgactgaggtgaccagtttgcttgagttttcatactctgcactctccagtggaacagcagctgcaggactcttatttttgtgatgtggagcatgtctgggtgtgtggcagggggaactgaaatagtctctgctgactttttgtacctacagattttgtttcattgctcattttggaaaagggaagcccttatggggccaaattaatggtttttctgtaaatgattttttttccccctcaaactccattggcttgacttccagtggtatagaaaggcaatatggtgaacttctcagcccgaaaaaggagatctccaatcagggccgagaggctcatgctaaggtggaaagattttcctccgtgatggactcttggatacctacgggagacttaaaaggccctcagaccacaggattaatggtgagaaagcttcaggctttgagggtgaactacttggagttacaagttaatcgggagcttattaaaatctctggagaactctactgtgggaaattgggcttctatcttctctgctgatatcttattatttcaatctcctggtttattttctttggattttttattatgattttaagaaattatttaaaaagttaaaaatatttcttttacgtattccagtttagttgttttgaagttaattcagggatccgggatccccaaggtgaggcaaccgtgattttagacaaacttttttcctctcccaaatttgtatttgtgggctcagttctcatgctggtggcagtagggagctcagtgtttactgtggaattaaaaatgtttattgttgctgcacataggttggtgtgaaaggtaccaactgcaagtttcaacttgcaaaaacacttggccgttgggctcctttggaatcgtcttgaagcttcagattctgatatttcatgagcactttgcaaagtcactatgagaagcaccctccttcttacctgctcagctggagtcagttacagaattccttggcagctggctgtggacacgtgccgggcagtcaggagacccgtgggagctgtgggagtcctgcaacgtcaataggaagaggtggggacttagagattgccccacatatggtctgttgtgccagggcacacctgttgacactgagttccaaggaagtccagacattagagggtgatactctctgtccacagcacctccaccaagcgctctttgttcatcgacttagaaacagtaggaggcgggaagccctctcttgacaagatcctggaagtggccagctggtccctttccagccaagtgtgtggtgtgtccacttcctgggagggactgggaccaggaggcctctgagcccttcctcagaagtgtacatgcaaacaagagggggctgagccatacacctgtctctgagatggtctgagatatgtgcatatgggattgagcccttcttgttcctcagctgaattaagagggtgaccacagtgctcagacccccccaagtaaccccatttcccaaatttctcttgagtacacaatgcctcagactgtactttatgcctaaggaatagctgagaacccaactgaagacaagtgtgaactgcaggatatggttgtgaacagaactgacgtgtgcaacagcatggatggaactggaggacgttatgtgaagggaataagccaggcacagaaagacacaattctcatgttctcacttgtatgtgggaactacaaattcacacaattgaattcatggagatagagagtagaatgatggctaccagaagctgggaagggcagcagggggagtgggagtggggatgacttatgggtacaaaaatatagttagatagaatgaatatgatccagtatttgacagcacaacagggtgactatagtcaacaataatttatggtacacttaaaaataactaaaagtataattggattgtttataacacaaagaggtgacaaatgcttgaggggatgggtgctttatttaccctgatgtgatgagtgtgcattgcatgcccgtatccaaatatcttgtgtaccccataaatatatacactgactatgtactcataaagattaaaaccaaaaatgctgacgtggccatggggtgaccctgagaaagagtgagttgagtgtggcagggcaggtgccctgttcgctgacacgtcagattgtacctggggcctgtggtcatcgctgggcaccacccagcagtagggaaagtggcaaatggaacttgtgcaagagtgactcacccagaaggaaggtggggagactaaaaccatgtcatttagaaatagctgaaggaatgagaagtcccttcagacctagggggacacctggtatctgtcctcagatttcggaagggaatattactactaatactcatgataatcggagctcacatgtattaaatgctctgtgccaaactctattccaagcacttcacatgcaaatcttaaattaccctacaacatacataccattatgatcttcactttatagatgagacagctgtaaatggactaagaaatgtgagtttcattagaaggtaatggagggaaatatggcatgtgttaccataagttagcctcagtaggaggaagagctgtctgacatgataatatccccccgaaaggaaggtggaaatggccagaaggaagataattaaaaccacatgtattgagcatctaccctatgccagacatggcctttgaagctccccatgtattattttggttaatcctcacaaccactgtgtgagagaagaattattattcccgttttacaaatgaggaaattgaagcccagagacattaaataaatctaagaactttccaccagtaagtgacagcccagatttgaatacaggtatgtgtggttctcaagtctactgtcattggtgttcagagcaaaggtggaggcgcacaggtggccccggggcacagaaccaggctggttcccctgctagacactcctatagcagcctgaatttcacaagttgtgacacattcatctgctggtaacttttgttgcttgtcttccccgttagactgcaagatccacgtgggcgggggctccatgggtcctgtgcagtgctgtactcctaggcactagaaatatttgaaaaaatgaatgaataccagtagagatctcttgttcagacaggggaagttaaaataaggataatgaatctcctattgggatgttatcgggagattcttatgttaaattaggaatggattatcagcagttgtaatcccagtatattttcagaaatactggacagattttttttttttttttttgagacagagtctctctctgttgccaggctggagtgcaatggtgtgatctcagctcactgcaacctccacctcccaggttcaagccattcccctgagtcagcctcccaagtaactgggattacaggtgcctgccaccacatctggctaattttttgtatttcagtaaatatgggctttcaccatgttggtcaggatggtcttaatctcctgaccttgtgatccactcacctcagcctcccaagagagatttttatacatacagattcctaggcctatatcagccccctagaatcagactctcctggagcaggacctgtacctgtatattgcatcatttcctggttgatttgctacctggccagctgagagaccttggaggatgggtctaaagtccacctgagatactgggattcctgacccccaacatctgcccctgggactcatttcccacttcctgttgcctctgcccaagcttctctctgccttctgggcttcaaggccaggccttgctcgtggctggagcctggagggaggtctggtgccgagtcaggcatgggaccttatcagctgggtatttactgagcaaagttcaaccagggcagtgctgcagatccgggtttaacagatacctaggcttccgggactttgattcagagcccaggtccctggggcccttatcggtggataataatgggctccctgtggaagtcctaaggtctagtgtttcttggctgacccaggcctgctctctgagagcccaggatccctaggccacaggctgtctaggtgggcagcttgttgcttcccagccacggctgcttttcagttgctctcccaggccaggaagggccctatgcactggctcttatttgggtcaatgctttggtttcctggctttgatggcaagaggggaaggaaaccttccctcagcagcaggtggacactgtctggccccagggtacaaggatcacccttgggtaattgtcccatgccctgaaagtcactgagaacctgggagccacttgcctcaatcctaaaggtgtaggagaggtgaagggaagacaaatggcagcatgtcttaaagaatcacccaatcgattaatcaataagtatcaactgagcttaaaacgcatgggcatgccactgggaagacatagagaaataaggtacaataactcaccttgagacgtttataatctagttgtgggtataagacacttccatcaaaaagaataactattacataatagactgaatttttttgaatgcctaccctgtacctgaatttatttgaggcatatactgttctaccaatttcccacatcaagtgacttctctcaatattcctttgataaagaaactgaagattaagaggcacagagaggtttagtaacttgcccaggatcacacaggaaggtggtggcaggggcaggatttgaggcctgtgctatctggctcagagtccctgctcttatggctgtcctctactgccacctatgatgaatactaatcagatctggaaatgtttgagaagctgtagaatgtggaaattactcaggctgcaggggtcaggcaggagggttgcatttgtcttgtgtcagcaagaatcaagaggttggaagaagtgagagggaattctgaccacggaaaacctcaaccacagatgaggaggtgagacacgcaggaacacgtagagaacacagacagaccttctggttggagacagggtttgtgtagtagggagtgtgcaaagtggtgagaaaaatgggttcggatctcattctgaagactgtccaattctaggacaaggagctgggccttcgttgtctgggtgcaggggacccacagaaggtttgggagtaggaggagtgacaatactggagaggcattctaggaagtgtcacgtggttctccgtgttcaagcacgacttaggggagcaggcagatccatgaggaaatgagcactttggggtgggggctcgtctgagaaggaccatgggctccagggacattgcttttcacagccacagctccggagcaagccccagccccggcccggccataccagggcgtccgtgtgaaggagccagtgaaggaactgctgaggaggaagcgaggccacgccagcagtggggcagcacctgcacctacggcggtgagagtttgtgtgtgtgagagtgtgagtgtgtgtgtgtgaaagagaatgtgtgtgtcagggatagtgtgagagtgtatgtgtgtgtgagtatgtgtatgcgtgtgtgtatgtgtttgtgtgtgatagagtgtgtgagagtgtgatagtgtgagagagaatgtgtatctgcgtcagtgtgtgagagtgtatgtgtgtgtgagggagtgtgagtgtgtgagtgtatgcatgtgagtgtgtatgtgtttgtgtgtgatggcgtgtgtgagtgtgtgatagtgtgagagagaatgtgtatgtgtcagtgtgtgagaatgtatgtgtgtgagagagtgtgtgtgtgtgagagtgagtgtgagagtgtgagcgtgtgtgtgagagagtatgtgtgtgagggagtgtgtgtgagagagtgtgtgagtgtgtgagagtgtgagtgtgagagtgtgagagtgtgtgagagagtacgtgtgtgagagagtgtgtgtgtttgtgtgagaatgtgtgtgcgcgcaggcagatggcttgggaggtgaccaaaaggatcaggcaggaaggagcgcaggtcccttggtggaggctgccagggatagagctagggtggagcaactgggatgagggatcagggccggctcagctggcccaccgaacacagctactgtcaaggcctgagtgagcgaatgacttgcataccctggtgtgagttgggggctccccctgagaagaagaagacaccagctccctgagcgcacagacttcctgctaaatagaaacgcaaatctctcaagtgtaggtggtgatggttgggatacggggtgggatgttttgttctaaccagagagattcctatcttctattctcctgccctgaggccctctgggcaagttctctgcacagggccggttgacgagggctaaacattgaccctggtcttctcctctcccctctaggtggtgctgccccatcagcccctggcgacctacaccacagtgggtaagagtgccccgtagccctggtggcccccaggcctctcatctgggtggcatctgaagttctgtaatttccttcttcccacaggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttgacctatgcctctccgccactcatcaccaatgtcacggtatgtcacacaaaggcaggactgcacccgcccatgctgagtgcacccttttataaccagagctgacttctcgatcctgatcttccttgctattgattctcaagataatcaggtcatcaaagctcgccttggtctccatggaggcctgctctgattctcatttcctgagataacttccacaaagatgtctcgcagcctctctcgtcatactttctgctcctcaggactggggaggtcttctctgattccctgttctaaatctccccagcttccctgcaagcagtgagtcttggttctgagttgaagtttttagtgaatgtggcaccaggcgagatctacatggggtcttgtgttggaactagcctttcatttctattcagataacttagggagtgattgttcacttaataatggggtttaacagaagatttctaggctgaacaacaggtgatatttttgatggtgtcagacccacgtgtggggtaattttttaaagttctgtctctactgtcagattgccttgttcaaatccctgtcccttcacttactagctatgtgactctgggtttagtgacttaaaactctctgagcctcagtgtcctcatctgtaaaatgggaataccaagaaaagggtcgttgtcaggatcaaatgaaataatgagtgtggagggcttagcacagtgtctggcatacagaaaccactaatatatgttagttatcatcatatcaaaatctgctaacattaaccaagggcttgatgggaaaggaagagcctcttcccccgggaatgaaggaaggaagggaaatagatttatgttaatgattcctgttcgactaaaggactgggaattttgcaagtattcaagggcaaaaagacctgtggttacagctgtatccagctccagtccagggaaaccgtgggaagtagagctgggccttgagcagtcccagagcccaccttcgatggtggtgcttgctttggtccaccttgtctcttccgtttccctccagggtccagtgtcatcctgatgcacctgcccctgcctccaagcaccttctatgaaaggcctgcagaagcccttccctcccaggtccacctgcctacccagcaaaccaattttggagcctggatgatgatagataagaaggagttaatccaacacctctcccaggcaactcatttccatgtcagaggcctggggtgagggtggtgggtggaggactcatggctcccacccatttcattaccaaggattcctttcattatttatcccctttcatcattcccaccttctgctttgaaaggttctgtttatcaaacaaacagtattcattaagaattgatttatttgttttgccattttgtaaattaagtcatcaaagctggctagagctgtaagtccacactcctgatcagcagagataagacctgctgtgtgctgagtggaagtaattgtattcccgagcaaagaaacctatagttacaggtttatgactgggaaatgtagaatttccatctggatttttgaaaagctgggaatcatgaggctttcccggattctgtctggtttcaggacactgggatggggaccactggcttaagtcaaaggagaggaagtgattatgctgtggtggggtgtacacctcagcccggatttcgggaggctggaaggcctctgagaccatttccagctctatcattctatgcaaaaacaccctaaagccttgctactcaaactcttgtccctggactggccacattggagtccccctgagatctgattagacatgcaaaatcccaggccccactctagacttcctgtgccagaagctgcgttctaacaagatacccaggaggttgagaaaagccctgccctaaatgattctaacagtttgctgtcaagacacagtgacagtaggagggatatatgacaggggagacagggatggtagggggagattttggcctccctctcatgaatccatgcagagagcatcctcttctatctgctttcctcaagtgtgaaagaaaagtaagaatccaggtcccgcccctgttgcaggcctgatctgaggtttgtgagggcagtcgccgtgcaggtgagaggtatgactcgcagagcattcaggagaaggactctaacacttggagggtcatggggggtgcccataagtgggatggccatggagatcagctcagagacagaggacgatgaggatgtggaaggcaccaggcagcagcaggaaggaaggccaagtttgctgacaaagcagtgcttcccccatctggggatggccaggcctccccatgctggccaccactagaggggtgggaggtgatggagctgtgttggcccaaggggacctccaaagctgttgtgtggagcccggactgtctttgtgtctgggcaggacagtggccaccttccagatacagcttccaggctgtggtttaacatatattttcacagattttaagatgcatatatttttaatgttttaagatctctgaaatagaaatgaattttgtattcaacgaaacctggaaaatcctctctaattggcctaacccaatgagttcattactgtttgtattctatttcgtagatgagaaaaatgagccttctgagcaggaagtggcctgagcaaagacatatagctaggaagggtcaggattggggctgcggttgaagtcagcctggctcctcccttggggaagactttgagcaggaggaggtggagccccatgaagtgagaaaccaggaaagggcagaattgaagggggagatggagacccctctaagggcaaggatgggtggatgggtctcctggggctgctaaccctctgtcacgtgttttcctgtcacagacaagaagctccgccacgcccgcagtggggcccccgctggagggcccagagcaccaggcacccctcacctatttcccgtggcctcagcccctttccacactacccacctccaccctgcagtaccagcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactacactttctacgcacagctagaattgtagacctgtaaaccttccttcccttcttccttcccctccctccctcacttcctccctctcccccatccttccattcttcccctccctcccttcttcctttccaaccccttccttccttttcctccctcccttccttccctccttcccttctccctttccaaccccttccttccttttcctccctcccttccttccctccttcccttctccctttccttctttacctccctccctccctcgcttcttctctctttcttacttcttttttcaattctgttccattttgggaggtaattatagggattttagcaataacattttatgtcaaatgttgccaagtctgtggtccatgggctttcatttctgtcacatttcatttcttggaaaaggcctccttcctccagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtgacgaagagagggacagaggagggatgggaacaggctgtgcatcttagttggagagaggggtgtgggaggaagcttgagtttgatgcagggaggaggaaggctgaggaatgacttggctccagattacttggttattaagaagaacaataaactaaaggaaagcattgcttgaagagatggttttgctgctctccttgaggatacgtgcaagggaagttgggctgttgtaaacagggtgaagggtgtgtttggtcggccatttctgtctcacctctaggccctctgctggtgctgtggaggccaagaccccattaagcctaaaggtgatgggtcctcgcctagtgcttagtgctaccatgtgggttttgtttctttccttccttccttccgtccttccgtccttccttccttccgtccttccttccttccttccttctttccttccttccttccttccttccttcctctctctttctttcttttttttggttttttttgggacggagtctcactccattgcccaggctggagtacaatggtgcgatcttggctcactgcacctctgtctcccaagttcaagtgattctcctgcctgagcctcccgagtagctgggattacaggtgcatgccaccatgcctggctaatttttgtatttttagtagagacggggtttcaccatgttggccaggctggtctcgaactcctgactttgtgatccgcccgcctcagcctctcagagtgctgggatcacaggcgtgagccaccgcacccagccttttaccatgtgggtttctttagtgtcttaaaagcgtccataagccaccattctgtggaaccaaggccccctccacgcaaacaccctccctcctggggacctctggagcctcagccagaagtaccattaggtttaattttaatttgttttgctggagaaacatcaggtttgtaggagactgagttgttagcaggtgtgcttagctcttgatagtgaacgtgtaccttgggaactggctcacccacctgctaatagcaccatcgtcactattaagcagacatttcagttggtagaatccatgtagaagtcatggacttttctgggaaatgacttttctgggaaatgacagtttctttgacatattttctttgcccactttaaataaaaactctggagaaagttgtctgttttggattttctttttctgcttaagattaattttgacccagatttctctgtgcctgccttaaatcccagtacacaaatcttgaattgtttttattcagatattttttagatttaaaagttcaagacagcatttgagaagatgcatttacatctttgtcggtactgatggtaagtaggtgggcagggctctcagtcctatttgattaaaagccctggttttccataaaaaaagacactatgcaagatttttcagcgtaccatttgagagggtgcagaagcaacctccgtaaaggagttaaagttggcaaaaactagcaaagaaatatagtactttacgtgtttgctaagataaatggtctattttttctcttatcttgaggtcaaatgtcttggtagtagtccatctgggtttcttcccgagttactctgctaagatggaaacattttcataaagatttgtagagacttttctgtgccaaagtgtttcatttcttatcaagttgatccccctaagctttcagtcccatgttagacagtgtgattagaggaaggaacttaacactagtcttgttgactttgcaaattgatctgttgcagaagaagataaaaccagtccccaccgtgcctgcagtccagttctcccaagcaggacatgcgcgtggctagggggcttgttgtccaggagagtggggagctgaggagagagggaaatcttttaacttgattgctcttcctgttattcacgccatcatgagtaacttctcatgacgctgagtgttcagggataagttctaccacgggcatttccatagcaggctctgaaaatccatcaatcaggatccaggagcatgtgacatcaggcaggaaccatgacctaaggaagccatctcatagggccagacatcaccacggaatggaaattccagaagccaattagtcccctccaagatcagtcaatggagtgagttacagtttggaaggggtctccctttcctggtgattttctgagtttctaaaggcctctgagctcactgcctacattgttaatcttcgttggagtaattgttttaaaattatctacactattctgctatgagccttatttccagattttggaggagagagtacatccagttatttagccttctttagattaccagcaccattgtctttttggcttactctccctgaaaaccagaacctagaaaaatgacatggaaggaaagggtttgaggttttatcttcagctttagtgaggctcaagtgaaagggaagatctattaaaaatgcatttgccttactctcttttgaggtagaggcatgaaaaacttgatctgcaacttgaagaagagcatggccagtgtgatgtagattagtgctttacaagattctgatccatgaggctgtccaattccagcataaaacaggctagcaaggagacaagtatgtggctgagatgaagaagatagacatctggaaaagaacaaaatcacatgaccaagtggctcaaattctctgaacatcaggttgcactcatctctaagtggaaatctgaagacatgttctaaagctaaacacaaatttcttgaaatcagaaaccatagataacttattttgcattaatttacttcatttgagtgtcaaatatgagactctctcaataatttcttgttgaattgaattaaccggggggattctctgtccactgcttctaaatattgatatagatgattgcaagttgattataatgaagtctcctttattggatggacagagacatgatgcctggcagatgttttttctgaaagcttgagtagaaatattcataagctggtgatgttaatctgtttgtcagttcttctacagctgtggctgctgtggaaggtgtttcattcattcattcaacacagatttaaaaaaaaattattttattgaaagttgacaatttaaatatgtttgtggggtatgaatataatacaatatattat

SEQ ID NO: 12579 - DNA, 7579 bp, Human
  misc_feature (1)...(7579): n = A,T,C or G
ggcagagatatgaggcaaaaagccaaaaagatggaagggaaaagaaagttctcttttcaacatcttattcccttttctctgaagcagttttcctggagttcccagcataaagtgtgtgtgtgtgtgtgtgtgtgtgtgtgtgtgtgtgtgtacgctgaggggaggaaggatcccaactacaccctgttaactgttttttccttttgattactagaagccttagatcacccggagctcgtttgaaacgtgggtttgtacacggttgaaggagacaaacaataagagaaatgcacaatttcatttcaacagcttttcccgagtagaaagcacacgctccttgtggctcctaagtggctgtcactggcggtgcctgacacagttatattcacaacaacaacaaaaaagtatgcggaggaaattaaattatatggaaatcaatagcgtctgactgcttcaaacaaatgtctgtcaccgcgattattctccaggaacctatttataaacctttaaagaaacaggttcttgcagcaaaagacagcaccttctgcatttctgtgttgttatttatactgtatacagaggaatgcgcgggcataatttaacgtagaaatgtccagctgtatacattatacaacagcttgttaggcatcccgaagaggaggaatgcctaagtaatgctcatatattcaaggcttgctatcagggagaagaaacatacacacatacacacacacgcacgcacacacacacacacacacacacatagaggggcgtgcgcgcatctcgtcttttttattctaaaaggtgcccacccttagacaatagctggaccttctgatctttccagaccacggtgggaaaggtgaggcgggcagtgcgcatgcccgggtagctacaggtgcatcacctgcgctgtccttgctggtggtcactataagagcggctcccacgcgctggtcgcggccggacgagcgcgcgcgcgcgcagacgcacggggccgccgagaaggagagcgcgcgtcagacagacggagacagctgatgcctgtcagcgcggtggggccgcgagctctcgcgagagctccccgggacggccgcgagaagtggggctcaggtgttagaggagtgcatcccgtcggcgcgcggggctagagctgtcggagaagcgggaccgcgaggccggcgcgcggcgctctgcgcggtcagagggagcgcctggcagcagcaggagcagcagcagcagcccgcggcggggccgccgccagccgccgcgaccgccgcggctgcagcctccgaagggaggccgggtgagccggcgtacgcactttcccgcggactttcggagtgtttgtggatatacatgccaagccgccacgatgatgtccatgaacagcaagcagcctcactttgccatgcatcccaccctccctgagcacaagtacccgtcgctgcactccagctccgaggccatccggcgggcctgcctgcccacgccgccggtaagcgccccacgcccgcggccccggcccgcgcgcccgcccctccccgtctccgaaacgctgcatgtcgggggctggtgtgtgcaggtcccggtgcggggaactgcgggcagggggtgtagagcagtcccgcagcgaggcacgttttgtccggcggcccttaatgtcgtgttcctgtctgcctctgcctccgcgtcaggcgcctgcgatcggagtagggagcgctggggccaggactctcgacttccctctactttctctgttaatttcacgcctcagaaaggcagtctctgtgcgtgctcgggtgtgtgacacgggtccccagctgcgagttacatttccatttcttcttttccctctttttcgtctcccacgcccgtttccggaatgtgttcttgtgtccccctttctccctacttctgtccccctctccacgctcccatcccttctcgtctgccccctccctggtcgtcaatgtgccccctctccgtctttcccgctctccactgcccccaaacccgttgttattttggttgctttgtgtttgcccttcgcatgctgtgctttccggcctgtgtgtgtgtttcttctgttgttttgttttgctcttttggttttgtggtttttttggtttggtttgtgtcgcctgcagctgcagagcaacctcttcgccagcctggacgagacgctgctggcgcgggccgaggcgctggcggccgtggacatcgccgtgtcccagggcaagagccatcctttcaagccggacgccacgtaccacacgatgaacagcgtgccgtgcacgtccacttccacggtgcctctggcgcaccaccaccaccaccaccaccaccaccaggcgctcgaacccggcgatctgctggaccacatctcctcgccgtcgctcgcgctcatggccggcgcgggcggcgcgggcgcggcggccggcggcggcggcgcccacgacggcccggggggcggtggcggcccgggcggcggcggctttttgttggcggcggccccgggggaggcggcggtggcggcccggggggcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggtaccacagcctgggccacctgtcgcaccccgcggcggcggccgccatgaacatgccgtccgggctgccgcaccccgggctggtggcggcggcggcgcaccacggcgcggcagcggcagcggcggcggcggcggccgggcaggtggcagcggcatcggcggcggcggccgtggtgggcgcagcgggcctggcgtccatctgcgactcggacacggacccgcgcgagctcgaggcgttcgcggagcgcttcaagcagcggcgcatcaagctgggcgtgacgcaggccgacgtgggctcggcgctggccaacctcaagatcccgggcgtgggctcactcagccagagcaccatctgcaggttcgagtcgctcacgctctcgcacaacaacatgatcgcgctcaagcccatcctgcaggcgtggctcgaggaggccgagggcgcccagcgcgagaaaatgaacaagcctgagctcttcaacggcggcgagaagaagcgcaagcggacttccatcgccgcgcccgagaagcgctccctcgaggcctacttcgccgtgcagccccggccctcgtccgagaagatcgccgccatcgccgagaaactggacctcaaaaagaacgtggtgcgggtgtggttttgcaaccagagacagaagcagaagcggatgaaattctctgccacttactgagggggctgggaggtgtcgggcgggacagaatggggagctgaggaggcatttttggggggctttcctctgcttgcctcccctcggatttggagtgtccgttatcctgcctgcatttggggagtcccttctcgctctctttcctccacccattctctgattttcctgcctttgctgtcccctagccttgaggactggggtgctgggtgtggggattggagtatagggtaggggagaagggggggagcattcgggggagtggggagtggggggaaggaaagcggagacccgagcaggggttttaaggagcaggatggttctggggtttgggtggggggagacgcgggaagggtaggaaaatggactgtttctgaccagagacacttacctaaatatcctggggaccaaggaactatgtacaaaaacaaacctaccaaccaccaaaaactagacaaataaagacaaactaaaacaaaacagaacaaaagcaaaggaaaatgctttagaaattttaactccggggagccataatctgcaacttcattttcccccatagaagagaaaaaagagcaccaccattattaccacctccccaaccctacacgcacgaactgagtcgaaaaacgaaaaccaaacgagcgagaagttgaagttctgggtatcaaagctagttgttctgtctgcgtgtttaatttttccctctctcacctccaccccatccatatcctctttatttcctccgttccaatgagaggcctatggctgctctccaatcccgggaagtgagtgggagcacagctgaaaagagagggtcagggggaggctggctgcttgcttaggtggaatccaagttttcccgtggccctgcctatactctggtggcctggtcctgttggggtgggggtctttggagagaagggcatagtctttgagctactaaaaagcagaattccggagcttcgagatatcttattctaggaaaatgaaacaattttaacaacagttttttttcctcttatgtcgaagatctagttttagacaatttcaaaataagcttttcccactcatagaactttaacttgccctttcagttttatcttttttttagagagaggtttaaactactgatttttcctgttgattcaaatagactaatggggtgaaagttattaggagagatactctctcctgttttctccactgaacgagactcatcttgctcttctaggtcccgtttcttcctctcttggaggacatgaaattatagaaatgttgagaagttcctgctttcttttgcggtaggacttggctgtgagaaaatcacctaaatcccagaaaagaggaagacagatttaaagtgcccccacccccatttgtttcaaagaggtctgcatgttgggcgaaaacagaacaactgtgtttccttttacttgttcttattattcaagagtcatttattacaggggataaatgttgggtagcaagaactttaatttgcactaccagtctcccaaatagaaaatcatgtatagtatttcatagtaataatcaggtaccttacaagctgctggtggattttaaaaaattaagatagttgaaggtggttaggtaaaatgcctgctttgtgtacaagatactctttggatctctcgtagagatggtttgttaccatcctttaatcataactaaaacattgaaaacagaacaaatgagaaaagaaaaaaaacctgccgattaacaagactgaaatcatgcatgatctgaaaggtgtggaaagaaacacaattaggtctcactctggttaggcattatttatttaattatgttgtatatcattgtttgcagggcaaacattctatgcatttgaaactgagcactaaactgggctagctttctggtagaccgttttgtggctagtgcgatttcacagtctactgcctgtttccactgaaaacatttttgtcatattcttgtattcaaagaaaaaggaaaaaagattattgtaaatattttatttaatgcacacattcacacagtggtaacagactgccagtgttcatcctgaaatgtctcacggattgatctacctgtccatgtatgtctgctgagctttctccttggttatgttttttctcttttacctttctcctcccttacttctatcagaaccaattctatgcgccaaaatacaacagggggatgtgtcccagtacacttacaaataaaacataactgaaagaagagcagttttatgatttgggtgcgtttttgtgtttatactgggccaggtcctggtagaacctttcaacaaacaaccaaacaaaaagaaaacacaaagaaatggggggagggtagggtgttgaagggggacaaaaaggggagagattgagaatgatgtatttttttgctgaatcagaattcactttcagataactcatgaaaagtggtgctctaaataaaatgaattctatattagttgcctgtgtttataaaagttattattttttaactgcagaaactcttaaaccacagcacttgatccagagtggtgaaaaccaataaataaccaggcacccaaaaaacatttaaatttagggtcagggacagaggaatttggaggtttagatgtgatattctaccctaaaaacacctagtaactgaatggcttttctttggagggtaatacattttaaaacatttagtgtgccacctactgctccacagtgactagagagcctctatttcttggtgacttgggactagatcagatgccaaatgtacaaagtttcttaagagttgagattatatcatctgaagtcatcttattttagccaaatctttttaatttcaccggcaaatctgtgaaggaaaacacttgatgttcaaaaagaatagtacattttaaaagctgcgattttaaacagttgttaatgttaaaaaaaaaaagcactagaggtatttttaaacatagaactcttccataaaaagttgatttgtttttgctgttattgacttgaaacatcatcagttttaaataaaatgcatttgtaaaaaaaccgttattttatagaaaagtatgactggatttcattgttggaaaaacaggacagaacaaatgaaaagatttacaaagggttttttttaaagtctgcctcaagcagaaatgttgcaggcaaacacatgtgtattatataataatgatcaatgtaggtattaagaatttaagaatttgctttaaataaaacctttaccacataaaaataagagtattatgttaataaaacatcatgaaaatgaatttcctattttatgtagtaggaaactgtgcaaaacaaaaaaaaatgctttgctttctggtaagcgaatctatatatggcttgaaggagtagtaagactattctaagacgcctttaactgtcaatccatgaaaaaaaaacaaaaagggacctcctgaagaggccaaactatcattgaagtgggtgtcaatgagtgatagtttggcctttcaaagttttctagttctgaagagaagttcactctaagcggattcctccaccagttttggggtgaatatgataaaatgtgtgtctcggattcttttaaagaataatctcaaaataagtttgagagagtgggaaaattgggctccgtttgcatttcagcttctcaggaaatccaggcggcggcgggggtggaataggaaaagcaaaagacaaataagcattaaagcatctgccacatttatgccatccatttgtcttaaatttcctcttttccccagttctagctccaggtcgtgttccttctgtaggtctaaaaaaattatgtcctcaagacccatcaactaacttctgaataatttttgtttaatgcgtgttctgaaattgctctcaacttcgattacagtttcataaataaactgtaggcacccactgccgtgattgtatcgatttttgttttcttgtgatactgagactacttcggtccagttcctcctacacgtggcagcgcacgtgagagaacagggcgccccaagcccgcaggactcactcagcgatccctgccctctgcctctgccccgccgccccggcctctcctgatagcacctggcacctgcgtgaagtatccctactcatctttcaagttgataggctttcgcagtttttcgtccgtgaagttggaactggggcttctgatcctggctaaaactagcctttcccaccccatt

SEQ ID NO: 12580 - DNA, 7232 bp, Human
catgatggttgacctgaagtcaccgaggcaggactgctcatctccaggtcctatgggaaacagtacctggtgaaaccagagacaataatctccataacgcattgggagctgctgggctcaagcaactactctgtgcctgagatacaactcatacggcccagctagagctgatctacttcccacagggccagagaagaattgccaattaagaatgcattcccccctgaaataggtctatatttattccagggaaaataccaatctgcctgggtcccttacaagaacaatgtcgtctgtagcaaaatctaatctactaggaagccttcttgtattattatctgcaacttttcagaagagccataccagaccctcatatgcccagcacaggatccactcatgcacacctgtctagggccttgtctttatgattttctgtcacctggcttctcagccatgcctccaaccaagctatcctcaaataaagactaaccatgcacaaaaagtgaaaaattacacaagacctactcaaggtctgaaatggaaagtgcagctggtgattctgagtagtatattttatgaattgatgaacagggaatttctaggtatcacagagcaatcagcagctgaggagagagcgacaaaaccaggactctgacagggctttttggaaacttaatttttggagcaatcagcagctgaggagagagctaccaaaccaggaccctgacagggctttttggaaacttaattttttattgtcaaattatacagacaaaaatgaaagtaaaggtagtgaggagtaccacacacctttacttagaaggataaataaaggacacctttgtagggagaaaaaaaaagatataggacgaaaagtaaacatggcaaggtagactcagaatacaaaatttcaacaaataagtgcgagaaaaagaatgagaaagaatgagtattggaatattacagataaaaatccttggtgagaaagaacactctgatgaaacaggtgacataattactgagtaaaagcagaagaccaatcaaggcaattgaggcttggacaggtattacaaattatcttagatgaatgtataattgtggccatttaattatcagtgatgacaattacaatatttattagaagaaataaagtagaggatgaattctatggaatattctggagaaagtggaggtcttagctatatgacatcgtgtggctcacttagggaaccatatattcagtttgttcaggtctagaaattccttggtggtttctgagttcagttttgctttaataaaccctaaagatatttttaaaatacaaatattttagcttgcctgtgttgtatagcaccaaggcttgcctgagtgtagtgagattcacagaagtttggacaattcttgtagcctgagcaggctgccagcccccttctttcatatatgtgtgcctgggagtgtgctgtcctcacacatctcacagataagcaagaccatctctgttacatgaaaaatttagctaaatgtgaaaatatccacgcacacacatcatgagagatggaaagaggctatcaaaacagtcagagatattgaccatcttcactgttagctgtaggatcagtgtccaccccccgacacacccacacaaactcacatacacagaaatgaaaagcacagtgaaaagcagaatagcagtctttccaaacagattgaaaaccaaaagatgtctaaagttcaatcctgacactgtgccgactgcttggacacagttccgtcaaaacatttgtccaagtcatagttgtgccttttaggaattagacacaaacaatatcctacccaacccttcctgctgagctagagtcccaaaagaaatgagggatacacttgacctgaagtaagcaaagcagaagccagtctctgaggcgaggaggcccacctggtagggagctcaaatgcaccattgtcctgcttgtctttataaagggagctgacacgtttctcccagcacaaagttgggagtgacaccagagcctcctgcaagatgcttctgattctgctgtcagtggccctgctggccttcagctcagctcaggatttaaatgaaggtaagatgaattgggggaagatattgtgactctgattggggtttacaggcaaatgctatagaggaggaaagtggagggaagagaggaggatgagaaaacagatgggactgcagagttctcatgctgaggatcagaagatctattgtacctccattcctcatcaaggcctcatagtttatttgttgcacaaatagaatccaataaagaattcgtactaggggtgtgagagagtgagatttgcattatatagagacatgggactgctgtgaaggatgtggagaatgcaagacagattcagggaagtacagctgtgaagatcctgtactgatcccagtagacagggatgatggtggccttgctgtacagtggatgagcattaatgaaggagataaacacatgtcagagctactgccgaggcagagaattgggtaaacacttgtctctgtctacatagagttagagaataaccagagtgaaacattgtcatttttctgtctcctgaatgtagtatttcaatgtgctgggaatggcatgcgtaagattatatccaagtggctatgtctggtggctcctgttgagaaggcttgcaaacataaacaacatatttacagatgaaagagggcagaagaatccccaaatatgtcattgaaatactcagagcagtttaactaaataagcgctaagggtttacaggcaaatgctatagaggaggaaagtggagggaagagaggaggatgagaaaacagatgggactgcagaattttcatgctgaggatcagaagacctattgtatcttcattcctcatcaaggcttggggaatcaaaagaggacaaacaggggcccttctatgttgagttcctggttgacgctcagtgtagtaacaatactgctttcccttacatcttcttccacttccagtagcatcagagagtggctgatgagatcacaaaggggatgcacagggtgtgatcagaggtcctttatcctcgtagaacactatgagccttgaatgattcaggaagtaacttttcccatcatcctgtacttcttttctagatgtcagccaggaagatgttcccctcgtaatatcaggtaaatcccaataaattctcagtaaactctgtctccatttttccctgaaaaattgatgagttctccagtgtcttcttatcaccattttcttgtcaggaattggctaataccaatgccccaaagatataaacagttttctcccaaccttgattctggggaccatgagtaaagaaattcgatttttcatcacccttatgtggattaagaggagttctaattaggaagccttgggaaggggggaggttgggagttgagaggcaggtcaggcagagaggggccggccgtgtggtgaagacagagaggtatgaagacaggagggttttccagcatgagctcagctcttcttgtttcaactcacacagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggtacgattccagtttattatccatcaaaggctccaactgctacagttctccaacttcattgtgccaatgaatcctctgaaaacctgttaatattgccctgtcctggaacacatttctaaaaattgttattcagatattcttgtatagagtatcaagaccctgtgaccctgtgttttacagaagctcttgaaggcaattctgattttgagaatcactatcttcaaattacatgtcttaagtagggttgacaatgaggacatagaaccatgttccccctttggctctctctattttctttcctcaaactcagactcccatttaaagttttcacctgaacatgctttgctcagtcctgcctcacatcaggctttcaggtccagtattcctgctaagtggtccttgaactttcagttgtaaaatggtatctcatttttagtatacttacatttaaagtcatacatgcttaagctaacaaaaactaatctcactgaaccgaaatgtacagagctaaatagtaagagcctaactcatctttcctcccttctatccttctcaaaacccccaccttttactctttggaatctactttttgaaatatatattgctacataaatatatataatgcttttattacaagcacttataccatactgtatattcagatttgtgtcttactcactggaaaaatttattgtttagaaaactttctcctgagttcatttagatctcttcagtgtttactggttagtttgtttttacaattgtatactattctattgtttggttgttccgtaatctatttaaccaatccctgtcactggatattaaggcgggattcacattctcactattatatgatatgttgcagtgcccatctttgtaaaaatagcccttacataaccaacagcagcaaagcatgaacacataacaataattgtttctctttctcatctaagcaacactttaaatcacattatgtgcaatggcttaaagagtgaacaaagaaaatattactaaggagaagggggctgtagaagggatagagggcaagagtaggggcttgcatctccatcactgcagtaacccccagtgagggattagacatttcctgccatgtcaagtgttgtctgtaatcttccttgtttgcttgtctttttcaggaagtgaataagaagataacagtgtttcaaatgccgtgaaacatggcatcatgctctaacttcagtataccaataaaacaatcagcttgcaatttctgctggtggtgtctctttctgagtgtttgggactctagaatctgagacccatgttcacattgtaagaatatccaggaccccttctccttgatgtttccagcaagcttctctcctccttatccttattaagtcatccacctggggaaggagttccactgtttctttccttctctgtcttctatagctcgaatttaagttgtacaattattttcaggtcatttcttgatattctagtcagcttatgaatgtaagcaaaacaataccaatgaaagaaaatcccagaagctgagagaaattttaacaagttcaaaagtaaccgattttgttttctagggaaatgagtatggttctatgcctctattccccagaagccactagacctattttcccatattttatcactgatcagttctgtccctgcctatgagtcttactattcttaagaaaacctaaatggatttcatcagaggcagcctgacttgaatgggcaaagaatttggaatctctcagattgcagtttaagaactatgtcttgctaactctggactcataggaagctacttaagtctcagagcctaagtttcctcttctaaatttttgaataatcaaaatggctcccctaaaggatgaagactaagcagatcacatacatgaaaaactagtggatatagtcatgtctgcttcacaataatgattttaggaaagaacagcagacatgaaattgtgaggaattaaatgctcccgagttaaaaatcttaagatttctttgtccaaaaaatctaagtagaatagtctctgatattgtttttttctaggctttcaaacaaaataggaacacattgagtatccatatttttttttagcattttctttcttatcagacccgtaaaattctaattaggttttttttaaaaaaaatagtatctgcttatggaaatttaattatgacaattagaaatgcaggctctttcttcctcctcctcctcctcttccttcttttttatttctcctactccatctccctctttttcttttttgaaaaaatatgtttaaagttgccttcaattatatttatttatttatttatttatttatttatttatttatttatttattttgagatggagtctcattctgtcacccaggctggtctgcagtggcaagatatcggctcactgcaacctccgcctcccaggttcaagcgattctcctgcctcagcctcctgagtagctgggattacaagcatgcaccaccatgcctggctaatttttgtatttttagttaagacggggtttcaccatgttggtcaggctggtatcgaactcctgacctcgtgttccatccgcctcggcatcccaaagtgctgtgattacaggcgtgagccaccgcacccggtcaccctcaatttatttttaaactttatttttataaatatatgtggttcaaagataattttgttacatgtatacattgcataatggttaaatcatggccttagggtttccataacaagaataacaaacattgcatttactaattaatgtctaactcttaattccctcccacccactcactcttccaaggcttcagtgtctatagttctcccctctatatctatgtaaacacattttagcacctacttattagtgacaacatgttatacttgactttctgtatctggcctttgtcacatagcatattatctgtcacatccagttccattcgtattgctacaaaaggagtgatttcgttccttctttttttttttttttttttttgcagagtagtattgcattgtgtatatatcacgatttctttacctacaaacccattagtatccattgatggttacttaggttgatgccatatctttgctgttgtgtatggtgtttcaataaacatagaagtgcagatttatttttcatatactgatttcatttcctctgcatagatacagtagtaagattgctagattgaatagtaatcgagttttagttct

SEQ ID NO: 12581 - DNA, 91559 bp, Human
aaacgctgccatctgcctgaaaaactcacacctgagcttgcggttctattgaatgatgtgtgaagattaccacacaaatacctattctgtcttctagatgtcaggtgtatgtcaggtcatgtctgacatacatttctaaaggtctgtgagcagacctttacagaatagtgcaagtgaatctggtgaaacggccgtttaatctgcattgcttattaagtaagaaatcattgtctaggaagaccttcagggggacagagggttttgccccaactctcttccttgctgtaatggaagccctggtcaccctggaggtttccatcttctcttcctggggcagcatttcccagacgcctgctgggctactgttgcctgattagaaacccaccctgggaatagcagggtgacaccagaaaaggtcagggtgctttaactctggctttgtgagttagtgatccctctagactcaaacagaattaaggaaatcttcagaaagtcccgacagggcaaaaactcccgtaactgaagatgattcttagtgatttttcctgatttgtggagaaatgaagttttgtctaaaagacccaattggcccaggaaagaagggattctcaaagaaactctctccagagaactcacagctgttagccccgctcctgcctgggaattctaaactcacagggcaaagggcgcctcctaaagacaaatttgtaagtcatctacctgctaattcagcaacgtgacagatacggaacccagcaaatcatgatgtttacccaaccgtctcctttagataaaacttccaaactctgcaggaaattaggacttcattaatatctgtgaaattaatgcctgtcaaaagctcctaatttgtctctcttgtggagtcaaagaacactggtatttagcatactggagatcccttttgtcttagctagatgaggtattacaggcccaagatctccaggtatgttactgattctccttccaggtctttattatttcaaatagttttctttctttatacaaaggcagaaaagacaatcaatgctttgtttcttatctttggcttacttatgaaagcttagaaaaaattataagtataaatcatcaaaaagagagacggagcaaggaagtaacttttttgctgaatatcagatgatagtttcagattaatgggacctcggaaaagtaggtaaaaaagaagaggtatctagttcacataagtggccagaacactcaataatggaacaatagatgaagaattagactagattcctggatttgtagctaacactttgataactatcatctaaacctcttggaaagcataattactgatttttgggcttttatgaagtattttgttcatccttatatgagaaagccctattttatagtagtcaattagtttggagttttctacgtggtttgtgatgttcaaaggcttagagtgtgtgtgtgtgtaactgtgaagaaagcagacctttttgaaaatgtccagagtaaataaggatcagctgccgaatgccttgggccaatcccattacacacataaatagaccatgtaagaattttgcggtgtcatatttaactagtgtgactaaaatagactcgctctatataaactcattttctgattactgtgtgctgtttcctgggcacctacttgaataacagaagacataaaatattggaaaacttttgcctcactctccaaccattgggcctaactccattaggttgaatggaactaactcttgagttacttctcaaaagcaaggttgagtgcagacttccagaaagcctctcccctcagcaagtcagtgtgtggttttgggtgagtccagcagtgtcctctgcagaaggggaagtgaaaacatttgttcacatggatagtggacctatgtgaggttctggctgtccatgataaagcactggttaagtagacatggggcaccaaaaataatatcttttatagcccccaaacagcgtttgtcttttgtctttttccagggcgcaaccatgtcgccatttcttcggattggcttgtccaactttgactgcgggtcctgccagtcttgtcagggcgaggctgttaacccttactgtgctgtgctcgtcaaagagtatgtcgaatcaggtaagcttgaggggattttcaaagcgggggaggaggaggagaatcctgctatgaactgtgtatgaagcaaggtcttccaggacatttgacatcatctggtggaaccaaatcctgccatttaggacactgatgcccagcaaagccaaggacttcctcatggacacacatttcgtgatggactctaaaccaggacccgatggcccaccggtgctctattgcactgtatcatttttcccacatatacaaagggaaagagaaagctgggttgaggaaattacataaggagttaatgggaaggaactctaatgagctgaagtagaacatagccctatgtggttaagcctggttactttaaataagtctaggtagattaagactgcataatcttccaaccaactctaaagactgcttactgctgctttggcaaatcttcagtggatattacaaagcatctataattagccattagaatccaaatttcagaaaacgtacttttgcactcactaaggtcttggctgaatgaaagaatagtgatgtttcatcaagttcaaatacaggcagctcaaggtgagggggaaagtgggacagccacccaacgtcctgtttgtgggttcagaatgttccattccaacagtcttatgtgtagggaatgtctctgtggtcacgtcggccggcttccactctccaagatcttcacctctgcattggaagtttgccacggatttccaaaggaaaagtaggagggagtttagatcccacaactctcctgactgcacaccttttcttgtttccctacgtgcattttgattttagcagacactttgtagggaatgataatgatgatggatgcaggcttgcagtaactatggaagccatcacagttcacttacacaaaagtgtttacggagagaccactgcaagagtgctgggaccagagcgtagagggaaaaaaagtcaaacaagtaagctgaaggaactcaggaagactgccttccctttagagcatctattcttgcagaagaaagtggcaataaacaaaaatacaaacagcaggtaatgaaggaacaaaaagcagtgtaaagaagagagggactgggggcagggatgtgtgttattttatatagggttgtcctgcaaaggcctgtgagcgagggacatttgcagatacaagaagaaactgactcagactttgagaacctcctgccagatgctcagagttcagattctggggttcccaaacctactattttgcatcccccaccaaaagcctttttgcttcacagctgactttgtccttccagccactctgaacacatcaaagccagagagactgtctgaatcatcttgatttcctttctgcccagagttctctcctgtttagttaaaagtgtgaatgccacttgctcccaacctaaaacctttcagatgtcacagacatctttgaagtgtaaaacgtctgagtttttcaaagccgcctttgacttaatgggtctcctggatccagttctctttaccatctcaggtctccctgacatttgcttcctgagggctttttttttttttttttgcatttggccttgcctttgaacttggtctaatgagccatgtggatcgagagtccttgtcagaaaagaaggaaactggttttcctaaatattagcctgtggagttggagggagtttagagatttttgcttttgattttattttgggcttgttctgaaaagaaatcactctgaatattatcattcaatatttacttctacaggatttaaacacatttcagttcttggggtgtaaggctgcattttccacaatgagccaacagaacaaggacaaacaggctacggggctgcggggttgtgagtcgttaaaacggtaacactctacatagatagggccctctgtttaggtgattacaaacgtggcgaatgaaaatgtaaaaagtgccttgctttggggacttttgccccttctcagggtatttttggcccttttctccaggcacagagaatggttaccatcaaaaggaagtatcggaaagggaagcttcaggtctgtggaagtaaaatgttaccgtgatcattaatattgccgttggtttctaaaaagcccaatctccagtccaattttttttttaccaacccacaaaaaatgtcccctttctattccacgtttagtagtctcatggtttatgtctttcctagccaagtttatctaacatttgagtttcaagcttattcaactccttgtatacccccgaaataaatattaatttaacaaatgctaaatgtctgctctgtttagctttgtgtgttggacagaaggggccctcgaaagttagaagggctttatttcctggctttaagcagatttttccccttttgcttaatcgacatctctgaattgctaaatctgccacttaatgtgcttatgtcacaagaaacaaacactcaaatgcaggtttctgcttctgaaatgattaaagaataaataccagagaaaatccaatgtgcgtgaaagacaagaaaaaacttcttaattagtaaactctttgccaatcacagagcggctttagggaggtttcccctagactgaccttcctgtctacagatttgttactatttccagggctcctgcctacctgcctttactcacttgcaggctggcagtcggcttcagccttgctggctccatgggtaaagatcagcaccacctctctgacttgctcatcagcttttgctgagggtgcatggtacatgtaaaatgtatcttcacccaagaattagagaaggaaataatggctcattatgttttaaagatcattgtctcttactgtatttatgtcaaatggaaaaaaatgtaaatatttcttaaaggagcattcattatgcgctgaaattacgccactatgtctttcagatgaacacacagtagttttgtattgactatgtttaagctggggccagtgaggttaatcagtcataggatcaacactacagattaataaaggagaatctcaaaggcataaaagattttttaaaaagtttgttgctcaggtgtttaaacccagagtgaagcaactaactgttgaataggaaaataacattttgaaaccaacccaatagtcccatagacagttgtttttggctgattatagaaatggacccttctgatcttaaagcttggaatttacatttgttttatctgagtttcttcctcaagaaaggatccccacacctctcaaaaaaaatattaaagaactgaaactcaccagatcatggcatccagagactgaagcgccaggcccctggttcatcatgattgcttacttacccctcccgagttcctgttttctcatacaaagttacatttcttccctgctatataaatccctagttttagttggtcatggagatggacttcagactgagctctcatctcctcggctgcagcacccaactaaagccttcttccttggcaattctcgtcatctcagtcattggctttctgtgcggtgagcagcagaacttagaatgcctggtgttttggtaacaatttccagtccaaggcattagcagattgttgtctgaattatcaacgctggacttataaggttcaatgcatcaccttgcatctggacccggggactgtctcattctgtcccatattgtctctgattgtttatgtgctacttttgtcttcccaacagaattctatatcccagagaacagagggagcaggtgctactgttgagttgaactgaattattttccaggcctggctgaaggaataatgagaccttacgtttctgttcctagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatgggtaacgttgcataaagtgtatgcacataagggataagcatgatggtagccgatgactggctcagaactcccatgtcaatctgagggtgtgattacactggcctcgggtcaccaggctccctaccacttcctactggtgatttgataatggcgatggttattctttatgggctgtagaacacattgacatcttcagatctctttgatgcctacatcaaagagatgtagaaagtctcttagactatgataaattatttaaaactgttaaagcaggcttggaatatctcaaattccccttaagtgggggatgagtttttgtctatcaatccagttgtcagtttcattcactttttcagttttgggaagaatatttgtatataaaacttaatcaagatttatgaaacaacaactctaatgctttttaacttagaaattacttgtttaacccagtagactcagaacacgttaagatatcaaaatcttaattttattaaacttcatcaatacacttttaaagtaagtaaaaagctatcagaatgcgagaggatagaacaaagatccatttaatgtttggtcttctctctctatactttgacaattcctacaatttttttcagctgtaatgaacttagcttactttgactaagaagtgcatcatacacaattcatcttagcacaccaagttgtcaaaaacctggattatggtagtaaatatttagaaatgttaaaaggaggagtaaaataatcaaagcgttaaaaaaattccaatgaaaatttctggggcacaaaataaaagaaaatatatcagtaagaaactgcttttacatgatctgaaatccagaaaatgttttcaaatgtttatatcatctgtgccaaaggagagaatcctgactttctgcttcttactttctataactcagatttttaaacatccacccaaaagattttaaactcagattttaagaaatccacccaaaagattttcaagaactcagattttaagaaatcctcccagaagattttcaagtcacaggtttcaaatgggaatgatacaagcctaaaaactaggtttttgtgtcagttttgtatttttgacctaaaaaaatggatgctttttaagaaagtataaaaatctttgctcgtatcactaaagtaatctttagagacaaatatatgccaagattttttttaaaaggtgctcaggcccatgcttagatatgtccaggtaatttagttgggcagtatctactcagcacttgtgtgttggcttgggaaaagggttcctggggccgggtgtggtggctcatgcctgtaatcccagcactttgggaggccaaggtgagcagttcacctgaggtcaggagttcaagaccagcctggccaacatggcgataccctgtctctactaaaaatacaaaaattagccaggcgtggtggcaggtgcctgtaatcccagctacttgggaggctgaggcaggagaatcacttgaacctgggaagcggaggttgcagtgagcctaattattttattaggtagaagcaggaatgggagaaactgaggaagaccagtttatttggtctacctaattttttttttaaagagtcgtcaattccccaattttaaaaatacgattctattcatgtttccttctcaattaatgaaaggataagtcggagggtgagtatctttttgttaagtagtcttcactgataggcaggttgctgttctatttgtatctcttcaagttgcatatgatttcttgcctaggattttgctgatttcatccttaacagacttttctttgcattctaggattatttagacataagcacatggtggcattcagatgctcatttaaccaactagcacattttttgcacttttaagctttggtgggtttttttgttttcttttttatttttttgccaaggttatttcttaatttacttttattttaagagccaacaggttgttgggacttatattttcccttgcttctattggaatctgcttttccaacactaatttctctaaagaaaatgattctctcaaatttgcctttcatgtttctcaacgccgtattgagagacaccttttgttttcccaaggttgtgactgttttcatggttgtctcccattcactccccaaaatgtgctggaatgtggctttctatgggtgctgtttttccagtagctaattggtttaatttcttccatcactactaagtactgaatactgccaaccttgtggtcacctggtgccaattttcattattccatttggaagcaggccccttaccatagctcttccatctccatttttgcctccatctttactccttattcacaagccagagaacaatggtgcatacatgccatgtcaaaagcacttttcttttcattaatctgttgaaactcatatgaaaatttatagttgttgcagcaatgcaagcttattttatcataaaattctcatggcagtaatgctgtgacataggcattgctattatgtctgtttttcagagatttcccaagacttagtgacttgcacaaggtcacataaccagaaaattatttagccacgattcagattcaatcctgagttccacaggacattacttgctatttcttagttactccggctcacgtggataacccatggacataatgaccaataatgaccttcaagtcatttctttcttattctttttggtctgttaatggcatagtgggatggtttaatagattaacaacagtgctcagcttgtcttgaacttggatttgtcctttcttctccttatgtcactttatgggagatcctacatcatcccttaaaatgacactttgttccgccctcttctacataataatacagtactgaagtatgtatttatatacatttataaattccttcccagatcagtgtaattagaattttctttagtggaccatccaagactttcctaaaaatacaatctctctttgtgaaagagaaaagccatccccattgaatgccctgattaacctagacatgcatcccaggtagaaaagaagacaggggcctggaggcggcctcaaagaggcaggatttatctttccctccaaaagaagagctttttccccaaggaagccagtcccagtgcctgtgattcttttgtcatgatgaagatctgggtctgccctgtgacagtccttcagatacgcagcattacagggcaagaaaaccaaatagaatctgttttaggattttatttcttccttatgtaagtttttctctccaaataaaattaatgaattgctgggatgttttaagaaaagaaaggcgattgtcacggttgctacagtcgtctgatgacaatgagtttgagtacagtggagagtaacaatgattgtattctgtggtggaaatctcctgccatcgtcagtagccagtgatgtcattgaactcagggcttgtttcacattctgactgatgtttctctccttctcccaaccagttagagctgaaacctcaaggccgaatgctaatgaatgcaagatactttctggaaatgagtggcaagtgacatttcttcttcctgtttgggggtgaggagggcatggccttctcctcaaatgcagcttattttacctttgcaattattgtagaagagaatcaggagaaaagagaggcacaaaattgttttaaaattctcagaggtgctcaggcatgactttaaaagacactatctgggccggaaaaacgtagaaatataaaacatttatagcacttgttttaagtgatgtgaatccatatgcccaaagctcttatactctgtctttagtttagtttgggaattcagtctaaatacaaaagactgttgatgtgtggttatgtgtgtacacattgtctatggttaaatgatgtgctctaagaagctaccatattatcagtagaatacaaaataagtaagaagtcaatcaatatattccataaaattagtaacaaaatgctaacacttgaagttagtcacctcaagtccttttaggaacaagaaaaggtgagaaaacacattgctaaagggttttgattccatgttacatgtggactttggccacagaagtgaaatttcccggtacgatgtgctgagacaggctgtcagggctgtgtatgtgaatcaaatccccctacttagaaaatcctaagtcacagcatggacatgtaaacttactgatggtaaattcacttcattttttcctaaattaattttactaccaagaagaagcaagtttaactttatacatttatggtgctttctgagtttcggcttaccatatataattcctccgtgtctaaattcaaacaaatacatcagagaaaacaatattatgaaataatcatagaaaacttgaacactcactagatatttgatgatattgaggcatggtgaattcatcttttaggtgtgataataatattgcggttatgtttctttaaaaggcacactgatcttttacatatatatgctgaaatattttagtaaaaggcgaaagatttattcgatctgaagaaaaaccagtgaatagctgaaatattttagataaaataatatgataccatagttttgcttcaaaataatccaatggtatggggtgtaggatggacagggtgtattgaaagagagtggccatcagttaataattgctgaaactgaatgattgatatatgaaaattgattatagtatttgctcaacttttaggtatatttgaaattttccataataaaatttttttaaaagaaagaaagaattactgagatgggaaaaatgtactctgaaattttatttatttttcctcttggaaggtgtagatatacagtacacatagtacaacttttgagttggctgaaatagagtgattgcaggatatccgaataaccagatttgcataaaatgtgaaagtgctgacctaaataatagtatcaatgatgtttaattccttgaataagagaaatacattcctcccattagtttaaatcatgacccaatgtaaattgaaaaagggtcttgtctgggcatggtggctcatgcctgtaattccagtactttgggaggccgaggtgggcagatcacttgagctcaggagttccagaccaggctaggcaacatggcaaaacccattctctaccaaaaatacaaaaattagccagagttggtggtgcgtgcctgtagtcccagctacttgtgaggctgaggtgggaggatcgcttaagcccaggttattgaggttgcagtgagcagtgatttcaccagtgcactgcagtgtggatgatacagtgaaagaaagaaaggaaagaaaggaaaggaaaggaaggaagggagggaaggaaggaaggaagggagagagagagagggtgagagagaggaaggaaggaaggaaggggaagggaaggagaaagaaagaaagaagaaaagaaagaaaaagaaagaaaaggaaggaaggaaggaggagggagggagggaaggaaggaaggaaggagaaaaagggtccttcaaaagaaagaaagaaggaaggaagaaaggaaggaaggaaagaaagaaagaaaggagaaaaagtgtccttcatcagaatgcaagtatttttggtaaatgattttaagatccctgctttgaaaaacaattccatggatggtccttctattcctgtggaacttaaatattttattagaatgagagagcaaattcaatcgggcaaaaacaatgatattccgtaaacaataatgacataagcctaggaaatgttttaagaataaagctttggccgggcacggtggctcacgcctgtaatcccagcactttgggaggccgaggcaggtggatccgaggtcaggagaccgagaccatcctggctaacatggtggaaccccgtctctactaaaaatacaaaaaattagccgggtatggcagtgtgtgcctgtagtcccagctactcgggaggctgaggcaggagaatggcatgaacccgggaggcggagcttgcagtgagccaagattgcaccactgcactccagcctgggagacagagtgagacaccatctcaaaaaaaaaaaaagaataaatctttgtaatatttaaaactttttatatctagatccaaattgacactccatctctaaatttttatatgtcaaaaaaatctaattttaaaaaccaaagttatggaataacctaactagaaaattccttgttgatgacaaggaggagagcattcttttaagaaagctcattattagtataagaaatcgtcttctgaaggattcagaaaagcaaaacgtgttcttctcctcagggaacatatacccagaggtggtacagattagacaattagataaaattataacctaaaccacacaaatactgattaaccaagagatcagtgtgtgttgctttcatttcagtaagttccacagtgtgggcattaaaggttagcaagagttgagttttctaaagaagagggatggccttacaaggaggaaaaagtgaaggcttgagcaagaatatgccttgtgtgagggctgtggggagaacagcctaggtagaccagcaggctcctgctgaaaccagaatgaagagtcagagacagatgttggagggcaagaggagtgcatagtcttgggtcatgctttgaactaatgggaagaatatactttctcttactcaaggaattacacagtattggtctacaaaatttcacttatgttatggagaggtgataaaaatctgttctaagggtgtagctacaggaataaaataaaaggaacagtctaaaagaaaatactgttgcagagagatttcatggtagagtagatgaaatatctacagaatgcctgttaagtgtacatagttgaaatgctttataattctttaaaaattaggctgggagcaatggctaatgcctataatcccagcactttgggggccaaggcaggaggatcacttgaatccaggagtttgagaccagcctgggcaatgtagagtgaccccatctctacaagaaaatttaaaaattacctgggtatggtggcacatgcctgtagtcccacctacttgagaggctgaggcaggaggatcacttgagcccatgacttcaaagataaagtgagccaagatagtgccactgcactctagcctgggcaacagaacaagaccctgtctccaaataataataataataattaatccttaaaaatgtaagttgaatgaagggaaaaaatgttgagaatatctcttaaaatagctagactgggaaaatggtagtcacagaagtgggagatatggaaagaggaggaaaatgattgggggataaggaattcaaatttggataacacttgagataataccatgtctcccatgtttctcttccatggaagcctcacctcctctacctcaccaggaagtaaatggctcagctctccataacagactactttgttctttctctttgaaatccccttctgttgggtttttgagcaggaatcattttttctcttcttcctctgttctcctattattactcttgtaacttcagaattccccaatgtcatctcatgcccccctgccaactttctatttcacaccttcctgtgcttctctatccattcagtaaccaaccttcaacccacatatcatcactcagaattctccacctccagggactcacactcagaacttgctttttcagagctcatcttcctcccctggcaattctgcccttattctcagacaataagtactagcctttagtccagtttctcttttaccctatttattagcccactttctggcattaactctacctagcctggctcccatgataagcctttgtcagcactctgctctcattagttcccctttgccatggatagtctgatctccaaaccttgcattctcccctctcattctccccggctttgctagaaaaagtcatacagctaagtgtgttacaaacagatggtattagatgacattcctatggttcagactctatgtttggcttcttagcagacctctctgaccagatttcctgtacttacacattttaaggggtcaaattaaactaagtatccaaaattacatttgccacattcacgagtaacctatttcttttgtaacttactatcgtacttaattatataataactcactccacaaaacctggaagtaatttttatagcctccttttctttcaacttccacatgaatgcatcagtcaatcatttgtgttcgtgttgtctagtcaatattttttccatttcatcatctaattacatcattactacctcctgccatatcccatccattctcctatggtggtcctagaagtaacgatgccaagctcaaatctgaccatatcaagcctctgcccctactgcagtgttccagcatctgcaaattgtctgcaggaaagtgttcaaactgatctgacacctacacatcttctggaagtgactgctgatcgtttctgcttcaccctctgcactctggcaatgcccagctagtgctggacccccacccacaccctgaggaaccttagctctgtagctttgcttgttcccttccacccagagagagcacctttggcttttccccaccataccttctcccacacattagtaggagttacctgtccagaattcagcacagaaacatttctgccaggacgtttcttttccaacttccctctttctctccttcacctacctccacctgccttagctggtatagtttcctcatttccgtggtcccacagcatcctgtgaatacctctgttctgacacatcgattttctttccctctggactcttaactccttgcagaacagccactgtcaaaacacgtctcattaattcctttaactgtggtgccaagtttctggtgaggcatgcaggaagtacacaatgaatgcctgctgaactgttcagctggactcaccttggcacttagaaatctccttcatttctttttgattcccacacaatggctattcctaccattcccatcctccttggtttctggggatgcctcaatctcctctgattctgggaggttgaccttgcctccaatataagtggtagagaccccatcttctttttatttaatttttttatgtattttttttttcttgagacagagtttcgctcatgtcgcccaggctggagtgcaatggtgctatgttggctcgccgcaacctccgcctcccgagttcaagcgattctcctgcctcagcctcctgagtatctgggattacaagcatgttccaccatgcccagctaattttgtattttttttagtagagacggggtttcaccatattggtcaggctggtctcaaactcccgacttcaggtgatctgcctgcctcggcctcccaaagtgctgggattacagttgtaagctaccacgcccagccgagaccctgtcttctgtttgtctctacactttaggatgcagttgcttcctcccgccttctcctcctgctcctctgcctcagagacagctgctccctttcttggttgcacacctctcatcccagcagtcctgctctatcaataaactttacctctgacatcctcaactcttccttctctctgcagtttcttccttattcccaagacatactgcattatgcatcttccccaatcttgaacaccatctcttcttttttttcacctttttacctccttgagtttttttttctttccctaacacattcctttaaaaagtagtttatatttatcagtttctttttcttcccttctacttctattcttagaccctaagactctgggtctccaagattatgagttctcacaagtggttcctgcttcttagccttcaatttccttgatatctctctatcatacaatgctgaaaacttcatttcttttcagcttgcctgatgtgatattgtccaggttttcctcttaatttttcagctgcctcttcttggtctcttttgccatttcttttcctacctcctaaaaaatatgggtacacatatctcggagcctattccacaccatcatatattgcctcttaaggttggctgttctgtgcctgtgccacgtctccctgacttgactgttagccatgcaagggtgaggaataatgtgtttcttcagcacactcagcaaggcagtttactcacagctgctcaggaaacttgtaatttgattgactacaaacaagtgataggttagaccacataaatagattagaatccattagtataaaagaaaaaaaactgcaaaaaccaatgagctcattcaaaccagtaaatagagaaataaatatagtcaatacaaaaaaaattaaagaattctatgtttttacatttattcttttgtaatgattgaaatagagaataatgaaaatcacagaaaataacagggtattaattcatttctagaaattcctgatattttaaaaaaattatagtactatagtctaatgtagaaattgtgtatataactatatatttatagtttataaaaatataaactatatgtagacatatatgtatataaacatatatgtatagatatatgtacaaaatatgtttaatatacatataaacatatatgatttttacagtaaaaacctgtatagggtccccataataattcactttcattccctgcatttaaaagtgtatttatacttatttttattttattttatttcatctggaccaaaatagaaacaagtcacatgttataaacaaatgacctactatactagtcacaagttgtaaatagatttggacatttagaccagaacttgtggaagaaggtgattaactcagtgatccttaatttaacccctcatttaccaagccaaatctattatttccagcctagttccaggtaaaaagaccaaaattacctactcttaaagtattaggcaaagtattatgtcccatctgtggaactgttagagggttactggaaatgctttttgtctggaagttggggttgccataaaacaaatctgcggacactacagaaaagacttcagtcctacaatgtgtcctgggatgtggctggattcctgggggaggtttctacccacacagctcctcctttgtctacctagagtgtttctaatctagccactgttagggattggacaataaggtatcttggaagataatttgccccaaacgcattgtcaggctactgccactgcttagccacaatagaagaaatttagtttgaatattattaactcattgtgaaatatgatgaacctgctttttaaatgaaacctcaatgttttgtatttgtaacaaaatagaagaagtaatccaagagtcttcaagctattacaaaattataactctgggatttaaattcattatccttatttatttattcacatatttatttgtgtatcatttttgttacagcagtggatatttttatttctttactgttccttgtgttattctctctcacctgctgtgtccactgtgctgtttaaccatgactgccttacaatttggtgtttcatgaggacctgggcttcagcaagggcatcctgagcattctcataatttgactatcttagtttttcaaccctttggaaagatgtcattcaggtatagggcactgtaaacagtgactatccaaagcactttcaccaatatttatgagcccagagtaaaatgaatagattgaatctgatggtttgatgctgatgactaggtaatgcacaggattacctagacaccaaaaaaatgcagtgagctattaattttctggcctttttcacattggtaaatatggttggcagctggtgtgtctgatcactgtggacatcaggaaccaggacacaatgtcccaaagttcctttctcctcacacaaaatcctggtcagctccccctagtctactccagcatgtctccaacaacctgctataaagcatcctggcacctctgaaatgctgttcccaagaggctgtcagtaaccatgtgattctctagaattacagacaggaaagcctttgccacttcctgccttttctgactgagtcatcattgatggtgacaaagagaggttgatagatcccttcaaagttctaatctctggttttgaaacttgaagaggatatatcgctcagcccagtcaaagaggagcgaaggattgagccagcaatccaacattgttttcaccctctaacaatatgccctatgatgaatctgtgttgtagaatttgaggaaagatgcttagtgtggtacccaccataatgagtacctggaatgttacagcaggtactcagagctggtcctcctccatcccttgcccatctccctcccctcctgacccagcttagaataggagtcgtccttttgcagaacttcactttcttcccctctctcttcctgtagacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggtacagtaacttggcatctccctccaagcttcgggttatgcattttgttgcgtcttcttaatcctctacgctggcatgctccactgtggggggtgtgctggagtaaatgctacctcagcgttgtcagggaccttgcctgaactgagaaggttcaaatggtgtgatccaataaaagaggtgcatgaggaagccaggtctagtcaggaaaaatgcccatgggattttagtttctgcctcaatgggggggctattgggggtaagtgggaaggaacagaagtgaaaggtatctttattacaaacagttttccagttttatagtcaaaacttcccccacctaatggcccaaccctgctggtgctactttttccagcaggcagcactctgccattgtagctaatggtttaaatgcttatgaggctcttgggtatcttaatagccatcaaacagatcagtttaaacctcagtaaccacatagcaaaggctatgacagagtggagacttgaaataactcctgtttctggctctcagcatcctagcctattaagggatactcttccctttaggctactgcagaaactgttaaagcacagctcctgtgtaaccagggtatccacatgccagatcgacttggcgggttttcatcagcctgctttcgtctaatcacttgaacctcctttctctctaatcatggatgtcactcaggaatcggtcctgcatgtgagactttgttggttgcaaatattctcagatgctcagaaagaggaaataaaatgttacagatgtctttgttcgtctgtagtgagctcagcgaggccatgaatttttaaatctagcacagggaaacgtgctacgaagagtctgtgatgcatgcattttcattcatgcattttaatctctatatgtttggaaaatacaaggatgataaatcagccagttctcatttatttaattatcaaactttttaaaacgcagcttcaaatgaaaaacactctgttaatactcttggcaaatgatacaacagggctgctgatcagaaactgctctgtgatcttagggggttatgagatctcatccatctcttaaatgctgttggtgctgatgttgatgccaacattgaaataaatcagcgtgtgctttattacaggggcctgaacaaacagggctaccagtgccgacgtaagtaagagggttttggttgcattaccatcattctttttatttagttattccttaggctatgaaaatcttaagctgtgatttttttcttcttttcagaatgcaatgcagcaattcacaagaagtgtattgataaagttatagcaaagtgcacaggatcagctatcaatagccgagaaaccatggtgagtatttacactcctctttgacgtgcagtgatttttatcagaacgttaaatgttacagcccacgaattcttcagaataatgccagaacttgcatcctcccatttatcagtgaacatccatctccccaaaactctttcctcttcaataatgattcttactgaattacccaaaccagaggatgaattagaaattagccaggcctggtggcataagcctgtaatcccagctactcaggaggttgaggcaggagaatctcttgaattcgggaggcggaggttgcagtgaaccaggaccatgccaccgcactccagtctgggcaacagagtgagactccatctcaaaaagaaaagaaaaaaaaaaaagaaatctgcacttgtacctcctaaatatacacaaattatatacaggaagaattttcattgctctacttttccagaaaaatggcatagaaagtggccagaaagcatagtttagattaattatatgagaataatccttgtggcacccccagctagaagtgacagtaaaagagtaaataaaggcaaatgatgataagatacagcaacatggcatttacaaggttagagataataacagaggcataattttatgttgagaagcaaatatttcttttagagtaaacgttgaggtataatcggaagacaaattacattttacctaatggaggggggaaactgggctagcacatgggcagtgtatcattatgaattttaaatttttaaaaatttatatgtatttaggaggtacaagtgcagatttcttttttcaattttttttttttttttgagatggaatcttactctgtttacccaggctggagtgcagtggtgtcatcttggttcactgcaacttccaccttccaggatcaagagattctcctgcctcagcctcctgagtagctgggattacgggcatatgccaccacgcctggctaattttcgtatttttagtagagatgcggtttcaccatgttggccaggctggtctcaaactcctgacctcaggtgattcacctgtcttggccttccaaagtgctgggattataggcatgagccaccacacctggcctacaagtacagatttcttctatgcctatattacctggtggggaagtctgggcttctagtgaacccaccatccgaagagtgaatattacacccaataggtaattttcaatcctccctccctcccatcctgccatctgtagtctccaatgtctattactccactctgtcactcattatgaaatcttttgacttccttctcccaccgtttcctttttcattccacaaatcctcactgggtatctgattcatggaagataccgcattcttccaatgacagcataacacaaaacagacgtggtcctgcgaagttggagaaacagataataaacagctatgtatggcttcgatttatattaagtgctacaaagatagtgaacaaggtgcaaggtggagagtaagcatgtggcctactgagactctgtggtccgggaatctccccaacggagggaacattgaaactgacagctgaagagtgacagagctggttaggtgaagagcaggaggaaggaagctccttacaggctggaagaccctgctgagggagagtccaacgtgttccaggaactgaaatgggaccagtgtggtgacagctgcaagggctgcgcagactggaagcccacactggggaaggcaccaaggcctgggtcatgcggggtttctttggagcctggaaaaatgattgtattttgtgcaacttgtagtagaaagcccactttgggatgctgtagtagaaatagtgcgttgagatgtgaaagtgaaaccagaggagatggaaggaatcctccaagcggggaggttggtggtttataccagtgagacgtcagcagaggtggagcaaaggggcaggttctcaggtgattttgatgttagaaatgactggatttgccaaaagattagatgaaagaggtggatataaggatgatgccgcaggttctggcttctgcccgaggccgagcagtgtggtagataacagagccacgacggagtgaagaagactggaaggagagatgaatttttccagtttggacatgttgagtcggagaggtggacatccaagttgaagcatcaaatagacaatttcacatgagcttggaattcctctgggacaagggcccaaccctataaatttgacagtgaccatcatataggtagattttaaagttgctgaagagattgcctagtgaggaaatagagaaagttcaggactgactacaaaggaatctaaaatgagatgttaggtagaagataaaggacagagatagacattgagaaactgggctcagagaccgctcctcctacacccagagtctatgaagttacagaaaccagaagaagaagaggtgggttgtgttctgtgcagttgaggtgttgaaattgaggcccacgtgcagatcttcacaggcttaaatcagagaaatgtcaggggcatcttggaggcattagtctgattgacctgcatgaagggtgactgaggtgatgacatgaaaacaacctgtaagttgatattatgaagaaggtgaaccatgaaggagatgatggacagagaacagtggctgggaaatgagaccccaaggatggcaagtgctcccgtggccagggagagatggataaagctggagagacagataaacaaaacagtcaagtctgttggcaggaagcgaagagggcctgagctctggtggagactggtccctggagcttccacagtttaaccggaagggagtagggcaagacagttgctgatggggataggtgtggagctttggtgatgggcacacaaaggcgcttcccttagactgcatgtgtcccccatggagtttgatggctggaggaaggaaaagagaaagcaacaagtgccttcgaggaaaaaggaagatctatgagataattatcttagagaaagcaaggtgactcgtgaaaagcagtcagactgtggagcagagctgaaagtccatttgaatttgacggagtcagcctgctcaggagtatgattttctccaacaaaggggcaggttcagagaaggcgaagtggctgggtttttccagagtagaatttctcctaacatttagaaccagaaggagataaacttgtgctaaccggtgattctgctaagactcaaagaggttaaagtagtttgttcatgtttgatcacctgtacgtggcagagctggtactaaaattaagatcacaatctctcagaccatgtttttgcttgcttagatcaaattttcacctcccagacttcttcctttacttgatgccttcagcttttctagaaaaaaacgcaaatctctgaatcactgttaacctcaatgactaacaaagttcctggtacaaagtcttgagaaactgtcagctacataaataaatgtctgtgatattatcttctcccaggatattttgatttcttgttcactcaaggggacatcatctttgggattcttttgttcctctacccctggagcagtattgtccgatagaaataaatagaatgagggctacatgtgtaattttacatttccaagtagcccacattaaataaaggaaaaagcaatgggtgaaattaattttaataatacattttatttaatccaatctgttcaaatatcatttcaacaaaaaatcgacatttgaaaaattcagatatcttaagtaattttatacaaaagtcttcaaactccaggatgtattattttacacgtccagcacatctcaactctaactcaccacctttcaagtgttcgccagccccatgtagctcattggttttcatactggaaagcgtgtacatagcgtcttcatcagccatggtgtcttgagctgtttgcccctgcattcaagattcgaagtggtccccttccagcctggaccttgacctattaattgtccatatttaaactgtggaatataagtgagtcccgaaaattatttttttcttggttgaaaatggctgtagtaagtgctgagcaatttttaatcgattctacacaggctttctaaagaaccaacgctgaccagtacccctggcgggaacgttagatctattgctgtgctgatgaataaggcatctttgctatgcaccttcccaaaggaactgttgaattagaaacttctgcagagattataaacctttagaaaataaagcattttatcctgcacaagaatattgacattcttaccaggaatccaactatccaagtgttttgttgttcctgcaataagtttgatttaaactctggaaaactgttttttaaaaaaattccatgtcgatcactagcatccctctcccactcccctctccctaccccgataagccttcacatttattttgagacagaaaagagaatggctgggctctgattctgactgccaagcttatagatatcccagctctagagctgcgtgtcctgggcaagtttcttaccttctctgtgcttcatttcctcgtctgtcaaaggaggatactaatagaagcgacttcaaaaggggtattctgaggattacgtgagatatcacctatgtaatagatgatgcgtgtgacatatttgttaaccgcacctggcaggaactgctccctcctcttgccacctcagttcatgaataataggtgtgaaaatgcttctcacattaggcagtaatactgataaacccatagaaatgtttcctttaaagaaggcattttttttttttttttttacatcttccaaaggttaaaagcactagttctggactgaaagagaaaaggaaatatttatagtaaaacaggaagggaatcttcatctatttaaatgggagcactgtttccttagcactttttaaaataaccctcatgcagtcttcctgagcttttagcctgtctgtgtgaatgcctcagatttcagctgtctgcaaggttcttgctacatgcagaaggcaagcatgccccgtcacgtacagttgctgaggctgcctgccttcttcaggcatgactgtagggcttgacaagtgacaatgatggtttaaaatgcacacaatgccagtgttttcattatgatctctgttagttatgctaaggtatctgcaagaacatccaaagtcggggccccaggaatacacagatttcaccttctgcctttctttcagttccacaaggagagattcaaaattgacatgccacacagatttaaagtctacaattacaagagcccgaccttctgtgaacactgtgggaccctgctgtggggactggcacggcaaggactcaagtgtgatggtgagtccagtgggggatgagcatggcccgacgtggaccccctaggggatggagcaaggctttctggggaactggagggaggatgtagggggtaccacttccacacccagcccagacaagtcatgatcataagtatggtcttctggggcaataagccactatgttcctttccttgcaccctgcaacacccccacccacacatcccagaaaagagcacaacagttcaggttcaaggtcaaactcctagctccatcaccttctgccgtaccatagccctgggggaaatgaagacagtgtttctcctctcactggtctttctactactagtttcctcagtgggctctgggctgccccttcctaatcccaacaggtctagctgtgtggtaccctaacccttctcctttgcaccagccagtaagattctttctgtcatctcatcaaggagcaagcccagcacattcatttggctgacacatggtcctgcacagaaattctgtaacattagcttgagcatccatccctaaaccattgctgtgaactccaagtgcccagtaagaggctggcccagttgtgaccgtcattgcctgttttctggtctttcctccaaggccaggatcgcagcagagcctaacctgccattcattattgatggagtttctcagacctaccatcaaaaaaggaaacaaggcaaggctttcttgctgtacaactccaagttgctaaggcgataacgtttagaagctgagatgctgttacactaggattaaggactagggaagaaaaaaaaaaaccctcaagaactgacaaggcactctgctttctggttggggagagacgtgggcagagcccagagaatagagccacaaaaggagaaccacctgttgcatacagacagcttctgatttttttcttcttcttttactttttttctgagacagggtctcactttgttgcccagactggagactggtgtgcagtggctcgatcacagctcactgcagacttgacttcttggactcaagcaatcctcccacctcagcctctcaagtagctgggaccatgggcatgtgctaccatgcctgtttttgttttttttgtttttctttgtttttttttttttttagagatatggtcttgctatgttgcccaggctggtctcaaactcctgggttcaagcgatcttgtctcctcagcctccaaaagtgctaggattacaggagtgagtcaccatgcctggtgagcacagaccttttcttatgatgaagtattaaatatataagccactttattttttcttggcagccctattttgatcagtgctactgactaatgtatgtcctctcttttgagcaatgaggtacgtgatggaaggcggcacagcatcttccgcattctccccttcttcatcccaatcctgttcacatgtctggtggaacccagagcgacctctcagtggaggcaggaggggttaggttttcaaatcattacctaaagcagacatcacaggaggccaacattagcctcaagaatccgttcctggccccaaaggacactgacacgcttttctctacacccctgttcaagaagacatggataggcagggtattaagagttcattaggaggtcagagacaaaacgtagtgtcccggcatcctgcatcctgacggtatccacagaaacaggagaaattctcgcctcttggttctcctgtgatggtctcaggtcgggttctctgtcctgggagcccgagaatccacttgcaagaagagctggtcccagcagcgccgcggcacagcttagaacttcccaggggttcctgggcgttatttcatggctcttctgcctgcttcgtttcatttctttcctcgaatactctttcctttccgctccattctgttccccgctctctcctaccacctacatttcaagtgctcccctcccctttttcttttgtcccctctcctctccctcccctgccctggtttgttttccattcttgcttctgacactcccgggtccctgcccctccactgtgctcaccccgcctgctccgctcaccccgcatgcccccgcgtcctcctttctcgactcttctcgccctcttctccagctctcttccctccctctctgcctccctttcatcctgcctccttgcaggccgtcgtcttaagtagggcctccttagccttttaccctgccttctctttctccccacaataattcccaagaaaatagtcatccaaagggactctttgccctccaagaaactgagttacggcctgataggttagtaacaaagacttaggaccttctcgtggagatggtggtggcctttcttcgcggccatgcaagtcacagagaagcctagatgtggctacagttttaaggagcaaagtaaaactccatccctctatgttcaatcctagctgacaacctcacttggtgtcacggtgatgcataagaaaatggagctggggctaccgaagttgaaacctgacaccttctaaatagggcgaatgtgagttatgcgagttttgccgacaatgtggaatttggagcacaatcatgaaaaaaaaaaatcctttctatagtaaagattttaggccgggcacggtaacagacctgtaatcccagcactttgggagggcaatgcggaaggatggcttgagcccaggagtttgagaccagcctgggcaacaaagtgagacccccatctctacgaaaaataaaaaaattagtcgggtgtagtggtgtgcacgcctgtggtctcagctacacaagaggctgaggcaagaggatggcttgaacccaggggtttgaggctgcagtgagctatgattgcaccactgcactccagcctgggcaacagagcaagaccctgtctcaagaacaacaacacaacaacaaagattttaaatatgcagaaaagattttgcttcaggtgaatttttctggctatatctatgcctatatactcggtctagtaatggttaatagttgaccgggcgcggtggctcacacctgtaatctcagcactttaggagaccgaggtgggcagatcacttgaggtcagaagttggagaccagcctggccaacatggcgaaaccctgtctctactaaaaacaaaaattagctgggcgtggtgatgggcgcctgtaatcccagctactcaggaggctgaggcaggagaatctcttgaatccgggaggccgaggttgcagtgagccaaaatcgtgccactgcactccagcctgggtgacacagcgagactccatgtcaaaaaaaaaaaaaaaagtaatagttatttacatagaaaattctgctttattttattattgagctatttgaagaagagtggaccagtgaaaactacaggtgagggttgcccaaatttcacctaaatattttaatatctacatctatgcaataaatgatgaagatgaaaaggaagttgtatttgttgagcgcctgctcgatgccagtcattgtgctaagcttctttgcacacacatgtgcaaatcagcagataagattaagactgcatgatgtcatagcacctggtgcctgcttctattacaacactctctactcgcagactctgtcagctggagtttggaaatctttatatctgatttttctgtattttaatggtgatgtttctttttttttttttttttgagacacagtctcgctctgtctcccaggctggagtacagtggcacgatctcagctcactgcaacctccgcctcccaagttgaagtgattcttctgcctcagcctcctgagtagctgggattacagatgtgcaccaccacacctggctaatttttattgttattatttttagtagagatgaggtttcaccatgttggccaggctgctctcaaactcctgacctcaggtgatctgcccgcctcggcctcccaaagtgctgggattacaggtgtgagccaccacgcctggcctttaatggtgatgtttcattagcaaaatttgaatttctaaaactaataattgtctttacacagtcacatgggcacacgctctccagtccaagagggatctcttggtcactggcaatggaagttagattctatgctactgttttcaagattcatgaatcagaatactcaccctgaattgtaggatccccaagctagaatcctgtatagatcatgagtccagtgctggagatccttaatcgggagcccccagagcgttcatgacttgcccaaggtcacacagtgtccacgctgtgcaagctgccaccagcaccccgttctccacccacctgacaggtgctcgagtatttccctctcctctttctttttctttaacatcttatgtgacttataaagatgacagaaaactttggttctttttcttcgagttacctttcataacaggttgtagatgtcaatttacgccatcagttcatgcgtgcaagaaatatcactttctttatgactgtgagatccacttagttaacattctcatctagtaatccttggggccctctacccttcccataatcacacgaggttttcaggaggcatgggtacaggggcctggaaactggggaatgtgctcaaacacccggttgctgttggcctcctcatctaagcccacactggtgaagcctgtggctttatgtttccacaccgtgtgtagagtttgtgatttttttttcaaagctgaggtcctcatgcctggtccagtcttgctaggtgtgttctgccgtgacctctcctggcattgctagcctcctcctactccatcccttcccacatatacactccggctccaccgtctgatatccatctgcaggctgaggctgcctcctgggcttcaacctaaaggctgggggaagctcttcatggcccaggtgggaaaggggatgttttggacccagactggagtgggcaggaatattcttctgatgcagggcaggtgagccccaaagtggggcttagcccaggagagttcttggcttcgcccaggaagaattcaagggtcggctgttggtagaagaaaacagcttcattggccaacggtattacagttctgttggtgttacagctccatgactgctcctgcagagcagggctaccccagaggcagagagtagcagctcagggcagtgctgcaatcctatttataccacttttaactacatgcaaattaagttcctggaaaaagggtggtaacgtctgggtgttgccatggcaacactaaactgacatggcacgcaggtgggcatcttctggaaagctgcttctgccctgtccctgttttagctagtcttcaatttggtctggcgtctgaaccccacctccagagttgagtcccacctcctacctcacttcccttccagcacgaggatcactaccagggagagccagggtcaacttcctcccagccgtggcactttaggctttcctccctatccgcaaggctctgtcttacctccagagagagttgtttagcaccagggggttcttccactcttgctcactatctgccttcttccttccagcatgtggcatgaatgtgcatcatagatgccagacaaaggtggccaacctttgtggcataaaccagaagctaatggctgaagcgctggccatgattgagagcactcaacaggtaggagcatgtgccgtggacacgttcccgccatggccgctcagcaaggatgtccatgcacttctgctgcttcacctgtggcagccctatgggaaatgccgggatgtatttctgagcaccggccttgcccttggctttcatatccatgcccacaccccctatctttgagatatttatttaatgcatttgtattatgcagatctttataaaatcttaaattcttcatggcatgagcattgcagaaacaaataaattcattaaagttattgaagattcattgacagctttatgtgaatatattcgggttatagaatagcctgggggaaaacacttatgtgctagcatcatcctcatggaacaccgagtccagggcaaatttggcctgctgtttactgttttggcattagctgaattcctagatccaaggataaaccctctttaagacttggcattgcctgtatcagctgttttcccatccattaactacctgtccttatttgtgatggaatgatgtagacagcatgagagaatcctgtcagccccagaaaagtgtgaaggaggcaaacgtgttcggctaatgcataaaatacagtagatagactctcccagaatatggggttccaaaagaacgttgaggataaggagatctttgttgaccctatgcatttaaacattttaaatggcctttgtccccatcgttagcaggctgagctgttccatcaatggtgggtgggtgggtggtctgactctctgtttgtcatccaggctcgctgcttaagagatactgaacagatcttcagagaaggtccggttgaaattggtctcccatgctccatcaaaaatgaagcaaggccgccatgtttaccgacaccgggaaaaagaggtagctgtcctgatcagcagtctaatcactgtcagtcattaatctcaattaaccctaacctaatgcccttggatttaagttatcagcttacctggtctgataggtgatccacctccagctaccaactaagaggctcccacttcttagaaaagaaactaaaaccttttacctttgtaaaaggcaggaggtgggggttagaaaatgggataggtctggagggaacaaccacaaatgttttcttagagtttcagcatgttacattctgtcagtgtcaaatggtttcacagaaataaatctgtcttaaaatttgatggtgggaaggccacagaagacattcttactctgcacctttgagacttaaatttaagggtaggaaagagaaggactcaaagccactttcatgacattatggcagtttttccagcctactgtttgaaagcagttcatgagtggatatgacccatgtttctgagacctgagtcgtttcagcatacattctaaaatacttagtgtccttggaagagtatgaaagataaacctagggatttaaaaatatagagactattgtaggcagggggaaattcctaaaaatttctcttatgttttctctgacttcaaatcaacttaaaaatgtaaatgaaaggtttgggttacatttaggaggggttgccaggcagtcaaggagactatgtcttagcaatgatcaacataggcagcatcttttttttttcttttttgaagacagagtcttgctctgtggcccaggctacaatgcagtggcacaatctcagctcactgtaacctctgccctgtgggttcaagggattctcctgcctcagcttcccgagtacctgggactacttgcgcacacaaccgcacccagctaattctttgtattttagtagagatggggcttcaccatgtcgcccaggctggcctcaaatgcctgagctcaggcaatccgcccacctcggcctcccgaagttgtcagattacatgtgtgagccaccatacccggccaacgtaggcagcatcttgacttgaattctgggatgaatgatgcagttcagatctttaaaaatctgctagatttcatttcctgtctctctcacgctgtaaattgtagaaattgatgccactgtgtttgtgagccatgcaaacaattgaaaatcatttttttcctaaaatttggttaaaatccctagatgtccttgatgtggcattattaacagtgcttgtgtattttgcatatatggtcttttactgattggaatttgtttcttaagttgaactatttcccagtctattgaagaaagagacatagtccacactccaaaatccaaatgccaggctcacagacagggggtgctgccctcacagacagatggaaaggtattaaagctgcctgaactgtaggaaaccctctaaacacccccaattactatgatggagcctcagcatgggaagtagaagagaaagcatgtgctctcagtaactagaatgacctccattactccatgttcatttttaaccaccagcttgcattttcagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtaagctaatgcacgggagaatgctatggcccaactccaggaactgatgagccaagttcctggtcaaagaaattaaactcatagggccactaggattgcatgtgagtgtcagagacagctttcctgagggagcgctgaataaatagggaccccgagggctctaggcccatagtagcctcagctttctggaaacctgtgtctccaaagctactttgcttggagagtgtacatctcacacgcctatgagtttgatgtctttgggcaccaaagaaataggaaggtgcctcagccacttcctgtttcacacggtgtttgtgtttgtttcattttgttttctcttcttttgcttcattctcaagcctggagtgttgttttagtttgcatgtgatttttttctctctctattaaatatcttccagcttgtataagtttccttggggtgtgatagggctcggctctgtgtccccacccaaatctcacgttgaattgtaataatccccaggtgtcatgggagggacccagtggaaggtgattgaatcatggggatgggtttttctgtgctgttcccatgatagtgagtaagtctcatgagatctgatgattttataaagaggagtttccctacacatgccctctcacctgccaccacgtaagacgtccctttgctcttcctttgtcttccaccatgattgcgaggcctccccagctgtgtggaaccgagtccattaaacctctttcctttataaattatccagtctcgggcatgtctttattagcagtgtgataacagactaatacaggctgctataacaaaatctcacatactggctggcttaaacagcagaaattcatgttctcgcaggtctggaggatggaagttcaccatcaaggtgttgtctgggttgtttcttcccaggcccctctccatgctttgcaatggtcgccctctctccatgccttcatatcatcttcctcctgtgcatgtctgcatccaagtgttctccttttttgagatgacgtctcactgtgttgcccaggctggtcttgacctcccgaacccaagtgatcctcctgtctcagctccctagtagctgggattacagttgtgccaccacactctgcttaaattttctcttcttgtgaaaacaccagtcatattggattaggacctgccttaataacctcatctaaccttaattacctctttgaaggtcctgtctccaaatacagtcactttccaaggtcctggggattggaacttcagtatagacacaattcagcccataagaaaactgtagcttgagagtcctggaaaaaaattgtggagaaagtccctcctctaaattcttcctgccatacatgcaggtggggggttgtctccatcactcacagatgacaaggagaggaaggaaagagggagaggaggagcaaaaaaaaaaaaaaggggaggtgagaagaaggaagaagagataatttaagaaattataaccaactaccggtgactgcagaaaattttcaagctggtgatttaaggagggatgatatggaatataggcttttaggtaatttttgatattaagggtatctcatgtattaacggggctcctatttgttttacattcttggatgggactcccaggaaaattttaatcagagatgactgttctatgaatctgtgcagccaaaggcagcattatacaccacaactgctcaccagactttggcaggatgtcttacccagtttatttaatattaaacaaactaaaatgcaactgagcggtcaccacagctgaataatattgagctccatttggggtttggatttaaacactgatgccttgcctttcagcagaatcgactctgtccagcacatggtagctgatattcaggaattctttttgttcagttccacaataatatgaaccacagtaggctcatttggtgctaatctgagcataataggcaatgttacagccagtcttcattgtaatttagcagcaattaatgtgcaattataacctgttaccaaaaattgaaagcacattatatagatggaaattgtctttttggcttcttagtttatggctggttttagggtgttttactgaaagaagcaattactaaaagaggacttttaattgttaatgaaatgtttatctttctttgttcccatgtggatttccacatttgaataaggttaataaggaagacattaagttaaacctacaagccttagtcggtatcccaaggtgcagctgggagccccaggtttcccccactccatgtccaaagctgtctacttcttttcatcaggaccctgggtccctatacacggagaggagaggagggggagatatcaaagcaagacaggatggctgtttctctttctcacaacactgagaatactccaaaacttgtcttttctctctcttctggctttatgtggaaagtatgtttcctcaccaagacctctatacccttgttctcaaacaacttttaagcctaagaaaacaaattgtgtgttctctggggatgtgagcatcattcatttgcctgaattcccatctaagtttcatcccttcccttctatcaagtcagctaccatcaagctacgaacctgctccgtcgcttttaaacctagacacttacatgttcagggctgttgtcacatcattgacttcggcctttcccaaaagtcaataacagaaacaaatgacaaatgactgaattttagcaactgtgattcagagatcattttagagtctactttcccaggtctcatcttacctgactttcacaacagtcctgtaagttagagaatgcagtagtaattggaaactgaagcccagaggggctaattcatctgcccacatttccacagctaataaatgtctgtgaaataaaactagagctagaattttctgtatccaaatgccatgcccttaccattgccaacagtgtgttgctgcatcatttgcaaaaactaaaattgttgaaaccctccatcatatgccatctggtgtcctttgatataagagccacaaaatcaagtgggaaaagtagattttggagttaaatcttccctcatagctccaagaatctgagcaagttattctttgaactcagtgtttgttgttgatgttgttaacttctgtcttgcagagtgtgatgagctaagaattaaattagataatacaattaggtcgtaagtgtaaagtaggtagcagagtgtatgacacacagtaggtcctaaaatgtttcattcccattttggtgtcctttgatacgagagccacgaaatcaagtgggaaagtaaacttcggagttaaatctttccctagtagctcgaagaatctgagcaagttatcctttgaacccagtgtcagtcacattttaggacctactacatgccatacattctgctatgaataattcattgctgtgttgtcagagaaaatggtgtttacttatttatttttttttattttgagacacagtctcactctgacgcccaggctggagtgcagtggcatgatctcagttcaccacaacctccgcctcccaggttcaagcaattccccacctcagcctcccgagtagctgggactacaggcacccaccaccatgcccggctaatttttgtattttttttttttttttttttttttttttagtcgagacggggtttcaccatgttggccaggctggtctcgaactcctaacctcagatgatctgcctgccttgacctcccaaagtgctgggattataggcttgagccaccgcacctggccggtgtttattttttaagtacacaaggagaactatatccctccattcttcttttggcctggaaaaactgggtaaaacgtaaagctaggatttatgtgcacttgcagtgatgtttcgagtacagtttctcctctccacactcaactcttctttcttcactgtgcactttatctctctggatttttattgtaccttcactcagatccctgagcaggcagggcacacttttaaaaatccattcaattgcttaataattttgtgaacccttggaaagagtacaaagatagtatgaaatagtgatgtcatgtccgaaaccagagaagtgctccattttgtctcaggaatggcctatgcaggatggatgggggttggagaaggaaccccttttcccacccaacacaggtgtctctcaggactctgtctcttttttaagaaatgggaatccaaattctaaaataaagttacttcttccctctccttctaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggtatggcttctgctccgacaaccctacctcccctctaacctgtctcagcatgataccttcaatggcgccctcattaggagacacgagtcattgcctccatatttatcttacatttcggtgtacctgccatccatccaaacatcccttctacacaccatggaagtattacttagaatgttttagtgtcatcaattgggaaagatctttacttctagatttgtttgtctgttttcctgttttttagaatttggtttcatttagcataacaaccaggcttctcagcagtccgtgacttaggggaaaatgtaacaagtgtttgttcatctaccctgcatgtactggaagagataaaagttggaaaatagatcaaaacgcacgtacactattatttttctcttcaaggctggcagaaaaagcagccttggagtgggctcatcagtgagcaagcccctgagctgggaggtggaggttggatgcgtctgcattcccactcggtgttgggaccctttccttatgctgaatttgccagaaggctgtgccgttctgggaggacttgcatcctggtctcctttttccttaaaaaaacaaaaattatccttttctttcctgactcaaaattattcaggatcattgtagaaaatttttataaactcaaagaagaaaatcacttataatcccaccacttaagatatactcgccattaatactttgaagtttctccttctatagattctctctgcagtggacttctaaaaacaaaaatagcaacccactgtaaatacctactgcactgtactctgcatttgttacactctattttgaacattttcttacgtctttggatattctacaacgtgatttaactagaacatctctaattttttgttctgatttaaataacactaaaatgaacatcctcgaagattagttttcatgcacatgcattatgattcttcttactggtttgtctcctctctgccaccccatcccggctgtccaccacccgcactaattagcagcctcaagtgggaccatatgactaagggccaaagaacacaaggggcggaggcttttccattttctgttttctttctttttgtttgtttgttttgtttgtttgttttgagacggagtctcactctgtcgcccaggctggagtgcaatggtgtgatctcagctcactgcaacctccgcctcccgggttcaagtgattctcctgcctcagcctcctgagtagctgggattacaggtgtgcaccaccacactcagctaatttttgtatttttagtagagacagggtttcaccatgttggccaggctggtctcaaactcctgacctcaggtgatccacccccctcagcctcccaaagtgctaggattacaggcgtgagccaacgcacccagcccttttcccattttctatctcaagccatgacgactggagagtgaatgagggaaaacttctaaggagacttgagccatgggaagaattaatgagggaaccagggaatgaatgaggaaagtggatggcaactggggcatccatcaccacctctgcagttcccagtagattctcagcatatgtgcaataaccaaatcaatgaataaatgcacttacctaagataaagagaagccagaccatggcaaagcacttactgagcatatgctgtgctcaaagcactgtggaggatacagaagtatataatacagctcccgaccttgagaacttcacactctaataagagtcaaggctgcatttctaacagtatgagtaatattagatcagaaggcagacacaaagtaccagagctgagagaaactagaaagaggaatttgaatgggcagaaagggccttgggcatgaaaggtgtggctgcaggagaggaagtagaaaagagtgaggtgtcctggtcaactatttaggagaatgcaggcccgcttcctgctgcagggagcaggctggaacttcccatgatgaaggctagaagagattttgtactagaaactccctcctggagatgataaatacccattggcctgggagggtgaaggtatgtcacctgcaggcaaagggacaaactctgccaccctctccatgctgttgggagggtgaaggtatgtcacctgcaggcaaggagacaaactctgccaccctctccgtactgttgtctagattttctgcacatgctggggctccctgtaatcttttccctttgcagtattttgaggcttgtagcaaactgctaaacacattttttcttttttgccataaataaagatttttactgtaaagctttcatagtagcgaaaaattggaaacaacacaaatacccaatgacagatttattgaataaattattatatggtcagagaaaataatactatataaccattttaaatgatgatgtaaatgcttaaacatcaatacagaatgttgtttatgaaatcataagtgagaatatatagtatttccttttaagcaagaacatttgcatgtataagcatgaaaaataatgaaaaactaacagttgttaattgggaggtaggattataactgattttatttttattatatctttctgtgtatgttactataaacacactttagactgggcttctgggcacttaggcagttgtgcttctcttggtgccttttccccatttttttttttttttttttgatttgcatgtatgacagttttcatgtcttacggggaaggctattgggaatcccactttgtagaagataggtatgctcctttctcttgcctgtccatcacagcttcaggcagcatttgtttctgtccctcttatgagagatctccttaacccatttatgcctgaggttgcaactttttgaattttgaaatcagaccttggtgatgaccttgagcagtaggatataaataactcccacatgcttagcgttccaataatggaacactaggcataaatgagttccgtgcagctgggatgctttaccaagacctgagccacaagtgcatccacagcattggtgctgggagagaaaaaaaaacttcagcagagaatgtttacatgaaatgtaaatctgactggctcaagactcagatctcaaggaactgagtccttttagaaagaggaaagaaacaaaggaagaagcttgaatcaccttttccaacaccccgagttgttgtttttgagatgtcttaattattcaaaccttgcttgtcaaagtaactgattaaataccacaagtgaatgcaaaaggcaacgattgatacgtgatatggataatgctttgttctgggaacatgttgggaatgacctttcttgggaggacagttacctgtgtatgctagtgtagacatcagataagataaattaactatgtacttctccagggcattgttattttttaaaggaagttattcatctgctctctgcctccaaagagcgcacctgttgaataccagattattcaggagattctgaggacaggtattcacttgttattaattagggtcatttggattaaattgttaaagtttttaaagttcctagatgagggatatatcacctatggaagggtgaaaatatgataaagccatttaggaagctacaaaatgtgaaaattcctgtggacttggattccgaagttcaagcccagctctgccgtttatcaacagggctctgaggcacccactttacccctgcccaggacagagagtaagagttacaggcagaggggctgggagctgtaaaaccaggggccctaatgggacggcaccgtctggggacatagatgtacaggataattcatgaaatctgaacctgaatctgaatgaggctcaaatcaaaagaatcttcacaatgaattttctgtgtgctagatcaaaatgactttgtacatcatccaggctctggcataaattactggctcagggtctaacgtagatcagcattctgagaggctgctgtcttggcaagaggaaagaagggctagctcttctttcttttactttttttctaacatttctttgttgttaatatttacattttctgtcttacaaagtctgcagggcttgaaattgcacgatcccttctcagtacccccttcagtgcggatgccagccaacttttgcactactagatttccaacttagatttttaacagtttccattacttacattttaaaaagtaaaaaaataggaaaatccacaataaaatttgtctacaagaagagttgtcataaatcttttaactatccacttacaagtagatttaaaacaattagaaaaaaataattaaccataaaactttgaaacacagggaaaaataaacactgaaacagtttccctctttttagttatgctgcagtaaaagaaagattaataactcaagtatccaaagtttctgtgttctatctctgataaaactgtggaaaaataagaggatttatttctaaaatttgtttggaaaggaaagatgcatctaacacagtaaggatgctatttctttttaatttcaaggaaataattttcccttaaaaattaaaagtgaactaaagtctaccttcctctgtgtctcctttgaattctgaaaggccgatctgtattctgacatttaagtagtgttactatttcacacctaagtagctctagatcctataggaacagctctgtctctgggtcgttccctcaggttggatttgagggcaggccgccgtggttttgcaggcctctgaagagaggcctcccagggtgatgccaagaggcagaacgctagtgttcctggattcacatcactgcccttgactcccacactcccaatatgcaccagttgaacattcttggtcaatatcactttgaaatttttcttttatgaaaaagaaaactgagtttcactttctattcatagaacacacaaagctctacttccggttatggcttcagggcatgagtgtgtgagttactttgaacaagtcacctaacatttctttgtgacactggttctccttttttgcttcctaaggataacgtgaaaaataataataataacaataatagcacttgcagagaagtttggatcttttttggagaaagtaccatactaactacaagatattattatcatttaaaattaaaaagaaaaactccttgaacttgatactttttaaaaagtatgtcatcctggtatttccatagttttaaggcaaaatccatctaagaaagtttttaatttcaagcattttattcagaaactgcttcatctgaagctctcaaaaatgctgcaatccatgaacctttcagttgagctaggagccctggaaattaccacaattgtagcaaagaaaagaaaacccacggaaaccacatccttccaaagacgtgtccctgcactaagacaagaattaacttttcatgctgcccccatctgtagtgacagataagcctcttttctttaacgtcctctggcggcgttctgatcctgagaacgcttacacgttgttatttcagaaactggggatcactcagacattctgcaggttcccctgctatgtaaccaaactgtgatttggcaaatgttagattttatagcaaatttacaaaaatgagtcgatttacagctgtcaacctgaaataatcaaaaaggccagaatctaatttaaagagcatttattcaaactcaaagtttgaggatggcccacctggaaacaccccaaaagaatgaagtcagagttgtaaaggagggaactttagggtttccatagggagagacagaggcatttttagcaggattacattttttcatacaaggctggtgcatagttccaggaacttggttacaggcagtgtttctttttgggaaagggacatttaacatcttttacagagtgtgctatagtcatgggttttctgtcatctggtctaaggaaaataggacaaaaaaaggaaaaggtaatctttaacaagattcattaattaaaaaggcaggaggcggccaggcacggtggctcacacctgtaatcccagcactttggaggctgaagcgggtggatcaccttggggtcaggagtttgagaccagcctggccaacatggcgaaactctgtctccactaaaaatacaaaaattagccaggcggggtggtgggcacctataatcccagctactcaggaggctgaggcaggataatcacttgaacccatggggcggaggttgcagtgagctgagaccacaccactgcactccagcatgggcgaaacagtgaaactccgtctcaaaaagaaaaaaagaataaaagaagtcaggaagtgtttgtccctgacaattgtttaattctctctagtcattgtacagaacaagagaaaaaaggaagcaagttaatctataatctgagaaacagaagttgtaaccatatgtgactcagatcacagtcgcatctctctcaaggcgtaaaacgcattttaggaattctaacaccttttaaatgttatttattttcacacagtaatttatgggaaattaatgttgcactcacaatgtttccttacagttttctcgtccaaatacacaggaaataacgggcaatgagtgaatacatattcaggaattcttggactaaaagaacaagacactcactcagtgcatctgaaatgccgcatctttcctacatgcctgctttttttttgtttgtttttttctgagatggagtctcgctctgtcgcccagcctggagtgcagtggtgcgatctcggctcactgcaagctctgcctcccgggttcacgccattctcctgcctcagcttcccaagtagctgggactacaggcgcccaccaccatgcctggctaattttttgtatatttagtagagatggggtttcaccgtgttagccaggatagtctcaatctcctgaccttgtgatacacccacctcggcctcccagagtgctgggattacgggcgtgagccaccgcgcccggcccctacacgcccactttttaagctcacagatctgttctcatcttgatgtgactctgtaatattcttccaggctcatggcccatattatctgcccattcctttgtcagccattctcacaaagtcccaaaagtattgtcaccagcttcccagaagacatgagcatttgacatctccttcaagagagtgcctcaggaaagtgcatgccttctgtgaatctactatccctcttttgttttttgttgttgttgttgtcattgttgtgtttgtttgtttgttttgagaaggagtctcactctgtcgcccagattggagtacagtggaacgatctcggctcactgcaacctccatctcctgggttcaagtgatcctcctacctcagcctcccaagtagctggaattacaagcgtgcgccactgcgcccagctaatttttttttcttggtattttagtagagatggggtttcaccatgttggccaggctggtctcaaactcctgacctcaagtgatccacccacctcggcctcccaaagtgctgggatcacaggcatgagccaccatgcccagcctactctccctcctttgaaaccttgctgacaaactacctactctataaatcacgctcagatacactaaatcctacttgtcattcagacgctcaggcttctcagcttacgtgacccagaaagatgattttgctcctgtactgctgggtgtcttctgtgacttctttcatatgttctgtttaaataataccttgtctatgtaaataatacattccttgataccaagatgcatgtttcgctcttttcttttgtttcatttgcccgtagagtgctagataatgttcaggggctgggcacaggggggagcggaagagaaaaagaaagataaatggtctgactgtagatcatactggctaactcaggtgccaggaaggctggtcccgaatagaactgcagaggagaagtctatctttgacaaaccctcttcccacccctctctgacctcctgtttcattattttccccttcatcccagagttcacatgatcttgtacccactgtagctatcaggtctctgccttgattttttttttttttgcgacagtctcactctgttgcccaggcggctcaatacaacctccacctcctgggttcaagtgattctcctgcctcagcctcccaagtagctggggttacaggtgtgtgccaccatgcctggctaatttttgtatttttggtagagatgggatttcaccatattggccaggctggtcttgaactcctgacctctagtgatccacccacctcaggctcccaaaatgctgggattataggcatgagccaccgcgcttggcctctgccttgatccttgatggcaaaatcgttcttctccatctccttgtctctcccccttaaaacttctgtcacttcaggaacctcttctccaccaccagtcttagagaaatatctgataaatagcatagagcagtttaatatgtgttgttcctagcaacgatttcttcctaaagtggagcagagtggagtttccttattagacccaacattacgttgtatttgaggtgattacagttcccatcctgaggaggtgacacgcatgggactcttcaggggaaactgtgggaatatatgagcgtcagaatcaacgtactgcagaaattcaagtgctaaaccacagaaaagccctcttttacaaagtaggaggaagagcaggggggaaaggtgatagggaggatcccttggggtggtaagaagaggaacagaggagttaggagtatcggaggacaggagaggaaagaatttcaagagagaaaggatcatatatttaatgtggtgaagagttgacaatcaaaaactgagtgtggaatgtgtcatggaggaggaacagacaatacagtgtgaaggagtgagtggtggataggcagattcagtggtgatacagaaatcttccagaaagagttttcagaagatggaagctcattatgactgcagagtgtaagggatgagaatcatgggaaatgcttgagccagagatggagaaaccagacaagagggagactattcaggttgtagccttttcagataggcttctttcacttaagaatatgcatttaagggttcttcttttctttctgtggcttgagaactcatttttcattgctcagtaatattccattgacaactaatgatttgttatgttcttttgttttccttataatgacagactccatggatcaagaattttagagtagggaggggtggtagaggttatcaagtcagatcccctcattttgcagcaaaggaaatggagctccagagaagataagcctagctggtcacaggagagtgctcttttctgtggtcaatccaaaattattagtaaagttgagacttcaagatacctaaacacaaatccaactcacaacttatttaattggaaaattgttcattccatgtcctaaaccttagacccaagcaagaggggttccgcccagcccctcacttagaatcctccctttggcctttctcaaaccacactccttcctgtgaagccaagaggtcgtctctgttcctaaactactccccaggacctcggaattccatacctaaacagcctcaagcctgtgtagacatctccctaggttctgtccttgaaaggggcaggaggagactttcccgatatggccaattaactggtgcagaattttgagggatcctgaatttgtcacgatccttcttggtcattatgaagttatatttcccaagagacagaacatataggaatgtagagcatatttaattgaattgttggtgagcttgattaataacacttaaacctggggacccacagtgtggggcctccctctgcacactcgctccaaatcttgcaaaggttggggctgtcctttttctgattataatgcaacttaatgcttttcttccctgtgtgataaataataacaatgtatgtgataaagttaatacataaggagttcttgctatatgccaggcacagggctaaatactttatatgaattctttcatttaattttaaatatgaacgatagctcccctttcttcttcagagcagaattcccaactctttccatcggctgtcctatgagatgtcccaaagaagagttgaattctatctctggttttcatcttgttgtactacagtcttcgctgttgtaacatttgttacgtgtccttaacatatgatactttgaaaggtgtgatggtaaatttagatgttttgtcataaatattttgatcttaattttatttattttgcagagattgcaaatattctcttgtgtaaaatttattacgttggtttactagccttcggagaaaaaagatacctcgaaaaaaatgactataattattcttttccttcttttcccatcttgtttttctggagagggagtctacaaatctgatcttatttgcatgatatttgccaagttctcagtgcatttacaaaattaactgttattagtctgataaaaatcatgagtttatttctttaatgctataaacctgtcattcatcctataatatatgcacatttgccagccatttccttgtttactcaatatttgattagctgtgttgaatagtcatcacaactaaacacttttccattctctttattctcattctctcctttgaaaagtgtaatcactgtaagaagaaagcagtgtagaagctaggttgtattaaataacttttgaggccacttttacaattcaccctttactaattctagaatattcacaaaatgtcctattcctccctttaaagaactatcttgtgttttaaataatgatatattttgacagctctaggacctttatctgctccaaatgatatttgtgtatgcaaacgcagtcctatgagaattatacaactgattttgttaaatctatcactttgatcttgtatttaatcatcattttttttaagacagggtctcactctgttgcccaggctggctttggactcctaggctcaagtgaacctccagcctcagcttcatgaatagctgagattacaggcatgcacctctgcacccaacttaaataccatttctttaaaacatcaataacacaaacataagagtcatacagctttgattacccacctatctacagaatgtcaacattgtttattgccttcagttgtctggaaatcacaacaaagctgtaggtaatggtgactctctcattttcatggacagggttcatttttcagaggaggaaaccaaggccctgtgatggtgggatttacctgatcacacagctgattagcgacagtctcatttctcacagactagaatttccattcgacagatgctttgccaggagttgttgacagtcggcaagactgggacgcgtttggcatgtcccatcccccaatgccatcacagcttcaattctcacccaccggaaagaatcatttgcctcggttaatgtattacccgccataaagacgtgaggtctagactagtaagtgacatttacaattaacccaacacaggccacattctctccctccctccctccccaccatctctctctctctctctctctctctctctctctctctctctctgtctgtctctctctgtctctctctctctctctgtctctctctctctctctctctgtctgtctctctctgtctctctctctctctctctctctcagcctgcttggtatcctctctcagcaggtggccagaacctaaacggcagcccaggagggaatctaattctgttttcttctttctttcgagagccatcggccagagaactgttcatttgcttcttctgggaagtatttgctggtttttggattggttttggttttgtctttcctggcttttaaattgcttcctagaaggacagctgccatcagttatcaattgcccactgaggaccaatgcagagattcatttccacacacactattttgtttaatacccacagcaaccctaggaggtaggagtattactaccccatttcacaaactaaatgaagctcaggagaggttaagtcacgtctccagagttataaatagaggggctttgaacccagggctgagtaaggatgaagcccacattctttgcaattactctgagtctcattcttcttggtttgtttctatctatgccagcccagagtctttccagcaggcagacacttctttttgcttgcggttctgcagaggttctagtcagctgtgggttgccttcaactctgagctctccttccccagctgtttatgaaagtttgagcctattatatttgtatttaccttttatgatgggattttggattcagcttttaaaaggcttatccatccctcaaaatgtgctcctcaaaatccaaacctctggactgtgtagtttgtatgtgcatacatttgtgctaattttatcacagagcagaacagatatttgacagatttattgtggagcctgcagttctcttgggagggttaaatgtggggcatccaacatactataaatctccattgctgttaattaataatcactagtaacgtagtcttcttctcaccctcatgttagtaaacactgactgtgccctgtgatctcttagactttaatggccaattcaacccccccaatgctcaccactagtgtggcgtctgattcagacctgagaataggtgggaaggtgtgtggaatgcatgggagtggggctgaactgttgcctccagtcccctcccaccactttctccacatctaaattgacagtgttaaattctgaaatgtcagcctttctaggaatttgtaagcatccaaacacttagaagaaaccgttcactcaagcactgttggaaatggtttcgctctacactttcatacgctttgctctcgtgactacttaaaagaagattccacctttgtggcttgtatagggccattatagtttgagtaaaaagctgaggttagaacagaagctctttctgtggtgctgatgagagcaagaggtagcatgagaaagcaggtgtgtgcaggcaaagccaatgacgactctcaaattgggtttgaaatctgtgttaagtcatgatttatgtcagctgagaatttgggcctgtccagaagagaaaagggtgggcttcacttaaagatatatggaattagtaaatcagatcggaaactaacattgaaaaaagacggatgcttaccttgacctggattattgagataattgccacaatacttggtttccccattctgtggtgaccaggcaaggagtctcactgtcagaccagaacaatgtttctactattacctcctatgccccacggcctcggttgggttcacatcaaaacgtaaaggttaattctgttaagaaaccacccaggtgagactttcagatgcaaattcatgcccagacgcaccgaaggtcctcacactttatggattactgattctgtgatgcattacaaccctttaaaaaatcaggtttctctaaagtgttataaatacatttattggaaaaaaaaattgtctcacatcattgagttgctgaggctggttacaatcctggctgatatgcccaccacagcctgaagaccacccagccctacttctgactgtggccactcgagggccccagctctactgacatacatcatgtcctctgccagaagaactccgtcataaactgtggcttgcctctgccatgagttaagtcaggactggagaaaaataaggttaaacttgattgcaagcttcagggaggaatgactgacatgacccgcccactccccccacgccacgcccacagaatatgctcagtagctaattactgagtgttgagtgaatgaatgttttcaagctccgcccttggagtcagagaccaaaacacattctccttatcaccctgcaccctgtcactttcaataagtatacaatcggcacatgctaagtgccctaagtgcctggcaccatcccattgtctggccagcaggtcaactggactctcccttgtgccccccgctcatctgctgggttgtaacacgcaagcatctagatgccacagggcatcccacctagattccccaggcttcctggggctcaaaaacatagattgtttaaatgattttgacagtcttctgataagtgatttcacaacagaattagttcccctgaaatgatctaatccatttaaaaagtagtcctccttgttgtattttctctaaagagctaaaaattggaactgtgactgggtatggtggctcacgcctgtaatcccagcactttgggaggccaaggtgggcggatcacctgaggtcaagagttggagaccagcctggctaacatggcgaaaccccatctctgctaaaaatacaaaaattagctgggcctggtggtgcatgcctgtagtcccagctactagggaggctgacgggagaatctcttgaagccaggaggcggaggttgcagtgacccgagatcacgccactgcactccagcctgggagacagagtgagaccctgtcttggacaaaataaataaataaaaatgaaatgaaataaaagttggaattgttttgtttttccacaggaaaacctcttttttgtgatggagtacctcaacggaggggacttaatgtaccacatccaaagctgccacaagttcgacctttccagagcgacgtaagaggctttaaagggtttgggagttttccactgttcttgtcagttcttgctggtttttttttccttttttcccacttggcatgcctgaatcccagggccaggtgaacccttgggaatacatcgagcaaggcgacagttttcccaggttgtgaaactgaaattcgtgtcagtttggtttcatttctctgtgatttaaaactaactacttagtttcttaaggaaccatcccgattcatcaggcttctaactaacctgagcacagaagcaaatatgtaccctttggaaaggaagcagtgaaatggactgcagacctcaagggtggtccccagggatggagcttgtagctgaggcatcttatggaaagcctgatgtggaggcataaagctttagggagcaggaagaggcacttagtccatctgagaacaaagcttctccttcctagtgccggcagcctgagacacctggagacggggcaggctgtgtgtacctggtgggactgcacctgcatccacagttctcaccaccactcctgcccatgctgttccctttgggtcccacttcctgctccccatgacatgcaagtaaaagaaagctctgccactgggctccttggaaaatgatgagtacatgctagcttcctttgctcagcgctcaataatccctccctcccatctgcatgaacactttgagtggtttaggttgaagtgggttgagaaatggatttggtccgccagcttcttaaaatccctggctggaatggctgtttatcacatctagtgggtagcactctgctgagatcattgctctgggaaacctcagcaatgcacccagaggtaattttactggatttctgcagcagagaaatcatcgggcatttttcatgccggaaagaattcacttagtccactgtcgtctccagccagcccggacccacgctatccatcctgtcctaaatgccttccaggaaggagaattttgcattcttccacaagatccagcaagcttcccttccaggaagctatctcttatatccgaccttaatcccaccagtgatggggtaaactcatttcctttaaccttgtcaccattgaagatgaagtgtaacttatcttgcatctgctaatatcctcttttccacctcatgggctgtaagtgttgcccaggctaaaggttctcagtacgaaaataaaccagctagttctattcagaatggtgcatacaggtctatgggtgccaaccagagtttaaaacaaagggagaaattatttgcctattatctatactattacttttttttttttttttgagtcagagtcttgctctgtcgtccatgctggagtgcagtggtgtgatctcagctcactgcaacctctgcctcccaggttcaagtgattatcaagcctcagcttcctgagtagatggggctacaggcgcccaacaccatgccctgctaatttttgtatttttactagagatggtgtttcaccatgttgcccatgctggtcttgaactcctgacttcaagtgatccacctgcttgggcctcccaaagtgctaggattacaggcgtgagccaccgtacctggcctatactattacttttaatgtctgtgtatgttttattagcaatagcaaaaacaacaaaaaaaatgacaatgtgagcattattgtttaaaatataagaacaagtactagatacaggcaggactcacttaagatgccagctctgttttatgctgttaggactgaggctggaggtgtctgagcctctactttcttatgtgtagaatgaatggacaacatcttccttgttaggattaaacagagttatgtgtgtatgccatttagccatacacagcatgtcagaaaaaggtcagtctgggtttgggattttatttcgttccatgacaacattcatgttgaaccttggttctccttcccccaggttttatgctgctgaaatcattcttggtctgcagttccttcattccaaaggaatagtctacaggtaaattttgctttgtggaaacaaatgctaagatatcggctttcctggctcagttaatttaatcattgcaccgagtgctgtgagacagcccatgtgatttcctgggagtaagctccacacataggtctgctgcccacaatgattacatggatgatgacttacaaccaaggaagacattccagtctcaacagcaggaaagtgctgagctcattctgtcctttatgctggttctcacttgaattccttctttcaccttccttttcccattttcactgtcctgttttctctttcttatcataccttacggtttctttctcttttgtccccttcatacctcttatttttgcttgtctttgctttgagccacctagaaatgcttatggaattttcttcttctctgctgtatgacatcatttcacgttcttctgtccaagctcttagattgacactattgtatctcaatctcctcacttcttttctcaaaatgtagttggcacttatttaacatacaaacctttacaagcttactgtcagatttccaactcactgcagattaggaggaaaaatagaaaggaaaaaaaagaaaggatctagtgaggaggatggctgagctgctggagagcagataattagtattgaagctttggtgcttacagagtgtagaattcacttaacaaggaaggatctctccattttctgagggtgcagtcaagtgagggttgccctatttggagtcacacaactaaaggcttagaggaggtttgagaagtaagtattcttaagcagcctctttgaatgtaattttttttggtctatctacaaaatcatagattaagaatctgttttataattttttaatcttcaggaaattgagaaatactcaccagaatattatttaaaaactcttagcagaatttttttaaatttttctttatatgtgtaaggcctgcaatgtatctaaaatatttttgtacctaggcactgactaaattgtgtggggtggatggatagatggatggatggatgatggatgagtgaacagatggttggatgaatggatgaacagatatttggatggatggatgggtgtggatggttgaatggatggacaaatgatggatgaatgatgaatggatgaacagatggttgaatggatggatgaatggatggatgtggatggatggatggatggatggatggataaatgatggataaatgatggatgaatgatgagtagatgaacagatggttggatggatggatgaatggatgtacctggatggatggatggataaatgatggatggatgaggaatggatgaacagatgggtggatggatgatgtatggatgatggatggatggacaacggatggatgaacagatggttggacggatggatggatgggtatggatggatgggtgatgggtaaattgaacagatggttggatggatggatgggatggatggatggatggtgatgggtaaattgaacagatggttggatggatggatgggatggatggatggatggtgatggatgggtggggagataaataaatgaaaggggctgggcacagtggctcacacctgtaaatcccagcactttgggaggccaaggcagatggatcacctggggttaggagttggaaaccagcctggccgacatgacaaatcctgtctctactaaaaatacaaaaattagctgggtgtagtggcccttgcctgtaatcccagctactttagaagctgaggcacaagaatcacttgaacctgttaggcggaggttgcagtgagctgagatcacaccattgcactccagcctgggcaacagagcaacagtccatctcaaaaaatttaaaaagttaaaaaaaaaaagggggaagtaggaataaaaattaggagggactggagagagagagagacagagatcttagactggaagggaccccgtgaaacctaaacccacatgcctcggggcattttatttccctgtgtcacaaagcttctttctatcatgtcaccatgtaaattattaacactcagaacaaaaaaaaaaaagcaatagatgtccataagtagctttactatcacaacaaattgtacccattttcgagtcttaccctgcccatgcatggaagttatgttctttaagccttcttaggcaccaacaagaaaaaaaaatgagtttattttttgtgctcattaggttgcaggagacccttgaaagtcatcatcaaatagttataactgaggataggtcaccagacaagtatgctggctttaaaactggcctgctgcataataagaaataagttgccttataataagttgaatagtaagaaattattcaactgtctgtgtgtaatttgactcacctaaacttttaatttggcaactgaattaacaaaaggattcaattcatttctttcttttgacctcataggataataattttctgaatttgttcacaaaactgatacattagttttgaagggctgccataagaaattaccccaaatttggtggcttattctggaagctagacatttggaagcaagatgtgggcagggccatgcccccaccaagccctcgatttaccagcctctggtggctgcaggcattccttggcttgtggctgcatcacccagtctctgcctctgtcttcccatggccttctcttgcccccatctgtcttttctaagaacacttgatggatttagggcccacctcgataatcaaggataatctcaccttgatatctttaacttaattacatctttaacttaattacatttggaaaaaaagaccctttttccaaataaggtcacatctacaaggttctgggggttctgacatgaacatacctggacatatcttctgggggccaccattccacccatacagctgatatcacagaccatgtgtgctctggatgtgcaggtctttgtcaagcatggcagtgggtactaaacatagagaagtcccaacccccagaaacctgatgagccactttctggggtttcttcagaggtagaatggattgatgatgaatggatgaacagatgaaaagacacaagctgtacattcaaaaaatgtccaagtgaatgttattccaattaaaagtgcaagagctgaaaggaaaaaatatatcaccagacttaagtaggggagatggcaaacaaaaattcttctgtgaaggtagactttttagagtggaagaggctttgcagatggaagaagtgactccaggaaaggcacagcaataggaaaatggaggaatattcaacaggtgcatccagcttcaggggcaaggctgctgttggtcgatgaaaagcatgagatgtggagaagcaggtgtggtggcgtcactcaccatctgccagaggaaccacaaaatcgacggcatcttcaaagatgatgtaagccctggtttgggtcaaatgtaaaaccacagagccggaaagtatgcagatgtggaaagaagaatctagaacttccaatcttagagtattagaactaagaagaaccttaagattatattttattgacaataaaactgggcccaacccatgtgtttgaagccactttcaatgctttcacgtgattctcattggacgttacaggaccccatgagacaagcaaggcaagtgtcatggtccctgttccttggatgagtcttggaggctgccagaggggaaatggtgaggcggagccagccggccgtaatgctgggattgggaagccaactgtgatgcccactccacctcttccaaatagaaaagctttgcctccgttaacctcatgatggaatgaaagggtgcccctggatgttctcttctgcttgatgccatgatggcctgcttctcctctgacagatgaaagcttgcagagacatgcacaggctgtggactctgaagttctcccctgggtcctgatgccccatagggtgtaagcatgacatgcctcagaataccctgggcctctgggttctctgccctctccagctggctccaggggtcctcactggtcttccttggcactccttcctcacccccatggggggctggcttcacatggcagcctttcagaacctttcccatattgacctagatccctcagagctggccaggcgcagtggctcacgcctataatcccagcattttgagtctgaggcagaaggattgcttaatgtcaggagttcatgaccagccttggcaacatagtgagaccttgtctctacaaaaaattttaaaaattagccaggcatggcgatggcacacatgtggtcaagagtctgaggtgggaggactgcttgctcaagaggttgaggctgcagtgaactgacatcatgccactgcactccagcctggatgacagggaaagacctcgtctcaggggaaaaaaaaaaacctgatatcaagggaagcacctgaattatctttaaaaaatcaatttcacaagtacagaatgagaagaaactgggataatggcacttcataaaggaaagcagaaaaacacctgaaggttttagtttacaataaactcaatattgggcattactgtgatgaaactatgaaaaatatggtgcaggatcttagtccaccgtggcaaaaggcaagaggatggtaatggagctctgggtgccgctgtaacctgcaccaatcagattgtctctctggaggattctggcttcattctgagccaagtcagtcgagaagaaaacggacaaattcaagatatttggaaggtagaggccagaatgtttgcccttcatccagtttcccccagtggccacatctcatgcagctgtggtacaaggtcaaaagggtctgaaaaccacatcatgaggagcgaagtccctgatcttggtgagagaagagaaaacttgatgtcatttttttcaaatatttggggtgtcacatatggtaacaatagaaagcccccttggaccaataggtgacatcacatggaagcaaagttcggttaattgttttttaaaaaatattatcagttacatttccctaagaatggaatgggttcttttaagaggatactagttctccaaggaaacagaagtttgttggcatgacattctggcgttggatggattccggttctcaaggggttcagtattagttaggaacaaacttcatcaactggacttggaattaggtgcagtataattcattcacaaatatgtagaaaatggcatacagtaagtatattttttaggttttcctccttcgtcattaccctcaggaaagtcctgggatcaagggtctccaatgggtatgggtgctctgtcctccttatactgagctgcaccccttggtaaatcagagaaagaatccatagcagccagcgtgcccttgcagaatctgctttgtctacaccccacttggtgtgcaagtggatagatacataagcgcctctcgtgagcccctctcaggctgcaatgagacaaactccctcgcctcctatggaattttatgttaaccaaattatattgattaatgtgagatttgcttcacttttgtttttcagggacctgaagctagataacatcctgttagacaaagatggacatatcaagatcgcggattttggaatgtgcaaggagaacatgttaggagatgccaagacgaataccttctgtgggacacctgactacatcgccccagaggtaggaatgcagtgacaggctgctcccacctcaccatgccctggccacatgccattgcttctttagcccctgaaaatcagaaggttttaaatatcttcattcaagatttgtacctgttttcttaagtatctcataaacgccaccatgcatgtgggtttctattattattttgtggggagcgctacttttacaaatcacatctctccaaggcttgcagagtttggcatttcctttcccccagccttaaaacatattcactctgctcagacctaccagaaggaacagctagtgaagagccaggtggagcaagcgtccacccaagtcaagtggtgaaactgtggggtcagaagacctggactgagtttctaagccaccactgatgtaagcacagagtgattgccaaagtctcactgacttccatttcctcttctgtaaaatgggtataatgctgatgtcattgtgttattgtgagcattagatgagaaagagtgtgaaagttaaaactcacccctgcccccattaaaaaataagaagaagacactgctgtcacattctggacacacaaagaagtgacatttgcacagaaggcatccatcaattcaactaaacccacctccccccttttcacagaatcctccccagctgcccacccagggagattagtgacacccctcccacttggtctttcccatggcacagcacttgttctggttgctttttcatcttcaaatctccctgcatgactggatatttgctctgcagtcatggacagattcatattcactttttaaaaattttcatttcgaaataattgtagattcacaggaatttgcaaaacatagtccagaaatatctcccaactgtgcccttcatccagtttcccccagtggtcacatctcatgtagctgcagtacaatgtcaaagccaggaaactgatgtccatccaaagtgtacatggtgctatgccatcttctctcatgggtagatttgtgtgatcttgttcacttttacatctaaggacctagtgcaggtgttggcatattaaggtgctaatagataccttctagaagagtaaatggatgaactaactaataaacgtgtgattggagatggttgtttgataaagactctggcagacctctgatttcctgggtaaaattattcagcagcaagttcctgtcattgccaaaggagttgtggccatctgagtcctagaactatgtagctttgccctgtggttgggtgatatgtaatttgaatttagccttggcttctattccatgaggaatgatgtcttttagcttacatggcattgttgaactcacagagcgaggcttattgattaaataactttctgatcgtagaaatctatgtttcattcagtttggcacagatacaggttttgatgctataaaccattttcatttgaagtgaaaccaaagctcatcaaagcacgagtgatggggacttaagaggacggactcaactcaattactgaattcccctttgtaacaattctgaaatatgcccaaatgcactctgctcagaccaccctcactgccatccccagcagcagtctcctttgtcactccctcagcctcacctgagccatctcaatttctttcctcttcaccttgcaacaccttggtgtggctgccttactctgatgtattcctgtctacagattttgggtgccgggtcttttccacggcaaaccttccttcccgatttccatctgcttcttgcagaatccggcttccacagcttgcttctctctgcagcttcactcccttcttttcttttacgtgtgcttgtctccacgtgattcagtgcttggtcctcttctcttcttactctacatcctccacgagcaacttcattgatgactgtggtcttcgctgtagagtcaatatggcccacctgcacttcttcctgctgcagacactacgtccactttcctgcttgagacctccaagtaaatgcatgagtccttcaaagacagcaggtccaaaactctctctgttgaacttgctccctacttcactctttccttttctttcttggtgaattacatgtcatccatccagtcttctagagagaaaactaggaattatacaaatttcccctttctttcttacccttcaaatccacccaaacaccaacaccttctataattggaccctctcatgtccattcactcccctaaacttgtgactgaattcagactctcccttgattccttctccaagctcaaacaaatccccttgatccagctccgcccagatctccaggtcctctcgcccttactgctgttaccctagtgcagaacatgagcatctcttgcctggctcttggtgacacccttccatctgctttcctcccttatcatccatcaccagggcatgctctttacatatcttcatgccttttgatctgttagaaaagcatccccaagatctgtctatttatatatgaatcatatacattgtcaccagctaagatagactgtgtgttatcaatgcctaaaaaggaatatgatcaggttatactaacaataatatatagtttaaaataactaaattgcattaatttatttattattattatactttaagttttagggtacatgtgcataatgtgcaggttagttacatatctatacatgtgccatgctggtgtgctgcacccattaactcgtcatttagcattaggtatatctcctaatgctatccctccccgctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccagtttcatccatgtccctacaaaggacatgaactcatcatttttttatggctgcatagtattccatggtgtatatgtgccacattttcttaatccagtctatcatttttggacatttgggttggttccaagtctttgctattgtgaatagtgccacaacaaacagatgtgtgcatgtgtctttatagcagcatgatttctagtcctttgggtatatacccagtaatgggatggctgggtcaaatggtatttctagttctagatccctgaggaatcgccacactgacttccacaatggttgaactagttggcagtcccaccaacagtgtaaaagtgttcctatttctccacatcctctccagcatctgttgtttcctgactttttaatgattgccattctaactggtgtgagatggtatctcattgtggttttgaattgcatttctctgatggccagtgatgatgagcattttttcatgtgtcttttggctgcataaatgtcttcttttgagaagtgtctgttcatatccttcgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagttgaattagatcccatttgtcaattttggcttttgttgccattgcttttggtattttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccattgcttgtttttctcaggtttgtcaaagatcagatagttgtagataagtggcattatttctgagggctctgttctgttccattgatctatatctctgttttggtaccagtaccatgctgttttggttactgtagccttgtagtatagtttgaagtcaggtagcgtgatgcttccagctttgttcttttggcttaggattgacttggtgatgcgggttcttttttggttccatatgaactttgaagtagttttttccaattctgtgaagaaagtcattggtagcttgatggggatggcattgaatctataaattaccttgggcagtatggccattttcacgatattgattcttcctacccatgagcatggaatgttcttccattggtttgtatcctcttttatatcattgagcagtggtttgtagttctccttgaagaggtccttcatgtcccttgtaagttggattcctaggtattttattctctttgaagcaatcgtgaatgggagttcactcaagatttggctctctgtctgttattggtgtctaagaatgcttgtgatttttgtacattgattttgtatgctgagactttgctgaagttgcttatcagcttaaggagattttgggctgagacaatggggttttctagatatacaatcatgtcatctgcaaacaggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattccgtatgatattggctgtgggtttgtcatagatagctcttatgattttgagatacatcccatcaatacttaatttattgagagtttttagcatgaagggttgttgaattttgtcaaaggccttttctgcatctattgagtaatcatgtggtttttgtctttggctctgtttatatgctggattacatttattgatttgcatatattgaaccagccttgcatcccagggatgaagcccatttgatcatggtggataagctttttaatgtgctgctggattcggtttgccagtattttattgaggatttttgcatcaatgttcatcaaggatattggtctaaaattctcttttttggttgtgtctctgcctggctttggtatcaggatgatgctggcctcatcaaatgagttaaggaggattccctttttttctatttagtggaatagtttcagaaggaatggtaccagttcctccttgtacctctggtagaattcggctgtggatccatctggtcctagactctttttggttggtaagctattgattattgccacaatttcagatcctgttattggtctattcagagattcaacttcttcctggtttagtcttgggagagtgtatatgtcgaggaatttatccgtttcttctagattttctagtttatttgtgtagaggtgtttgtagtattctctgatggtagtttgtatttctgtgggatcagtggtgatatcccctttatcattttttattgtgtttatatgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcagttttggatttttcctgctttctcttgtgggcatttagtgctataaatttccctctacacactgctttgaatgtgtcccagagattctggtatgttgtgtctttgttctcattgatttcaaagaacatctttatttctgccttcatttcgttatgtacccagtagtcattcaggagcagattgttcagtttccacacagttgagcagttttgagtgagtttcttaatcctgagttctagtttgattgcactgtggtctgagagacagtttgttataatttctgttcttttacatttgctgaggagagctttacttccaactatgtggtcaattttggaataggtgtggtgctgaaaaaaatgtatattctgttgctttggggtggagaattctgtagatgtctattaggtctgcttggtgcagagctgagttcaattcctgggtatccttgttaactttctgtctcattgatctgtctaatgttgacagtggggtgttaaaagtctcccattattattgtgtgggagtctaagtctctttataggtcactcaggacttgctttatgaatctgggtgctcctgtattggatgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgattttgcagcagctggtaccagttgtgcctttccatgtttagtgcttccttcaggagctcttttagggcaggcctggtggtgacaaaatccctcagcattttcttgtctgtaaagtattttatttctccttcacttatgaagcttagtttggctggatatgaaattgtgggttgaaaattcttttctttaagaatgttgaatattggtccccactgtcttctggcttgtagagtttctgccgagagatcagctgttagtctgacgggcttccctttgtgggtaacccgacctttctctctggctgcccttaacattttttccttcatttcaactttggtgaatctgacaattatgtgtcttggagtcgctcttctcgaggagtatctttgtggcgttctctgtatttcctgaatctgaatgttggcctgccttgctagattggggaagttctcctggataatatcctgcagagtgttttccaacttggttccattctccctgtcactttcaggtacaccaatcagacacagatttggtcttttcacatagtcccatatttcttggaggctttgttcgtttctttttattcttttttctctaaacttcccttctcacttcatttcattcatttcatcttccatcactgatactctttcttccagttgatcgcatcagctcctgaggcttctgcattcttcacgtagttctcgagccttggctttcagctccatcagctcctttaagcacttctctgtattggttattctagttatacattcgtctaaatttttttcaaagttttcaacttctttgcctttggtttgaatttcctcctgtagctcggagtagtttgatcatctgaagacttcttctctcaactcgtcaaagtcattctccatccagctttgttccgttgctggtgaggaactgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacaaacaggaccctcagctgcaggtctgttggagtttgctagaggtccactccagaccctgtttgcctgggtatcagcagcggtgtctgcagaactatatttattaatactacaaaaatatctatgcttcatcaaaataatgagattaaatgactttttaaaaatcttggttttggccaggtgcagtggctcacacctgtaatcccagcactttggtaggctgaggcgggtggatcatgaggtcaggagatcaagcccatagtggctaacacggtgaaaccccgtctctactaaaatataaaaaattagctgggtgtggtggcacgtacctgtaatcccagctgctcaggaggctgaggcagggcaattgcctgaacccgggaggcggaggttgcagtgagccgagatcgtgccactgcactccagcttggtgacagagtgagactctgactcaaaaaaaaaaaaattaagtgctaccttccctggccaggccacactgtgcctctctgccattgcacatccttggtctgtgaccctcccctcaaacagtcaccttctccctaaagttgccaccggctttaggaatcacctgctgttcccttccctgtgcaaccacagcacctctacatccacctgaccaatccattgagcttctccccatcagggaccatggcttatccactcacaggctggagcagcagccctcagctccttcctgaataaacgaccacacaaagtcaaacaccctaaaagttcatctctaagtgtatactgaattccccacctctgggcgtcttttgttaaataaccctccccagcttccccctactccacctggaaaaatcccacccctggtcggaggctgccctcccaccatccacttggtgaagttttctttcacctcactcagttccccattgccccttttgccctcaaaaaccaaacaaaactggagctgtgttctccctcctcagtgccttagagaaatgttagcctctcttgtgtgattctaagtcgatgctgccctgcagggtctttatgagtgttccgctgctgtctctcctacaaacgtgtctgtaagcaccttcagggaggggactctgtggcctggggaaggccgactaggtgaggcagagaattaaaacacaggaacacacaactgctgggacagaggccatctggcaggcacccatcgttcctgtgaggagaactcaaatctcagaagctcatgcatttcgtagcagagtcaggagctacacatgaaaaacacacctgtgctccctcaactggggatcgtctcactaggctgcacctcctgagagctaaagtgcgtctcaaaagccccactgttccccctgtgttcctataataggagcaaagagaggctgatgtctctttggaggtgcaaactcattttgacaaagaatagcaaggcagttaaacagggaaatatcgtactttttttttttttttttgaggtggagtcttgctctgttgcccaggctggagtgcagtggcacaatcatggctcgctgcaacctccgcctcccaggttcaggcaattctcctgcctcagcctcccaagtagctgggactacaggcgcgtgccaccatgcccggctaatttatgtatttttagtagagacagggtttcaccatgttggccaggatggtctcgatctcttaacctcatgatccgcccgccttggcctcccaaagtgctgggattacaggcgtgagccactgcgcccagccggaaacatcatactttctatggcacactagacactcagtaaatccagatgggattgcaatgcatggaagcagctccctggagaaagtcggatttccctggaaaccacactggtattggccccaggaggtcactgactgctggggcagcactcacccagttgcacatcatggtggcagagccccgcctgtccagacctgacttcccagcttctgaggctgaaggagaacagatgaggcttgctctggcgtcgttcggtgaaaccactgttcctctctcgctgctttcccgggtttccttgtgcattttgagctgtgcatctgattctttgggtcaaagcaaggactgaaaaagagcagaacacaagaagagatcacaatgaggcaaggtcccggggctgagagagaaaggggccacccttgctggtgtttctccaccacagtctctttaaaaattgggcatgggccgggcatggtggctcatgcctataatcccaggactttgggaggcggaggtaggcggatcacctgaggtcaggagttcgagaccagcctggccaacatggtgaaaccccgtctctactaaaaatacaaaaattagctggatgtggtggcacacacctgtaatcccagctccccaggaggctaaagtaggagaatcgcttgaacttgggaggcggaggttgcagtgagctgagatcgcgccactgcactccagcctggccaacataagcgagactctgtctccaaaaaaaaaaaaaaaaaaaaaaaactgagcatagtgtgaccatgacagcttgaggtttaaaaccaagaggcacattatgctatggaaggaacatcacgtggtaaaatcctgaaagaccagattcagaacattgctctcagctcactaactaggagactttaagtaagacctttggcctttctaagcccaatcatcaccccctataggagagggataactgtgcctagctcaggggggttcttatcaataaaagacataacgtctgcaaaactcctaacacatatcagtattcctgaggcgaacactctgctgcacgtgtgagtttgcgttttacttcttcctcctaaggtaaaactgaaattttttaccaacatcgccaagctttgaagccttaatttgcaccacagctgtctcctgtccttccaaattttctttttgtttgtcctgccaaaacgaagttgtttacaaagatatgtggttcagagacgtttctggttgctttgacgccgccttgtgggcaagtctcggaaattgcatgtgtccctggcccagcaaattgagcaaagattgtattaggtgcatcttatatttccttatcattctccctgggtctaccttcagatgattccttaaggcaaagcctattttttctaaattataaagtaaactttagcatgtaaatatcgaggtaagagtagtgggtagcatttttatattggaaatcagtaacattgcaaaattctgtttgcaactttattttcagaaacggggacaagtgcatcatcaaagcagatatttatcataacatttatagttgtcccataagacaaatcatcttgactttgctacttttcactggatctcacaagaagcttataagaagcgggccagatatgattcccgtttttcacaaacaagaagggtgaaagggtcctcccaaaactacacaataagggattaagccagaagtagagcctgtgacgttttacatggccagaaaaactcttgtgctgctgttgatattgttcttctgtttgtttagcaagtctgccttagagagacttcacagcacccctgggcctcacttagcactgatctgtctcccaggagtgggccccggggtggtggagggtcagggatggggttgccgtgcacatcagtctgctccatctaaaaaagctcaccgacatcaaaacatctggctttcctagaaaatactggaatgtctggaatttttttttttttttttttttttttttttttgacagagtcttgctctgtcacctaggctggagtgcagaggcgcgatcttggctcactacagcctccacctcccgggttcaagcgattctcctgcctcagcctcccgagtagctgggattacaggcgtgcgccaccacacccagctaatttctgtgtttttagtagagacggggtttcgccatgttggccaggctggtctcaaactcctgacctcgggtgatccacccgcctcagcctcccaaagggctgggagaatggctggaattgtggtgtcattttcttttcaaggccatcagtgctgcaattctgccattcattccaaaggcccattagagaaggaagagaaaaattccatgtcatacgagtagcgccaacaaaaaaataccttctgcgtgcgtgtgtgtgtgtgtgtatttatgtgtgtctgttcacagatgcacccagctaagcccaaacacattacaaggtagtacagatgttcatccccaagagagtctgactgtcttgcttttaagtttagtgcctcaatcctattattccttctccattttgttttggctaataaagcaacttgcccgcaactcatccttggagcagcagtcatgaattaacgaagattttttttccctcttttccattaaaaaaaattttatgtgccactactatgtcctagggttttgtttttaattgtgggaaaatacacgtaacatgaaatttaccatctgaactatttttgtgtacagttcagtaatgttaaaaatagtgccaggtgcggttaatcccagcactttggaggccgaggtgggtggatcacttgaggtcaggagatcaagaccagcctgatcaacatgtgaaaccctgtctctaccaaaaatacaaaaattatctgggcatggtggtatgcacctgtaatcccagctactcgggaggctgaggcaggagaattacttgaacccaggaggcagaggttgcagtgagccgagattgtgccactgcactccagcctgggtgacagagcgagactccatttcaaaaataaatagataaataaaataaagtgtattgtatagttgtgcaatcaatctccagaaggttttcatcttgaaaaaccaaaactctgtccccattaaataccagctccctattccccctccccacagctcctggcagccactattccacttcctgtctctagaatttaactattaggttggtgcagaagtagttacggtttttgtcactgaaagtaagggcaaaaacttctgttaatacttaaggtaccttatgtaagtggaatcattcagtatttgtctttccctgcctggcttacttcacttagcataatgttatcaaggttcactcacgtagcatgtgacaggtttcccttcaccttgaaggctgaataatattcctctgtgtggaggtaccacattttcttcaacgccttccctatccctcctccctaccctctgcccagaccctggcgactgccactctcagcttctatgagttcaacgtgtttacgtttcacatataaatgagatcttgcagcatttgtttttctgtgcctggcttgcttcactcaacatcatgttttccaggttcatccatgttgttgcaagtagagattttctcctttttcagggctgatactcccctgtgtatatatagcacagtttctgtatccatttatccactgatggacacttagagtccatatcttggctattgtgaatgaagctgcaatgagcaagcaagtgcagctgtctcctctacatactggttttatttccgttggtaatttacccaccggcacattttccttatttctttcatccatggatgggtcctaccatgtaccatctcagagaagcttaggcacagtttgttgggatgtcagacgctgagcagaatggcgcgtgccctctaccttccaatgtccaaaaaggaattcattgaaagatcaacatacaaagccttttttgccagaagagtgggttggtgaaaggataggaatctttcaaaatgttaggtaggcttccagactttaaatcctcctccctaacagatagactcagaccccgctatcgagctgtaggtagctcttagagatctttcatttctagatttgagtgctttggggttttttttgtttttgagatggagtttctctcttgttgcccaagctggagtgcattggcatgatcttggctcactgcaaccactgcctcccaggttcaagcgattctcctgcctcagcttccggagtagctaggattacaagcacccaccaccacacctggttaatttttgtagttttagtagagatagggtttcaccacgttggccaggctggtctcaaactcccgacctcaggtgatccactagcctcggcctcccaaagtgctggaattacaggagtgagccactgcacccggcctagatttgagcactttgctatcctaggttctctttcctggcacaggacacaatttgattctgcatgtcagtgattagagttgtgccccctgaactgaacagccatagatagcaaggctttaaggaagggaactgtccagatgacctctttggatgcctgattactacagagtttatgcaaagactcaggacagtacaagtcagcaaagcacgtaggcttggtttccaggctcacaccagagccactgaagaacttagacacataccagctttcttaggtccaatatctgccacctaagttcccatgtcactgatgggaaaataaaaactaatggcatagtttcattgtttctttataagcagaggaaaagtacaaattgaaactgaaaagtgtttactcagactcaaactcaaaaatttcagcattgtttagacactgctctccagtcattggcttcccaagagatgggtttcagggtgatctttcttgcacaccatcatcctcgaccatttactgagtggccttgagacgctcaggaagagttgtcactcctcagcctcattcctgttaatttcctgtctgccttttggttgtgcagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaaggtaagaagcgaagccaagagcgtcttcataagacgagcattaggtcttctggtcagttttctgttcctcttagtttccaacttgcatgtggcaaacaatgattattattgaactgggtttaaatgggatgtgcaccgtctgtgttttaatagaggcaccaatattatgagcattaaatgtcaaaatgagtgtaagagaaaccctcatgtgcatcagttataacataacggcccaggaaccagttccatgaccttgaatacgctcacctggagatgtagttggttcattaaacaagcacagtgtgtggcttaaaaatcaatcttctagctacttgggaggttgaggcaggaggattgaagttggaagtgtgaggtcagcctgggcaatgtatcgagacccctgtctccaaaacaataaagggaaaaaaaaaagaaacaaaatgggcatttaggctgggtgcagtagctcacacctgtaatcccagcactttgggaggccaaggtgagcggatcacctgaggtcaggagtttgagaccagcctgaccaacatggagaaacacggtctctactgaaaatacaaaattagccaggcatagtggcacacgcctgtgatcccagctactcagaaggctgaggcaggagaaaatgggcatttatgttatatagagggtttttttttattttactcagtcttttgtttcccatagttttttattagaaatattcagtccagttcatcttcccctgcctctggttgaaatcttggacaggatgtatgactttttggcctgctcttagataaaagacaacctattgtcactcttatgttatgaaacactgtctcagtggggaaattaaaaccatccagtctgggatattattcatcacataacttttttcttttttgagacagtctcactccctcacccaggctgcagtgcagtggcatgatcttggctcactgcaacctccacctcccaggttaaagcgattctcctgcctcagcctcctgagtagctgggatcacaggtgcatgaccacactcagctaaatttttgtatttttagtagaggtggagtttcaccatgttggccaagctggtcttgaactcctgacctcaagggatctgcccgcctcggcctcccaaagtgctgggactacagatgtgagccaccatgcccagcctcatcacataaattttaattttaaagctgggactcctgcttcctttcctctgctcagagctcgtgattggcagctgctcactactggaggagacagtgttgtcatgctcttgctggctgtgttcttgttctcttccattctaactcctgagtttctgcttcagaccttaccaggtagaagctgagagaggaaagaggatgagcagaaaaaaacagttcttattcggctggcagcctcctacccctgaactggaggatggctaaagctgagacttcaatgaggcactctactaggttctgcagaaatacttatccttgcagatgtgtttggctgaaacccttgagatacaggcattcagtccagtccctggcctatatactgtaccaacgctgattctgcaagactctctcactgttggtttcctgcccagcagattgtcttgggcagtgtactagtctgttctcatgctgctgtaaggacatacctaatactgggtaatttataaaggaaagaggtttaactgactcacagttctgcatggctggggaggcctcaggaaacttgcaatcatggcagaaggcacctcttcacagggcagcaggagagagaatgagagccaagcgggaagggggaagccccttatgaaactatactctcactatcataagaacagcatggggggaaaccgcccccatgattcaatcacctcccatcaagtccctcccgtgacacatggggattataggattataattcaagatgagattctgggtggggacacaaagccaaaccatatcagccagtacagttgacctttgaacagctcagcagttagaggagccaacctcctatgcaatgacaaatctgcatatagcttttgagtcccccaaaacgaccaccaataacctactgttgaccagaagccttaccaataacacaaagtcaattaacacatgtgttatatgttatatgtatgatatactgtattcttacaatctaagaagctacagaagaaaattctattaagaaaattataggaaaatgtgtttactgttcattaagtggaagtagatcatcataaagatcttcatccttgtcttcatgttgagagggctgaggaagagggggagttggtcttgctgtcttaggagtggcagaggcaaaagaggtggaggaggtggaagggaggcaggagaggcaggcacacttggtgtaaatttgattgaaaaaatctacatattagtggactggtgcagttcaaatccaggttcatcaagggtcaattgcacttaaaatacctacagaccagctctccccaacctgccctacccactgtccaccagaaatattgttgacttcttcactctaacaaactctgagagtacaggctattaccatcttagcagcaatctccagaattcaccatcaaaacggaattcagcgccctatccgtggtagcccaggatccatcgagaatacaggcacagtattacaggtggaaactgggctctgagaatcacaaggtgtgagccaggagctcccaaggcaaacccacgtggagacagaggaacacctgagagccatcaagaaagatctggactctagacagactcagagttggccttttttgaggatgcgaaatattctccacagtgtatgggcgtagcaagttgtagaatgaaatgaatcatgtcaatacaacatgctaaatacatagaagaataataaggacctacatatactgagctgtcccagcaaatatttgggtcaaagagacccatcactgtaatcaagagcctagcacatctaggctgggtgtggtggctcatgcctggaaccctcgccctttgaaaggctaaggtgggaggattgcttgagcagcccgaaattcaagaccagcctgggcaacatagcaagaccccatctctacaaaaaatctaaaaattagccaggtagggtggctggcgcctatggtctcagctactcaggaggctgagatgggaggatcacttgagcccacaaggtggaggttacaatgagccatgatcacaccactgcactccagcctaggtgacagagcaagaccctgtcccccccgcaaaaaaaaaagagtctagcacatctaaaggaagtggaccaagaatgcaggtgttttggaagaaacattgttttgatttctggcatttcatatgtcagctggttaaaaaataatcatcatttagagaaataatttttagccttgttcgtgctatattgaaaatgggaataggataagatccttcaacattggaagctatccatgggttctaaattaaaaactagaaaaatattagcaggctcatcttttttcactaatctacttttttgcttttgaagaagtacttagaattaaatgtaaagggaatacacttccacctctctaataaaagtgacaacttgtcttgggcattagaaacttggaggcaactccagggctctccctggaaaatcaagatcttgaatctgagaagtgctgacaaagccctcacaggatccccagcccaggggtaaaggaacaagatgtttaaaaatttgagccacttccattcagctttcactttctgactatgatccaaacaagcaatagcttagaaaactccctcaacaatcaattaaaggcacttttaatgaccaaacacagataaaatgaaaactaatctcaaaattaaccaatttttttaaaaaggctgacaacagtaaaaataagttagtgggagccgggcacggtggctcacgcctgtaatcccagcactttgggaggccgagatgggcgggtcatgaggtcaggagatccagaccatcctggcttacacggtgaaaccccatctctactaaaaatacaaaaaaaattagccaggtgttgtggcgggcgcctgtggtcccagctacttgggaggctgaggcaggaaaatggtgtgaacccgggaggcggagcttgtagtgaaccgagatcacaccactgcactccagcctgggcgacagagcaagactccatctcaaaaaaataaaaaataaaaaaaataataagttagtgggatctggatataaagttttttattttatataaaggcaggttcaaacactattacaattgctacatttgtagcaataaatgtagcaatcgtaataatgaactcagtgtgaaatgtgtcagcttgggctccataacaagatatcacagactgagtgggttaaacaacagacatttctttctcacagttttagaggcagaaagtccaagattaaggtccagcagtgtcagttcctgatgaggactctcttcctggctggtagacagctgccttcttgttgtgtccttacagcagagagagagagagataaactctggtctctctttcatgtgagacttctagccctattggatcaagaccttaccccatgacctcatttaacccgaattatctccataaagcccttacctacagttacattgtgggttagggcatcaacatgtgtattttgagaggacgccattcagtccaaagcatgaggctgcactgcaaagcctgggccagcaaaacccactggaaaaaagtgagcacaaggcttagtctgtacaacctgaggcgtgagagcacctccagactcaggggctgtctccaagtgagtcccaaggtggaggctctggagggagagtcacaatcccccaacacccctcatggcccataaatgccagcttccccctgtgcttcacaaacccagcctaccttgaggatatgcaatacttcaggccaggacggagagtgaaggagggacagaggtaaccagaagtaattccgtggagagaagttggaagtgatgatttccaaggagagaaagattggatgggaagaaagggttccttccagttggaggagaaaaggtgaaaagccgtgtgctggaatcctactcagcaatgaaaaggaacaaactattgatctataaaacaacccaaggcattatgctgagtgcaaaaagccaatctcaaaagatcacatactctctgagtccattgatataacttcattaaagtggcaacaccatagaaatggaagtcagattagtggttgcctggggttggggtgctggggacaggagggtgggcgtgactctcaggatgcagcacaggtagatctttgcagttatggaacagtttgtatcttgcttggcgtggaggttgcccatatctgcacatgtgataaaatggcataagtagtatatacacacacggtaccaggccagctcctaatcttatgctatcattacgtgggatggaaccgttgggagaaatagggtgaagagcacccaggacatctctgtactgtcttatcaacatcctgtgaatctataattatttaaaaacaaaactaaatctaaggctaaatgccttgcaaacacccaaataaaaagtcatctgcagagtttcagtggcaagagaaagagttgccacaagagaagaaaataaatttggttgaatagagcagaaactaagataataaagtttaaagaagcaaacaagaggactggtgggtgaaagaggttcttttcttttttaagacagagtgtcgctctgtcacccaggctggagtgcagtggtgcagtctcagctcactgcagcctatgcttcccaggctcaagcaattctccagcctcagtcttccatgaagctgggactacaggtgcatgccaccaatgcccagctgatttttgtattttttgtagagacgggttttgccatgttccccaggcaggtctcaaattctggagctcaaagcaatctgcccgcctcagcctcccaatgtgctgggattacaggcatgagccaccattctcagtaaaaagaagttctaaatgaagcttgcccaacccacgccctgcatacagcccaggatggctttgaatgcagcccaacacaaattcctaaactttatgacattacgacattttttgtgatttttgttttagttcatcagctattgttagtgttagtgtattttaggtgtggcccaagacaatccttcttccaatgcggcccaaggaagccaaaagattggacactgctgttcaaagttgacatagaagagtttggacttgttatttcccatgtgagttagtaaaacttccatgaactttctcttacacatattcttgcagttgggctgataaaattaatttccattatgcaatctgctgcccataaactggcttgcagctttatctctattcctcctttgctttgatccaacagcccccacattcttgagccccatttgttgcaaaaataaaaggtaatgccctttctcagaaacgtcttctagggaatttgacaaaatgttatgaaacccagaagtcataggtcctctggaaaagctgaggatagcagcatttcatggcatctgtgacagcagcagtgccagacccgttgccattggcccacctagggcatggatgcatgtcgtgcactgaacaattgcccactgggagaggctgtgctctggcaagaattccagtggggacactgctgtccagttgatgattgccaaagaaacaccctttactccccgtctctactaaaagtacaaaaaattagccaggtgtggtggtgggcgcctgtagtcccagctactcgggaggctgaggcaagagaatggcatgaacgcgggaggcggagcttgcagtgagccgagatcgcgccactgcactccagcctgggtgacagagcaagactccatctcaaaaaaaagaaaaaaaacactctttacttcctcatttatccatccaggatgtcctgtctatttgtttgaaaatgatgggaaactaatgatatagaacataaatatctcttcctttcatagaaagacatatctgaggagggactgaagagggaaggcaggttccaggtacaatctgtcagcactactgctggctgtcctctgcagcctggagctgctttcttgcacagactgtccaataaacttaaacaaacttcaactacatcctggctattttttcccatcaatgtaaacctccgtcctgacagcttttacagacaaaatcaagtcttcaggtattttatttcctcagtgcagctttccaggggcggagcttccagcctggccccactcccatgaggtcacctgtcatcctcaggacctcagtgggttgagtcgctgcaaggcagaacatatactaatttaccgttctgtgcaaaactggaaagaatattgacgctcagagctggagaccatatgctcttctcattacacattttattttttaaaatatatttttaaattttgcaggtacacatccaagctaagaaagcccattgacatgatcctcttggtacaaataccacatgttcactggaagaaatagaatagaaaacccagcctgcagcacacacggcccagggcagttacttccagcctactttgctgaagcatctcattagaacaacatgagcgaggttttggccccttcctgagacacttacgccatctatctaatctcgtttcatccaaatgtccttaagaagcagagaccaatcatttatcatttagtatcattgtttcaggagaagggatatagggcaagtcacttattccttttgcttccttttttttttttttttttttaaggagtcttgctctgttgcccaggctggagtgcagtggtggtgcgatctcggctcactgcaacctccacctcccaggttcaaatgattctcctgcctcagcctcccgcatagctggggttacaggcgtccaccaccacacccggctaatttttgtatttttagtagagatggggtttcactatgttggctaggctggtctcaaactcctgacctcaggtgatccacccacctcagcctcccaaagtgacgggattacaggcatgagccaccgtgcccagcccctctttgcttctaaaacatcaatcagctccatgtgatgactcctgctgttttatggtttgtataaatgtatggggtgcaggtgtcatttcgttacctatgtggattgcacagtggtgatgaagggcttttagtacccactccattttctgagtctacagaaaaatatatcttaccgtgaacttggtgcttcttttctatgctgaaaacaggcaaccgagataaaatgaggatagaagatgcgtgatctgcagataaacaaaatggaaagacagcttattcacttactctgcaggcatctactgagcatctatgttgtgcacggcactatgctagcttctgtaaggaatagatatgtcaatggtgcccggcctccagagcttacagtgtggtaggaaagaagacaaccttggaaaaaagatacaatgtgctaattctccagtggagcgaagatgttgtgtggtacacagatgagagattatccatcaggatgagggggaaggaggccgcttgtcatcaaagtgctagatcctctgaagctcggcttcctcagctgacaactgggatgatgaatttgtttctcttagaatttgtttgaaaatcactgaggcatctagcacagtgcctgcctctcaaagaacattggttggagtggatgatgtatcagtcgtaagaatcatgagtgatgtgaatgatgtatgatagggtgatcaatcctgaatatgacttgaacagaagagagagagctccctgtcaggggaggtaatcaaagaaagtttcacaaggaaaagggggtgaaagctgagccctgaaagataaggcagaatttaaagatgaggggagggaagcaggagtcgactaggggagggtatctcatggcaagatggaaatgtcattagtgagggacagagacaggaaggcaggtggtgttttcggtgagcagaaatgtctggactggagagggtcctaatgggaaatggaaggtcctgtgagtcagcgtcagactccagagagccttgaatgccagccgaggacccgaggatgtcagaactctccaagccctagagatcaccttgtctagcccttcctttacacacgaggaaactgagactcagaaaacttatccaaggcgacgtgggtagtcagtctctcggatagctgtcgtgttatttccaccgtgcagtggctttctaattgggtactttggaaccccaagtttccctagagagtcctcagcagtccccatatggtaagggggagagaggaagttgagactgctaagaatttgccaatcagatacaccgggtgattgcacaaacatttcacccggaactttaaaagattctcctacttttttttaaaaaagcgaaaaaacttcactttacaatagcatgttgtttggtctttatatttttttggtagaacggagcctttgaagattttcaagtactcagataacacaagtgaagcactatttcagaacatgcaggctggctatgtttatgagcagtaaaaacaagagactcgcaatttaggtgtgaatggaggtcaagtccctgggaaagcctcctggaaaatcacgcgttccaccatgttttctgttttaaagaaccttaggctccttaaaatgccctataactcatggttacttcataaataaacatctagctgatgtaagaataaccggtaactactccagacacccaggggacctgttacttttctaagttaatgtttagactctcctgtttcttaatgcccttgacaggttttatttaagtttgaaaaatatccaagtttctttcctgtcttgccagtgttcattttaacttcttaggcagaaagaacaggagaaggaacagtgcagagaggaatgtacatatgtatgtatgtgccagctcagaaattattagatggaccttgaattaaatattgctcctccagcaggtttgcaggagctgagggtaattctcttcactcagatgccttgtagagtccaaagctgactgtctgggactagtttctattatacctgagtccccacaatgctggaatcattctaagaatgcagctttgtaagaaatcagactggagtgatggataattgatcaaatgacaaattatcactgactctatgctgttgggtgtaacagaccaggagttatactgcacaaatgcgtgcgtgtgtgtgcatgtgttcctgtacgtgtgtgtatgcgtgtgtatgcctgtccgtgtgcgtgtgctcacatttgtgttttagtgggtgtgcaggtgtatgtgttcatgtccatgtgcatgtgtatgcatgtgttcatgtgtatgtatgtctgcacgtgctcacatttatgtgcatgtgtgccagtgtgtgtttatgtccatgtgtgtatgccgtcacatgtgcctgtctgtgtgcacgtgtgtgcctgtctatgtgcgtgtttgtgtgtgtattgctgtcttataaatcgtcacatcagccctgttaggagggcacttggcttactttacaggtgaggaaactgactcaggtttgtcagttgcctaaggtccaattaataacacagggcaaagccggtttcaaatcaggtctatgcacctcagaagataacgcgtcagactccagcaaatttagaaaggcttcttcaagggagagtgccaggacaggttgactttagtcagtcctgatgaaggtgagtagaaaaatgaggttagaaaagaaggggctggtgcaccaggaagcaccacgccctcctgatgcaaaagggtcatccctggagacctcagggctcctgctctgctccctttcagctcttcgtgcgagaacctgagaagaggctgggcgtgaggggagacatccgccagcaccctttgtttcgggagatcaactgggaggaacttgaacggaaggagattgacccaccgttccggccgaaagtggtaaggactcgctcatgggccgcttggtgtcagccactctccctccgctcagggccgtctgcctgtccaagtcaccgcagctgctcacccctgccggtgccccaactccccaccagccccactctccaggaggaatgcacgtctctaacacatgttactgggctggtggggcagggaggggaggtcactcttgtttgcaaaatttaatctctgtcgtcaagatgcgcctgcatgaagaatggattgctgtgtgtccacgccttaggttgaatatgaatttgtgagggtgactattaaacaagatgggggttgtgcacatgacacatacgtacttaatggtccagtctgggtaacccaaacttggacataaaccctgcatcctacgtcaggaattttggagctgttttttccatgatgtttattaaagtatctgtaaagtgctcatataacgacatttcctaagggtaattgttaggtgttctttggtttaagggagaaactaactaaatccgtgctttaaaaaagataggtctgtacatttccatttatgtcctcactggcaaaagtcattaagctacatcagcaaaggcagaatgacctggctcacctgcgagacgggccaccataaagtgaagtcaaaaataaagcaaggttgggctgggcatggtggctcacgcctgtaatcccagcactttggaaagccgaggcgggtggatcacctgaggtcaggagttcgagatcagcctggccaacatggtgaaaccttgtctctactaaaaatacaaaaattagctgggcatggttgcgggcgcctataatcctggctactcgggaggctgaggtgggaggattgcctgagcccagaagtttgagactagcctaggcaacatagtgaaaccccatctctacaaaattaagtgggcttggtggtgcatgcctgtagttcaaactcctcggtaggccaagacaggaggattacttgagcccaagaggatgcagtgagctgggttcacaccactgcactccagcctggtgacagagcgagagactgtctccaaaaataaaactttttagaaaaacaacaaaaaaaagtcattaagaaagtaaattttaagttatgtatatcacaatttctaaaaataatgatttttaaaagagtagagcaaagttgtgggtttgccagccttaaccattccctgtgattgcctggatagacatgggccatatccgcgctgaagggggccaggctcatggacttcccaacagattccaccccagagaacgcacaggctattagtcatgatagcgaatggccagaagaagcaggtgcatctcattcccagggcaagaatagttgttctcaacatctgtcccaagctccagtgatgttccaaggacccaacaggccagcctcaagcactctaattacttgtgacagaaccacatctaatacatgggttagtcatttgtgataaaataaaaattttaccttgtttttagctatcagaactattaaaccatgtctcaccttccactgcagattaaaattgacttaatattttgcacataaaaatcaaaactttgatctaagcttaccctaaaggacattcccagttctgccagtaggaaactttccctgacctgtggtctgagctgccattgacctcacagccccagggccccttggagggtgggaggggcctggttcttcatttcgcttctctgtgttcatagcactttctgttgataatggttgttctcaatcttgggacactgaattgaacaccatactgaacagcatgtatgaaatagatgtttgctttccctttctctgttgtttggtttggttttggtttttttgccatgaaaaccaatggaccaagtggtctgaaaggagtctgtcccagtctgtgctgtctaaaaaagcccaagatacttactaataaaattaacaagggcaggggactgacaacagccaagaacgttgataaaagaacaggaatatgtaattgtgaaattccttctctcttcccatccctccgctcacaccccctcactccctctccccaccaccctcccttatccccaccttgtgttccatgaaaactgaagaggcagaggtcaaattcaggtggatcactttttcaaaggttgccaaccctgcttcatgtaaaccattagaaacattagatcccatttgaatgtctacagtcgtagtctttctgtgaatttatgaatttatattattattaagctgaggacacaggatcacagccatgttcaatgagagctgggcatggtcatctgtaggcattgcctccatttagtgtctctgcaaacaccaactttgccatacgcagatcacggcctagataacaaaagtgaagatcatgaacttaatggctgatttttcttctctttctttcttcccttaaactctgactaagaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtcctcttaatcgtttacttccccgcttgccccccacaagaacttgcttctgctgtgtcagtcctcaaaatgtagctagcattgagatgatgttttacagttgggggattggctgggcacgatggctcacgcctgtaatcccagcactttgggaggccaatgtgggcagatcacctaaggtcaggagttcgagaccagcctggccaatatggtgaaaccctgtctctactaaaaatacaaaaattagccaggcgtggtggcgggggcctataatcccagctacctgggaggctgaggcaggagtagagtaagacaaagggtgaggaagtcagatgacattaaggcaattgtaagaaaagcaagtctgcataatattcggagtcactagcctacctcatcacatggctggaaataactttagatattatatttaaaatagaataattaatataagcagactgttgacagtctgcaggtgtgctggaacattttcctgactatacggagctcttgtgattttttttaaatagacactcccctaaaatgaacacgagtaacctcatttaaggatgggcatctatcttcagatgtgtccattcaggtgtccgggccctttgttctgaaaatagcaccatgactacaaacctctagttatgtgagaaggcgacacttgtcctccccttgctccaaatgaaaatgctcacacatgtttaccaaattcacctgcttgaaggagggagagggtcctttaaggccctggatgggccagtggagggcagggagccgcccgttctgttctgatctctgctctgctttgcatttgctgtgaagccctgaacaagtcatttcatcttttggggcctccaagtaatggaggtgaagatgctgtctaaagtcccgtctcactagagtgatggggtcggtgaagacgctatctaaagtcccttctcactagagcaatggggttggtgaagacgctatctaaagtcctcactagagcgctttctggttctaaatctgaatcaaaatcctgcaaagttaaaaggtcagtgagcaacactttccaaaacacagacactcgtggattccactcgctgcaggcctgggggcagctctaccccattttccttccagtcgtcctctcctcactctgggttcccacatacccctgccccagcacccagcatcctcctgacacccagagaccccaacaggacccctaccaggagacaaataagtgaagactgttggctcttagaaacaggaaccaacgcaacttttatcccctccactagaccaaaataaggtctattcatcatttggttttgtttgttttattttttatttttttgaattagagacagagtctccctatgtttcctaggctggtcttgaactcctggactcaaatgatccccctgcctcactctaccaaagtgctgggattacaggcctcatcatttgtttttaataaatgtcatctgtatgaatatgtcaggtgactaac

SEQ ID NO: 12582 - DNA, 23108 bp, Human
ccgtctcaaaaaaaaaaaaaaaaaaattagtcaagctacataagatctatgtgcttctctttatgtatatttcaattaaaagtttgaatttaaaaatagtactaataataaataggctagctgcatataattggaaaggcagcttatgaacccagcatcaatagctttcagttcttttaggattgtttaagaaaaggttacatcagctggccaggcgtggtagctcatgcctgtaatcccagcacttgaaagcctaggcgggcggaacacatgaggtcaggagttcgagaccaacctggccaacgtggtaaaactctgtctctacaaaaaatacaaaaattagctgggggcacctgtaatcccagctactcggaaagctgaggcaggagaatcacttgaacccaggaggtggaggttgcagtgagctgagatagtgccactgcactctagcctgggctggaaggaagaatttgttaaggagcgacaagagcaaaactccgtctcaaaataaataaataaataaatataaacaaataatgttgttacgaacattcttgtacagctttatttttttttttttgagacggagtctcgctctgtcacccaggctggagtgcagtggcgcgatcttggctcactgcaaactccgcctcccaggttcacgccattctcccacctcagcctctccagtagctgggattacaggcgtccgccaccatgcccggctaattttgtttttgtatttttagtagagatggggtttcaccatgttagccaggacggtctcgatctcctgacctcgtgatccgcccaccgtggcctcccaaagtgctggtattacaagcgtgaaccaatgctcctggcctgtttttttttgttttttttttttaagagacaggatcttgctatgttgcccaggctggtcttgaacccctgggctcaagtgattctcccacctcaccctctcaagtagctgggattacaggcatgaggcattgcactcagcttcttgtacagctttcttgtgtgtatatccaggagtggactttgctgggtcatagggtatgtgtattttcagctttagtgattatatttatatatatatatatatatatacatatgtatatatatacatatgtatatatatgtgtatatatatatatgtatatatgtgtatatatatatgtgtatatatatatgtatatatatttttttttccttttttttttttttttttcttgagatggagcctcgctctgttgcccaggctggagtgcagtgatgtggctccagtggctcactggagcctcaaactcctgggctcaagtgatcctcccacctcagcctccctagtagctgggattacaggcatgcaccaccatgcccagctaatcttttttctttttctttttttcctttatttatttatttatttattgagaaggagtctcgctctgtcgcccaggctggagtgcagtggcgcgatctcggctcactgcaaactccgcctcccgggttcacgccattctcctgcctcagcctcccgagtagctgggactacaggcgctcgccaccacacccggctaattttttgtatttttagtagagacggggtttcaccgtgttagccaggatggtctccatgtcctgacctcgtgatccgcccgcctcggcctcccaaagtgctgggattacaggcgtgagccaccgcgcccggccccggctcctgctcctctaaatattagaggcaagcctcgaaccggagctccgggatgcatgccaatctccggttgcgcctgcgcgtcgggctcccgtggggtccacgcatttcctacccggcccccgcgaacaggcgtaaagctctttcttcagtgctcgctctagtgcgcgcgcccggacggcgcctgcgcagagggcaaggaacctggtaccccggtgcggtcccggcgcctgcgcgctgcggactgtggggcttctcggcccgaggcagaggaacagggaagatggcggctgtggtggagaatgtagtgaagctgtgagtggtcgtttctttctctcctagggcggcaggttttgtaaagggcctgggagtagggggcggtgggggaagggactaggcggagagagggacatccccgggaaagccatgttgcgactcctggtggggagggcaacaggagactccggagaagacgttgcgcttctttggaaacttgtggaggccctggtgggggcacactggagccccgacgggcggcatccctgcggggctgtgtggcctcagcgttcctcggggctgacggtttccagagcatggcgccctgcctgcacgcgagactcaccgtcccggtcctctcccgagacgcctcagtccggaggagcggggccgaggcccgggcggccctacggctggcccgccgcccaccccgccccgtcccgtcccgttcgctgcagcaacaggctcggcggcccctgcggagtgcactgcggggctggctgtttcagttccaggcagccccgtgatgtttgggaggatcttgggtggcaggtacctaagactacaaatattcttgggaagaatttatcgaggagcggatccagaagggaaggaacttcaggggagtgggccttggccccgtccagtagcagccatcaaaaacctgcaactggaccgaagccgttcaggacagcttagcctaaaggggcatctaggtgggcattcttcctattatacgataccattgtgctggtcagatttcaagcaaagttaaagttaatagctgttggggccatggacgctggcctatgaactgcttcctgtgagttaaagatgctttgggacttgatttattcctacagaagaatcagaatgagttttagattgggttaatgcatggtgggcgaatagagcttcttttaatgggtatgttgggcttggtgcaagggtgggaaaattgagtggtgtctagctgtccagtcagggtttttgcattttgactggatgacgaggtaaaggttcggtaactcttctaagggactcacagcttctcatctgtctttgtcgtggcctgagccccactcttcctaagagcctttttaaagagtaagttgcttctccctcctgcctgaagccttttctttgagaatgctttcccacttccattaagctaagtgcctttcctcctcttgtggtttgtttttttttttttttaagttgctttctgctctatcctgctgtctctttcagccacccctcctcccaacactattgtctttctctctgatctgcccactccagtttccccagctctttcttcaggctgacatttttctcaatttagaaatgacactgttgatctaccatttatccagttatccttcctgactcagatgttctttctttgtttccctgcgtctttgttgacttccctcatcccattgtaaggggatgttttacacaggtttctccaaaaataaaaaggaagattctcattgtactgggggagtatcagacttgcctaggttttgggagttaaacgtagtgaggttcttcgtgttggaagattttcctcagagaaatagggttgccagtgctttcaagttgtgtcataagtgaggggttgcccatttaaacagagcgtgacatcttgtttctctttgaaaaactgtagagattgtgagcatcaccagccactaattcctgaatgccagtaatgagaaaccaactctctcctcctcatttctagctgcacagggcctcagatcacaattaatacgtactcccacagaattatccctttaagaaggggcttctattcttccagttcatttggagatatggcacttctcttgattatagtgtgcctagtcttctgacagctgatgttatacattgagtacattgaggtcaggaccactagctcatcttttctttttttttatttttttagacagagtctcactgttgtcggcccgggctggaatgcagtggcacgatcttggctcactgcaacctccgcctcccgggttccagcaattctcctgcttcagcctcccgggtagctgagattacaggtgcccaccaccacacctggctaatttttgtgtttttagtagagatggggtttcaccatgttggccaggctggtcttgaactcctgacctcaggagttcacccgcctcggcctcccaaagtgctgggattataggcgtgagccaccacgcccggcccctcatcttgtatgacttgcatcttgtcctgggaaaagaattttcttatttgtaaatttctatcccttccgaatgtgatgtcagaaatgaaagtcttggctgggtgcagtggcttacgcctataatcccaacactttgggaggttgaggcaggcagattgcttgaggtcaggagtttgagaccagcctggccaacatggtgaaacctcatctctactaaaactataaaaattagttaggtgtggtggcgcacacctgtagtcccagctacttgagaggctgaggcacaagaatcgcctgaacccaggcggcagaggttgaagtgagctgatatcacaccactgccctccagcctgagtgacacttttaagactctttcttaaaaaaaagaaagaggctgttgggcgcggtggctcatgcctgtaatcccagcactttgggagtccgaggcgggcagatcacaaggtcaggagattgagaccatcctggccaacatggcgaaaccccactctaccaaaaatacaaaaattagctgggcatggtggcgtgtgtctgtaatcccagctactcaggacgctgagggaagggaatcacttgaatccaggaggcagaggttgcagtgagccaagatcgcaccactgcactccagcctggcaacagcaagactccatctcaaaaaaaaaaaaaaaaaaaaagaagccgggcacggtggctcatgcctgtaatcccagcactttgggaggctgaggcgggcggatcacaaggtcaggagtttgagaccagcctggccaaggaggtgaaacccgtctctagtaaaaatacaaaaattagctgggcatggtggcgtgcacctgtagtcccagctactcaggaggctgaggcagaagaatcgcttgaacccaggagagatcacaccactgcactccagcccaggcgacagagcgagactccgtctcaaaaaaagagagaaagtctttaagcgttcttactaggaaagtaaaataatagtatagctgtagctgctgattggttttgaaactttctaggcaaaatctagaggcagggcgcggtggcttacacctgtaatcccagaactttggaaggccgaggtgggcggatcatgaggtcaggagttcgagaccagcttggccaacatggtgaaaccctgtctctactaagaatacaaaaattagctgggcgtggtggcgcatgccactcgggagcctgaggcaagagaatcgttggaacccgggaggcagaagctgcagtaggcagaagctgcagtgagccgagattgcaccactgcattctaacctgggcggcaaagcaagactctatctcaaaaaaaaaaaaaaaaaaaaaatatatatatatatatatatatatatatatatatatagagagagagagagagagagagagagagagagagagagagagagagagaacaatgttaatgttaacttgacatttcttggtatcggagccttaagtttttgttattgcttttttttgttttaagagacagagcctccctctgtcccccaggctgaagtgcagtggtataaccttggtttactgcaccctcaacttcctaggctcaaatgattcccctacctcatccgccccaggggctacgtggaaccacaggcatgcatcactaagcctagctgatggtttttttgtttgtttgttttgttttttttaattttattttttttgagacagagtttcgctcttgttgcccaggctggagtgcaatggcgcaatctcggctcaccgcaacctccgcctcccaggttcaagcaattcttctgcctcagcctcccccgtagctgggattatggtcatgtaccaccacgcccggctaattttgtatttttagtagagacagggtttctccatgttgaggctggtctcgaactcctgacctcaggtgatccgtccacctcagtctcccaaagtgctgggattacaggcgtgagccactgcgccaggccttttttatttttattttttaacgttttgtagagatgggatctcactatgttgcccaagctggtctctaactcttggtctcaagagatccaccagccttggcctcccaaagtgctgggattataagcatgagctactgtgcccggcctcccttaagttcttaagagctcactgtcatgctgtcttgttctctcttcatgagattctccccccacacttcagtgtttccttcccagcccttttacccccaagactgtttgcctgccttatgtagctcacaagagccctgacagaacatctctcattcattccccgcaaaactgtttccagcctccttgctctgactttgcagcactcgccagcctggccctgccttccatttgacttccagtgtccgtatcaattcccatcagcagaaacaaaggagctgccgcactcaaccttgtttatccaattttattctgtgtggtgaagacgtggctgcctcctaaaggcgagcccacagaggcaaggctgccttctccattctgctctccaacgtgagattcgtgcctacctcagattacagtcattacagctcattgaatcacgccaggctatatttgtggcattgccgtctctgtgtgtcgtatgtgtcttttttacttgctgggcacatgctaagttatgcagtggtctattgtggctgctcactgaaggaccctgtcacattctagagcagggtttgttggtgtagcccgagttacggacagaaaccacagagacttaatctgtttgctgtctcatccccaggctgtttcttgtaaaatcctgatatgtcaaagctcatttggtccaacctcctcaatctatagaagagtaaccaaggtccacctgggctgactaagtgtccatgttcgtgtgacttgcaggcaagccaggtctttttactctcaagtcaagtctgactgtatctcagacatcgtcatgagtattagggatactatgagaaataaatcaattctgcccttggtttaagattgattgacgccaggtactgtgacacatgcctctattcccagatacttgggaggctaaggcaggaggatcacttgagccaggagtttgtgtccagcttgggcaacatagtgagaccttgtctcttaaaaaaaaaaaaaaacaagattgattgaatataagatcgagtttgttaacctccattaccaaagtccttgttaaaccctgcaagatgagaacaagataggttctatatacacgcttcttagaaccagataactcctggcactgtgcagttttccagttttccacttaaagatttacccttgattcagatttcaaattgagtcttttgagaccaagaagattttttcctatataattttattttgtgagaatggagaagaaccctaagatgggccttagagcaaacaagtttcttatgagtgatggtgctcaataaaagcttcaaggaacttcaggtacttgtagacatcttccataaatgtaaaattaattagttgattaaaaacctagttcaaaattcaaaagatataaaaaggcatatggaaggaagtggcctagtcacccactttttctccccgctgacctgcagtttcttttccattttgttacataaatgatagttttatttgacgcttctcagcagtgtaccttgctttgctttttgtccctagttaacttgaaattgtttaatatcagtatgtgaagagcttccttcttatggctaagtagaatttcattgtatggatttaccatagtttgctaaatacattttaataagtcccctagactttgaactctttccctctggagcagaccttggggcaaggatgtgggagcatgtagtttatttgggaggtgattctaggaaagagggaataaggaggaacttaggagggactatcatctgcttcttagcctcataagggttaagagaaatagcatcttaactagcacaggggtgggcttgtgagacacgtggagtgaacattctttcacctctttgggggttaaacttaagtctgattagacatatgatgaaatcatgtgttcctgatggtaatttatttgtaaagtaattcctcatgatggcctagaaaaggggcttcgtgtcccatgaggcagaagtggaggcaaatagaacggaagagacagccacccagtcccttgagccttctagagaagcagatggcaggggagaggaatagctcagcaccctatgccccccgctccaacatacacgcctgatttctatcttccctgcagccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggtgagggtccagacttgggagaaggggactcaggagcataaggaggaagaagcctcctcatcttaggtgatgagacagttgatagggttttccctactgccttccacctatggatgaatatggtcttcctgtgattagaaacccagggaggatgaagcagatgtttgataccagcatctttgttttctgccctgctgaggccattgtgtgtctggagaactatgtgttagccaaggccctgaagcttatatatctatttttcttttccacagactattccacctaaccccctaggccctcactgtcagaatttctcccttgctctagaactcaaaggggggcctacttaattagaaagtgtttggtattactttctaatactgggttagggcctgacttctatctttcttcctgccacaggattggcctccggacagctgtactcctaccctgcccggcgctggcggaaaaagcggcgagcccatccccctgaggatccacgactttccttcccatctattaagccaggtaaggcacatacttcctgagcagaggcgtggcctgctgcatggtgagagcctgctaatcactgtgatataccaggcccagtactagatcccaaatatactcaaatgaatatgatgtgattctttcctttaaggacctcagtctagaaggggagacaggtaaacagataagttatggtgccaagtgaactagggtgtcttaattcctgggcgtgcagagaacaaaagatagtgacagacctttggtaagccccagcattatgtggactcagagcagtctgctttcagcccttttgagccttgctttatcctgaccttgcttgcagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaaggtacaggattatccctgtggctaagggagctttgatggaaatcagcctcctcttcactgggggccacctagtttctagaactgaaacagaagctggagtccaggaagcaggcccctgcagttctgttcttacttcagtccctgattattgtcaggtactgactggcttctctgttgcttctaactatagactctcattccttcacttttatcacagaaggttattattatacacatatataattttcattaaaaaaattaaaataggccagatgcagtggctcatgcctgtaatcccagcactttgggaggccaaggcaggaggattgctcaagtccaggagttcgagaccagcctgggcaacaaagtgagaccccatctctacaaaaaaataataattaaaaaaaaatagccaggcatagcagcatgcgcctgttgtcccagctactagggaagctgaggtgggagaatcacttgagcctatgagttcgagactgcaatgagtcatgatcatgccactgcactccagcctgggcaacaaaaaaaaaaaattaaaaccagaaggtgcaagaatagtacaatgaaataccacatactctttacctagatttatcaattccacattttgccacatttgccttatctgtctttgctaaactatttgagaggaaacttcaaaaacttttcagtctaggcaacatagcaggaccttgtctctactaaaaataaaaataaaaaattagctgggcatggtggcacacgcctgcagtcccagctactcaggaggctgaggtgggaggattgcttgagcccaggagattgaagctgtagctctgcttatgcctctgcactccagcctgggtaacagagggagaccctgtctgggaagggagggaaacaaacttttatccctaagtgctttactcttttatcacaaaagtttgtgtcacagttttttggtccctgaggttacacagtgaagcacacttagtctctgccaacagagaagataagaatacatgtaaaaataacagctataaatatgccagcattgggttaagtgccttttcatgccctttctcctttagtctgtacaaccttatggggtaggtcctgtgttccccatttcacacagaggctgaaacaaagcagtttaaaaacttcccatgggtcgggcacggtagctcacgcctgtaatcccagcactttgggaggccgaggcaggcggatcttgaggtcaggagatcgagaccatcctggctaacatggtgaaaccccgtctctactaaaaatacaaaaaaaattagccaggcgtggtggtgggcacctgcagtcccagctactcaggcgcaaacccgggaggcagagcttgcagtgagccgagattgcgccactgcactccagcctaggtgacagaacgagactccatctcaaaaaaaaaaaaaaaacttcccatggccggccacggtggctgacgcctgtaatcccagcactttgggaggccgaggcagttggatcacctgaggtcgggagttcgagaccagcctgaccaagatgaagaaaccccgtctctactaaaaatccaaaattaatcaggtgtggtggcgcatgcctgtaattccacctacttgggaggctgaggcaggaggatcgcttgaacccaggagacggaggttgcggtaagccagtattgcgccattgcactccagcctgggcaacaagagcgaaactctgtctcaaaaaaaaaaaaaaaaaaaaaagcttcccacaaggtcacacaaataagcaacaacattttaatttaaactaggaggcgagtgtcaggacagaaccaccaataatgtgctcccagggtggccaatcagaggcaggagagggcatggctgcttgtggcatcagggcaaccttttggaagcatgctatttgatttggccatgtggcatggtggggaaagcatttcaggctaaggaaataacgtgaagcacaggggaaagatatcccaaagtatggaagggagcaggagcaggattatagcatgcttgaaaggcgttggtgaggaatgaggctggtgtgggtgggaccacgtcacagaggaggttctgggtggccttggccagtctcatcataggggagcttttggatgcacatatttctacccatgctaaccctcctgtccactcagcggatcctagaaccagatgacttcctggatgacctcgatgatgaagactatgaagaagatactcccaagcgtcggggaaaggggaaatccaaggtgaggggccagcgtgctgcctgcatcttgggacagggtggcctagggaattccttattttatttcaagtgagattagcggccacttccaaaagagtctaactcctcaggcccagctaccaaaataagggtgtctctttgctcttcttggcagggtaagggtgtgggcagtgcccgtaagaagctggatgcttccatcctggaggaccgggataagccctatgcctgtgacagtgagtgcctcacaagtgggtgggtagaccttgccttggacccagctcctgctctggatatgagaggagggagggttgtgtttttgcccagagtattaaaacaaacctgggctcttgtcctgcctgctgactgcttccgtctgagacccctgggaggcctgggtccctgctatatgacgggtgggacctgcatgctctgggaaagatttctgccatcctctggggtagggttgcttgtgggggccacagcaggcagggttggcctctcaacagatggcctgcaggtctcctggcctcagttaagccagggccccaggggtctgacactgagtttttcaacgtctgttctctttttctttctgtctgccttgccccacttctgtccctccaccctgggagcaccatcgccgctggggtttctctctcgtttgctctgctttcctgctgctgctgctcctgtctcaagtgtatcaaggccttcttctcatgacttttctttctgtctttcagatagtttcaaacaaaagcatacctcgaaagcgccccagagaggtagctctctcaacttttcagacttgtggttttcctttccctttttccctcttcccttgttcctcctgcctttctcatttcctgggatgctagctttaaaatctctggaatggcatgggggtaggagcagtggaatttctgctgtgctctactcctcaaagtcctgaaggctgcctttaccactgcttgtttcccacaaacctgctcctagagctgctcggcccagtgcatggggtggcttcagaagcattatcaggagcccattacaatcagacccttccgctccctccccagaccaggcagctggtggtcagctcatgttccccactgccccaccacctcctcctgccatcctctctccccactcctttcctgctggcccccttgcccttcttggtattacttctcaagatgacaaaatgcctcatggggatctgctttccttgctgattggcaggcctggacagggcaattacatgggagtgtgcttgaatttctttggggaccaactgcccaactggcttcattgataggctatccccaagaaacccatcccctgcttgtttacccacattcaggggagatgggctccatggtgtgtggggtagcatgagcctcccacatttactgaggggtaaaaaagtttggagtcttatccacttttcccccttcctgccaccccaaagatataggaatatccttccctttcctgacctggagcgtcccagactgttagtatatcccagagcaactaactggtgatggggcaagggctaagccccccaaaagtcaacatggaagagcagtggtggccatggggttggagttcaggagggaaaagagccccagaagctagagagccccacggcctgatgctcctggctgaggggaagtggccgtcactcaaggcctgtcccagagtggagctgctaggggaagggatggttgccctctgcctcaggtggagcccccacagcttgcagggatggggacatggcactcttgtatcctaacacctttctctgcaatcttcttcccactcagtttgtggaaaacgttacaagaaccgaccaggcctcagttaccactatgcccactcccacttggctgaggaggagggcgaggacaaggaagactctcaaccacccactcctgtttcccagaggtctgaggagcagaaatgtaagctgaggtgtcagaagtggtgggcaagcagaagttggcctggttatgaaaaccactccttgcatgggtgttgagtggctcagggacccccatgggtgtcatcaaaactctttctctctgtagccaaaaagggtcctgatggattggccttgcccaacaactactgtgacttctgcctgggggactcaaagattaacaagaagacgggacaacccgaggagctggtgtcctgttctgactgtggccgctcaggtactgcttcccgtgaaggctgctgctttgcccagtccccaaggggctcttggcttgctggcctctagggctgtcataaccagcccacctcgcttttcctaaccaagagaagatgtagccacaggcaggagctcctctcttccccccgcatttccgactgtctgtctcactcacttcccccactacagggcatccatcttgcctccaatttacccccgtgatgatggcggcagtgaagacataccgctggcagtgcatcgagtgcaaatgttgcaatatctgcggcacctccgagaatgacgtgtgtatccccgccccctcctcagcatggctccttctgggcttttactgctgtttgcacagttccctctaaagtgagctttcttttaaaaagggagcaggatccctcccacatgccacacgcccctccctagcatctcagtcagaactctgatttgttgccagatatatattgagtgctgattttatgtcagacactgttctagtcactaaagatgctaaagacaaacaaggtccctgcctcatgagatttacattcttacaggaacaacaataagcaaggatgtaaatgagatttgtataatgtgccatgaaaaaaacgaaatcagtactgtggcagagaataattgcataagtgatttattttgatggtcaggtatggctcttctgggagggtgatgctggtgttgaaattttggtgataccaaggagccagtcaagatttggaggtagaggaatcccaggaaaggagcagccagcgccaaggccttatgttggacaagccagatgacagggcatgggagagtatggtgggcaatgagatgagagaggcaagcactgccagatctctggggcctcgggttttattctaggtacaacaggacactgttgaagggttttactcgggaagtgacatggttatttatgtatttatttatttactttttttttttgagatggagtcttgctctgtcgcccaggctggagtacagtggcacaatctcagctcactgcaacctctgcctcctgggttcaagtgattctcctgcctcagcctcccaagtagctgggattacagacacgtgccaccacacccggctaattttgtatttttagtagagatggggtttctccatgtttgccaggctggtatcgaactcctgacctccggtgatccgcctgcctcagcctcccaaagtgctgggattataggcgtgagccactgcacccagctatttatttattctttatgtatttatttatttattttgagacagagtctctctgtcatccaggctggagtgcagtgacgcgatcttagctcactaaaacctctcccttcaggctcaagcagtacaatcctcccacctcagcctcccgggtagctgggaccacagatgcacaccaccatgtctggctacttttttatatttttggtagagacagggtcttgccatattgctgagctggtctcaaactcctgagctcaagcagtcctcccaccttggcctctcaaagtgctgggattacaggcatgaacccaccatgtctggccttgtcttatattttattttatatttatttatttatttcaagatggagttttactcttgtcatccaggctggagtacaatggcgcaatctcggctcactgcaacctctgcctcccaggttcaagcaattctcctgtctcagcctcccaggtagctgggattacaggcgcccgccaccacgcctggctaatttttagtagagacggggtttcaccatgttggccaagctagttttcaactcctgacctcaggtgatccacctgcctcagcctcccaaaatgctggtattacaggtgtgagccaccgtgcttggcccttgtcttatattttaaaaagatgactttgggtgccgtgtggagggtagactgtagggacaaggatggaggctcatgcctgtaatcctaacacttgagaggctgaggcgggaggatcacttgagcccaggaattcaagaccagcctgagcaacatagggagatcctgtctccacaaaaaaaataaacacttagccaggtgtggtggcacacacgttagtcccagctacttggcaggctgaggtgggaggattgcttgaacccaggagtttgaggctgcagtgagccatgatcacaccaccgcactctagcctgggcaacaaagcaagaccttgtctcaaaaagaaatagtcactgggcacggcgtctcacacctgtaatccaagcactttgggaggctgaggtgggaggattgcttgagcctgggatttcaggaccagcctgggcaacgtaaggagatcttgtctctccaaaaacattgaaaaattagctaggtgtggtggtgtgtgcctatagtcccagctacttgagaggctgaggtaggaggatcacttgggcccaggaggtcaaggctgcagtgagccgtgattgcaccactgcactccagcctgagtgacagcaataccctgtctcaaaaaaatataccatagagcttgggctttagggaaaaaaaaaaaaaaaaaaaagtggaggtgatttgatcaattaggagctctgaaaggacccaagtgagaaatgacagtgactggatctgcggtggagaggggcagcatggtttcccacataagattctcacatctgttcttacctgctacctacccctcttggaaatagcagtgtcctgtagtggcctgaggcacatcagttattcagtccccatcctcttccctcttgcctacttcaggaccagttgctcttctgtgatgactgcgatcgtggctaccacatgtactgtctcaccccgtccatgtctgagccccctgaaggtaagttgcccagatcttttactcagaacaattactttattagttacttggaaaatactgagttctatgttctttatgttatcacttacatattcttccaaattagggagtaaagcaccttgccttggctcagtttagaatgccttcctaacatttcaacttaaagggtttagtgtttgcacattatcagctacatttacaacagaaaatcaacagcccagaagaaagcagatgctgagccgagatcaggcacccagaaggaatgatttattttcttccaaccagtccagaaaactcaagtggtagattatctgatgtgaaacttctgcagtcaactcttgaaatttgatagatttgagcatttatttcctatcccttccccttctgaactgggaagggacttgactttggagcctgaatgggtcagtctgcttctccgataacttactgtaataatggtccaaatttattaaagctattcactgaaaccagtggtggcaccaagaattggttgcatctccacaagtccccttccagctggatttctgtacataaacacctcctgtacagaaattgagtagcagctgggcgcggtggctcaagcctgtaatcccagcactttgggaggccgaggtgggcggatcacgaggtcaggacatggagaccatcctggctaacacggtgaaaccccgtctctactaaaaatacaaaaaaattagccggctgtggtggcgggcgcctgtagtcccagctactcaggaggctgaggcaggagaatggcgtgaacccgggaagcggagcttgcagtgaaccgagatcgcaccactgcactccagcctgggcgacagagcgagactccatctcaaagaaaaaaaaaaaaaagccaacagaaattcagtagcttactcagaacacaaatgcccaggagctgttactgtgcacaaaggatgtgggccagcattacaggcaagagaaagtgtttcattgtgtgatgtaagctgacttgtaacatatcggtcaaactgctgtcacccctctagagaatgaggcccctgacaatgtctaagagtcctttagcagctgtaggggagtactcagcttctgtcaggcccagtttatgaatctgctttggggagaagtcgcatgtttatgttttgttttgttttgtttttttaaaccatcaaacagatgatctatgttacagaatggctttcctattaaagttctgtgggacatcgaggtagtggagagctgcaggcccgagtgtcctcactgtagtgttaaggcagctgaggggcaacccctagaagtatcagatgttctaggtcagggtcagcaagctacaagctaaaacctatggaccacatccagccacagccagcttaaatagcttgcaagctgttttgttttcttttcttttctctttttctttttctttctttcttttttttttttttttttgagacagtgtcttgttctgttgcccatgttggagtggagtggcatgatctcagctcactgcaacctctgcttccccgggctcaggtaatctggtaatcctcccacctcagcctcctgagtacctgggactacaggcatgccaccacacccggctaatttttgtatttttagtagagacggggttttgccatggtgcccaggctggtctcgaactcctgggctcaagtgatccacccacctcagcttcccaaagtgctgggattacaggtgtgaaccactgcatctagcctgaagaaaatccccttaaaaatataaaaactggctgtgcactgtggctcgcatctgtaatcccagcactttgggatctcttgagcccaggggttcaagaccagcctgggcagcatggcaaaaccccatctttactaaaaatagagaaattagctgggcgtggtgctgtgcgcttgtaatctcagctactatagaggctgaggcaagagaattgcttgaatctgggaggcagaggttagagtaagctgagatcacactgctgtactccagcctgagcaacagagcggaaactcttgtctcagaaaaaaaaaaaataaagggagttaaaaaaaaaatgcatgagactgtatgtggctcacacaccctaaaatatttaacactctggctctttacagaaaactttgccaaccgtattgacctttgggttagaaaggacttacatttttgagtcacctgtttctgaagagctgataaaagccctagaataatgtccaaatgcgcataggtataattttgcttatcatttcaaggcattaaggactaattttattcaaaaaaaattagaagaattcagccatagtcaatattaataaacaaggaatgacccaattgtttttcatataagggacaattattttgtgttttttagtgaaactacacaagtcttaaaactgaggtgcttgacaaacttctgtcttcccaggccctcttcctactcccaaaacttctgatttaatagggccaagagggcctgggcatcagtattctgaagtcctctagatgattatttctttcatctccatagaggatgatatttcacaatatttgaagacttagaggtttatcccagctcaggaaaccatggaactttcctgctgcagagcatccctcgtcctacctgtagctgatcctgctatagagatggggtatcaagagcagaggaattgcaagcaggtggggattgtgtgggacccatcctgaccccattttgcctctctgcaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacagagccctctgctggatggtttatctcctgcctttctccattaagaaggccatttcatcctaagatttccatgatggtggtttttttttttaatgttttgaaatacagcttttttccccccaaattaaaatttttttgtggaaccccaatatgtaaagcgaatataaaattggttattttgttttgttacataaattcaagtttataacaattctttgttataaagaacaatgaagctgttttgatcaatacaaaatttgggttaaaatcaactttaacatctatttttatgtttcagttgatttggagaattctcctagtcttggatacatagatggaagtgatgacaggtttataacagttgaccttgcaatctcagacatttaaaacaggaccagaagtttatataaatataattaataagcaaactaatgacatcaccatgggacacacacaaaagttcttgcaggagcagggtctgtgtggcttcagttgcctgcagcgctcccaggccagagcaagtgctctaggatctgaactgcccgcagtgcagccctgcagcctttcccagggcacgttgatgtgcacacagtttccctgaaggcaaagtgaacatgtggagagcttacgtggcagcgcgtatgtcttcagtgtgtgttttagaagtccaactgttgtttttatgtttttaaaggaaagatttgaatcaagcagttatgggccccctgaagtatccttttttctagaacattctgaaagtcatccttgcctatgggaagcctaggccggcctgcactgttatgttcaataaataagcagggtgctctgggctggggattgtgtgaggagcagagcgcagcccgtcctcatgcttttccactgaagtaggccaggcagagagggagtacagcaatggatgcgctttggcagctgagtagtccgagagccagaaaagaaatgtggaaaataagaacgctgtagcaggcctaggtgaggaaatttaggaagggtttgcgggaggtaggatttgagatgggtcttggagagttggacagtgtcagccggtaggacgggggtgcggacggaagcctgtgaggaaggcagaggatgcggagctgtgagcggagggagcagcgaggctggagagcagctgggctgcgggtcaagacgtctgcgtttaattcgggactgaaggttagcagggaagggaacgatgccagatcttgagtttaagaacttgaatcttgtaaagtaccaaatctaataaaatactcgtcctaaatcattactggcccaagcatgcagtgtttccgtggccgacagactcgagccagcgctgtccatggtaaccagcttttgtgtggcttaaagcttgcatccattttctcctttcatcgttttcccaaaacaattccgtgagggctgttagccctgcttggtagacgaagaagccgatgcggtctagggtcacggccagggaggctttgggacgccaagtcagctcggcggtcaccacaccacctacagggctcgtcgggccctcggggtcggcggctgctggaggcgcccaggggagtcctgctggttcctggctccgcctcccgcccctccgcgctagaagccccgcccccagaggggctcgacgaaccgccacttccgcaacgtccaatgaaacttagccgggggagggacggggcgccactgaggaccaatctgcttgggccggggcggggctgcggcgggtgggtgcagaggggccgcaccgcggacttcgcagccgggagagagcccggcgcgggcggcgcgcacgggactctgctgtgcgcgcgcccgcccgcccgccgtccgcgcaggccctcggtccgctctgccctcggggtcgtggcgcccatccctcccctgttctgctgtcgccgcccggacaggggctcgggagccgggctgggggcaggggctggagccgcgggaccagcgcctgaggtgggtgcggagcgggaggccgg

SEQ ID NO: 12583 - DNA, 254964 bp, Human
  misc_feature (1)...(254964): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcctggtacagatagcagtggctctactgctacaactgttaagaagattttctttctttcccatccgtctcttcctcggccttctctactctcccctttttccctcctctgatagtctttgcttgtgtttccattttcctaatctttctctgacgttttttcttctgagttctcaatattaggtcagaagtccagaacttggaagggttaggagtggcattggtgtaggagcttctcgcagaagattcattgcaagcctccctccctcatttactttcctttatgtaaagctgttggtttcattttcatcaagcaatctgaaatatctcaggggaagtatctgaatttactttttcagaacagatattagctgtgatagtgccctcccagtattagaagatgtgggaaatcactattatgattccttatatcaggctgattcttgagatatgttgtttgctttaggaatgatactgataatttttttttttttttgagatggagtctcgctgtgtcgcccaggctggcatgcagtgatgtgatctcagctcactgcaacctctgcctcccaggttcaagtgactctcctgcctcagcctcctgagtagctgggattacaagtgcacgccatcacgcctggctaatttttgtatttttagtagagacgaggtttcaccatgtgggccaggctggttttgaactcctgacctcaagtgatctgctcgcctcagcctcccaaagtgctgggattacaggtgtgagccaccacgccctgctgatactgataatcttaaagagagaaatttgatcatcctttcattagtaaaatgtgtaataagaaagcttattgtgggaagaagaggttctcgattatttacccctttagcattttcctggaggtttagcggtcattagaaagaagtacttgtggctaggcatggtggctcacacctataatcccaacactttgggaagctgaggaaggagaattgtttgaagcaaagagttcaagaccagcccgggcaacatagcgagatccccatctctacaaaaataaaaataagttagccaattgggttggcatgtgcctgtagttctagctactcgggaagctgaggtgggagcatgccttgagcccaggaattttaggctgcagtgagctatcatcacaccactgcactgtagcctgggcaacagagtggggtctcttaaaaaaaaacacacacacacacacggaaagacatacttgttactagtgctctttcgtaagattttatctaacgtggcattttaattatggttttaaaaatatttctttccagttaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagtaagttaactttaatggttttctaaacacttggctaatttgttcagatttgattataactaaacttcaattactttttgagggggaatggaaagaaatgtgtagttttttaatttttgtggagaaggaaccataattgagccaaatttgagtattatttaatttataatttagggtgattgaatgtgaaaatatatcttataatcaaaatgcttaaatgttctaaaagggaagctacgtagctcatttctgtagcttttatcattgtagcactatctttaatgactgtgtttaatgatggtagtgtggataagttacctgtggactcttggttattttcagaattcggaattcctaagtatgtcataactagttgaaattttagcaaaatagtcaatttctgatataatctgtggcattggaggttttaacattttttaaaagtatgtttggcatacagatttcctttgtgcttttgtagtagcatttatggctatgtaacattattgcaggatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggtaagaaaattatggtttgctgaaaatgttagccttatataagtgttgccgttttgtaatgtcaatgtaagtaaatataaactaaataagttcatttaaatgtattctttttaaaaatggtaaaattacctcttaaagattagtaactgttaacttctcttccttctgcattcttaattgtgagaaaagaactgaaggctttgtatatctctaccatcactgttctcctcccccaaaaatatacttgtaaaatttttgcttgcttttcaatagaagaaagggttggtaaatcctctttgctcttcagtttattgttttcttgattgtggtagtgaaagagttggaagtaatcatttctcacttttttacccactctgtgatttataccttactgtgtgtttttttttttctgccttttctcttctttggtctgaggatggtattaagcaatcctaatttctaatattactatgcacatataaaggaattcggctaattttttttaatgaatgcatgctgagaaaatggaattccttttttgaacatcattatatgcttctgtgaactctgcaggataatttttgagtttgaaatatatattttgcatattcaagtctaattgcctgtgtttcagggtttgtgatgatatactttttaggtttattactatgtgaatcatatagataagttcatcatcataaataggtacactgatctttgtatacttattgccctctagtggctgtagttatctcaataaggatgtaggaatgaggggaggagtgtatgtatgtgtgtatttgtagaaaagagaagataatatcatggtggctggaggaatgtgaagtaaatagatagaaagaggaagaatgcataaaaattcagatattttagaatatctgaagaagaataaattggaattacatctgatattataatgccattgtgggttaaatttcgataatataggtaacagtgtattatacagaaaatatttaaaaatctgtctgctgtattgaaacattttaaagagagttttttttttttttcttttgagataaggtctcactctgtcacccagcctggattgtagtagtgcgatcatggctcactcgagcctcgacctcctgggctcaggtgatcctcccacctcagcctgcagagtagctgggactataggtatgcaccaccatgcccaactaattttttgtagagacaaggtgtcgccatgttgcccaggctggtctccaacttctgggctcaagcgatccgcccacctcagcttcccaaagtgctgggattacagcagtgtgcccagcctagagttctttgagtaatgtaattgtatacaatatgtatcatcttcctggtgtatataaattccttttggtaaatgaaagataaaaatgcatcaattgtttgaaaataacttgaaaaacaacaaggtcagcataaaaacaggaacacaaagtcttatttcatctctgatcattagttatctgtggttcttttagttaggatgtttgtagggtgatcctcaaagtaggtgtatttgagtttgaatcagtgaggtttactaaattacccaaggcaacctaggtaagtacaagagctgggatttaacttaggacttccattattactattctgcttcttccctgtgtaaatcttatttttccaaccaaatagttcaacatgttaaatttgatcctgtgctcagatagcagagaattgtaatatgtggcctcttcctttaaggatcttctaatattacctgagagtttgaatgaatacattatacattattaaaaatatacctgaaaataatatttcttttagaaaaaaatatacctgtattgcaaacttcctaggatgccttgctcactgtttttttttttttaaatctaaatcctaccagtttttcaagtcccaacttggattttatgcctgtgtagagccattcttgacagctatcgcccaagtaaatttctctttttcctcatattttgtatataggcaatttcttcacagtccagttctttggacagttaatcaagtgttgcctcgtgcatttccaaacataatatagtttatttcctatttaaataatatcattatttaacttttcttgtgtttgtgagctgtcttacaaagtagagtattgaactgcaagtattggaagctgttgagatcatgtaacagatagttttatcactggtaacaagtactgccttttgttttccttgaaatgacaggttcacttggttcctttttgagaaaatgtctgtcaaatacccaagtctgtgtaaccttagttttctgttagttattcttcaagtaaaaatgatgttctttgaaaagagccttgtagtttatttagcttgcagctcagtcacacaactgctttttttcagattattgttgttctttgatatgtggggaagtgctttatgcatattttccattttgtcaatgtagaatattaaaaatacatattcaagtgtagaaatttaatagaattaataaactttactgtttcatcaaggtttacagtagttttgtggggggtatagtgagggcaatgaaagaaagagctgtccaagagagaaaaattgttgagggcccagctaaaattggtaattgggaaagtatagtgtaattaatcctggtttgtgggccttcctatggtagtgtgctctgctgtgcagtagaatgcattatggccttgatatggagggtttgggttttaatgaatgagtgtcttagaaggatggggctatagggaatttaaggatgctgctgagagacagttcaaggggttactaacagggcacagtctggaaagaaaagagagagtgtaaggaaatggggtgatcaaagaataggtagtgttctccatgcttgctgcatagccgtcatgtggggagccctaccctaaacagattaaatcagaatctcaggaggttagagaggagataaagtggtagttaagatatgagaaagctggtaggatatgacactatggtaagtgagtgaaatattgaagttttttaccaacatttttttttgtactgtagtaattttgtgaaataaatattttatcctccattgggtggattggatgaaatggataagattatgttatttaagatgacataacttgtcagtggcagaactgagatatgaactcagtttgttctgtgtttttgcctagacaccaaagaaatatcctctgtgttaatatcccaactcagtgcaagtggaggagcggctaacaaaaataagacattttaaaaccatgtaatcacaatattataattactgatttaaaatctgaaccctctaagttttccagagtagcaggaaatatggtaacctaggtaagatttcaatttttaaagttttgttttccagccatgttttggtagacatataggctaatgaggtaatcaataatctacaaagttgccacaatgagacaaagatgtgattgacatgaagaccccacagctgataacaggcaaaaaacctgatagttattttaatataagtaaatgatacaatttactacatatacatggctatctagaacaaagttagagacaaagttaggatgtggtgggtgagtttccccagcctccatctatagtggggtgcccagccactggtggtattgcctaattggagtgaggattctagccagtctttctgaaatgccttgcattcatcctcacagagttctagccctttccactatgcctgcccactagctgtatataattaggaacactccagaacagtggtgctgccttgtagactgagtgaactgggatttggtttcccagtcattttctcagccttttaccgtgtttaggtaccaggcctgtttgtaaagtagtattgcttaggccagcaaaaattaggggcaaaaagagatgccttgagcttggataatttagaatggagttgcttctccttaagtggccacaaattaatactgtttttcactgattaaggtttttgtaggacatatatttagggtgtcatagtctgagggatacgaagaacttaaagatggcactaaattagaaaatgaaagtggttaaattggaaatttgcagttatttgagaatgggtctttcaaaggtgttaagtctgaggtcatttgttttatatgctttagtttatcagtttgtcagagattgattatttcttttatcattcctgggcagaataaggaatatttggaatatagatgttcaaggagaaattttctaataagaagaactattaaaaacactggatttgtttgatggcaaggagttaaccaaatttgttagtttccatacaactttttcttccccccaaagaaacttgtagtatatgtaaaccgaatcttcactgtggtagacagtaatgattatctgtttagtaaagggaaatgatgatgtacacattgaaacatataaagcttttaaacaggagagggataaaagtgcttataaatttatattcagctatgagattaaaattagtgagtagtggcaaatgggagtaagtctaatcagaatgttaagtgaaacaaatttttttaaattaaaactcagtttattttataaagttaaatatgaaaccaccaaattaattttgatcagttagataaatagaatagttaaaaaaatttagttttgaattcagttaaccacatacttttgaggagatcagtcttctctttttctcaggcctttaggaagtgagtgtgagagagagagagtgtgtgtgtgtgagtgtgtgtgtgtatatatatgtgtgtgtatagatatatatatatatatatttttttttgagacaaagtctcgctctgttgtctgggctggagtacggtggcagtcttggcttgctgcaacctctgcctcccggtttcaagcgattctcctgtctcagctcagtctcccaagtagctgggattacaagtgcgcaccaccatgccaagctaattttttgtatttttagtagtgacggggtttcaccatgttggccagactgatcttgaactcctgacctcaagtgatccacctgcctcggtctccccaaagtactgggaattataggcgtaagccagtgcactcagcccttaggaagtatgtatatatatgtatatattttaaatcaggagatgaataaatagtatcatttccttccttccgtccttccttccctctttcttttcttttctctttacttttttcctttcctttcttttccctccctccctccctcccttccttccatccatgtgacagggtctcactgtgtcacccaggcaggaaggagtgcagtggcacaatcacagctcactgcagccctcaacctcccaggctcaagcaatcctcccacctcagcctctcgaatacctggaactacaggtgcacaccactacacccagcaaatttttgtatttttttccttgatggattctcgctgtgtcacccaggctggagtgcagtggcgccatctaggctcactgcaatcttcgcctccctgggtcaagcaattatcctgcctcagcctcctgagtagttgggagtacaggcgtaacctgtaaaaaccctttgtgtttgcttacctgttgttcagcatagggaaaggggtaaggaaagaactgtatggatcactctgtggacagcaggagaagtacctgatgatttcttgaatcaggcaaaggaaagaaaatagaaatcaaaccaagaatttttacttctatgcaatgcaatactgaatgtttataactttaaaaaaagatgtgtaaataaatagtgtattttggaagatttatgtcaaatgtgatttaaggagataattggaggcacttgtcaactttctggaaatttaactcacataaagcatgacaatctctgtttaagagtaaattaagaattattgattttattggggaagcagccaagatggccgaataggaacagctctggtctacagctcccagcgtgagcgacgcagaagacgggtgatttctgcatttccatctgaggtactgggttcatctcactagggagtgccagacagtgggcgcaggacagtggatgcagtgcaccgtgcgcgagccgaagcagggcgaggcattgcctcactcggggaagtgcaaagggtcaggggagttccctttcctagtcaaagaaaggggtgacagacggcacctggaaaatcgggtcgctcccaccctaatactgcgcttttccgagggggcttaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatcaatgtgcaaaaatcacaagcattcttatacaccaataacagacagccaaatcatgagtgaactcccattcacaattgcttcaaagagaataaaatacctgggaatccaacttacaagggacatgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactattttaaagttcatatggaacccaaaaagagcccgcattgccgagtcaatcctaacccaaaagaacaaagctggaggcatcacactacctgacttcaaactacaaggctacagtaaccaaaacagcatggtactggtaccaaaacagcatggtactggtaccaaaacagagatatagatcaatggaacagagcagagccctcagaaataatgcttcatatctacaactatctgatctttgagaaacctgagaaaaacaagcaatggggaaaggattccctatttaataaatggtgctgggaaaactggctagccatatgtagaaagctgaaactgtatcccttccttacaacttatacaaaaattaattcaagatggattaaagacttaaacgttagacctaaaaccataaaaatcctagaagaaaacctaggcattaccattcaggacataggcatgggcaaggacttcatgtctaaaacaccaaaagcaatggcaacaaaagccaaaattgacaaatgggatctaattaaactaaagagcttctgcacagcagaagaaactaccatcagagtgaacaggcaacctacacaatgggaggaaatttttgcaatctactcatctgacaaagggctaatatccagaatctacaatgaactcaaacaaatttacaagaaaaaaacaaccccatcaaaaagtgggcgaaggacatgaacagacacttctcagagaagacatttatgcaaccaaagaacacatgaaaaaatgctcaccatcactggccatcagagaaatgcaaaccaaaaccacaatgagacaccatctcacaccagttagaatggcaatcattaaaaagtcaggaaacaacaggtgctggagaggatgtggagaaataggaacacttttgcactgttgatgggactgtaaactagttcaaccattgtggaagtcagtgtggcgattcttcagggatctaggactagaaataccatttgacccagccatcccattactgggtatatacccaaaggactataaatcatgctactataaagacacatgcacacgtatgtttattgtggcactattcacaatagcaaagacttggaaccaacccaaatgtccaacaatgatagactggattaagaaaatgtggcacatatacaccatggaatgatatgcagccataaaaaatgatgagttcatgttctttgtagggacatggatgaagttggaaatcatgattctcagtaaactatcgcaagaacaagaaaccaaacaccacatgttctcactcatagatgggaattgaacaatgagaacatatggacaaaggaaggggaacatcacactctggggactgttctggggtgcggggagtggggagggatagcattaggagatatacttaatgctaaatgacgagttaatgggtgcagcacacccgcatggcacatgtatacatatgtaactaacctgcacattgtgcacatgtaccctaaaacttaaagtatgaaaaaaaaagaattattttagcctaaaaaaaggtctctatctctgtgtccttacactacctacttacaaataaaggagccctgcagatattttcaaacataaggagtcatttttgatgaatgatgttttcaaaaataatgctatcctttcctgaagagtcttttccttaacccaccatattttccaactggcttccacctccctttttggagaaacatagcatttaaatagatgcaacaaatgctttagtataggcagcgtaaaaacagacatgggttagaagatcattctttatagtgcatatcaaaaagtaaaacacagtagctctctcccattggaaatcccatggcactacttttttcacaaagaaaggattttaaaaaaagagacaaaaaatgtggttatgtccacatgtgaagagtgaacacttagttaaccgttttttaatatttaaaaaaacccaacaccaaaaaagagaaaagcatccatgtcctcctttcctgctcaattaataataaaatttgcttgagaaattctggaaaactgattctctgtagtggtgagacttgagtaataccacacccaacacacttaacacaccttccatctcccagtccctgctgtgtaggtatttgtagataccttggatgtcttagtgtatgtgcacctgtgtttgtctgacaccacctgttggaagattccttgcaaggatttaacacagtggtgaatggcatagaggagtatcttcatttagcctgggaaaccagaagtctgaaatcaaagtgttggcaggactgtactccctcaaggggctctacaggataatctatttttcactttttccagctcttggtggctgcctgcaatcctgttttccttagattgtagttgtcttactctaatctctgcctacatctccatattgcattttcctctgagtgtctgtgtcatcatcatcatcttctttcttctttcacagggtcttgctttgtcacccaggctggagtggcgtgaacatggctcattgcagcctcgaattcctgggctcaagcaatcctcccgcctcagccccgcaagtagctgggactacaggcacaagctaccatggctggctaaatcttatattttttttgtggagatggggttcaccatgttgcccagtctggtctcgaactcctgagcttaagcagtctgtctgccttggcctcccaaagtgctgggattacaggtgtgagccactgcacccagccctgtgtcttcttttttgtctatctacctcaaatttctctctgcctttctcttataagggcacttgtcattggatttagggcccactcagatgatccaggatgatcttctgctttcaagattcttaacttaattatatctgcataaattgtatttttcccccccaaattgtgtaacatttagaggtttcagagattaggatgtggacatatcttctgaggatggccatttttcaactcactacactccccataatatgttctcttctttcaaatagagaaagaaaatttaagattaataattatgtataatttaagattaacatttatatagtataagtataattacataatttaagattataattaggattaatgagtaatatataacataaaatttatcattttaaccattttaaagtactctatacaattcattgccataaagtacatttacattattgtgcaatcattaccactatttctagaaattttttaattatctcaaactgaaaccctgtacccattaaacaataattctccatatcctcttgctccaacccctcgcaaccagtattctacttcctgtctctatgagtttgactgttctaaatatttcatataagtagaatcaaacaatatttgttcttttgtgtgtgtgtgtgttttatgtagcctaatgttttcaataatttatacaagtcatagaatgtgtcagaatttgcttccttttaaagcctgaataatatttctttgtatgtatatagcatattttgtttattcattcatttgttgatgggtacttgggtttcttcctccttttggcttttgtgaataatgctaccatgaactggatccacaatcatcaattcaagagtgttttattttttgaggaacctccatactgttttccacagcagctgtaccattttacattcctaccaccaatgtacaagagttccagtttcttcacgttcctgctagcacttgttattttctgttgtttttctttgctaatggccatagtaatgggagtgaagtggcatctcattgtgattttgatctgcatttctctgatgactagtgatattgaacatcttttcatatgcttattgtccattatccattatgtatatcttttgggaactgtctattcaattcatttgcccatttttttttttttttgaggcggagttttgctctgtcacccaggctagagtgtagtggcatgatctcggctcactgcaacctccacctcccaggttcaagcgattctcctgcctcagcctcccgagtagctgggattacagatgcgcgccaccacgcccagctaatttttgtatttttagtagagacggggtttcaccatgtttgccaggatggtctcgatctcttgaccttttgattcacccaccttggcttcccaaagtgttgggattacaggttttgagccactgcgcccggtgctgctttgcccatttttaaattgggctttttgtttaacctctctctagtactgacctgcttgttgtttctatgctggtgaaggtgtcctactcctttaactttttactgcctgtttattgtctttccagttgtccccatatcactttctccaccccaattataatacacagtctgagtccctttgtatgtcttctttgtaatcactatattgagagatctttcaatcagaatgcttttcactgtttctatgcaaatgacttagttgtctaccaagtagaggattatttttattaaatcatatatatgtactttgcattatgcaataggtgtgttctgaagaagttgtgtaaatatttaataattgtaaatcagcatttcatattctttggaaattattttttaaaaatattttttcacagtttgtattatttaagtttccatttttattttagggtacatgtgcaggtttgttacaagggtatattgcatggtactgaggtttgggcttctgctgatcctgtcacccagatagtgaacatagtatccgataggaagtttttcagcccttgtcctctccactccttccttccttttagagttcctagcgtctgttgtttccatctttatgtctgtgtgaacccagtagtcagcccccacttataagtaagaacatgcagtgtttggttttctgtttctgtgttagtttgcttaggactatggcctccagctgcatccacattcctgcaaaggacatgatcccattatttttttatgcctctattctgttccattggtctgtgtgtctatttttgtaccagtaccttgctgttttggttacagtaccatgtagtatagtttgaagtcaggtaaattgatgtctctggctttgttctttttgcttagaattgccttggctatttaggctcctttttggttccatataaattttggaatagtttttttctaattctgtgaaaaatgatgatggtagtttgataggaatagcattgaatctgtagattgctttgggcagtatgaccattttaacaatattgattcttccaacctgggaacgtggaatgctcttctatttgtttgtgtcgtctctgctatcttttagtagtcttttgtagttctccttgtggagatccttcacctccttggttaggtgtattcctaggttgtttttttttttttttttggtaggaattgtaaatggcattgcattcttgacttggctctcagcttgaacattattagcgtatagaagtgctactgatttttgtacattgactttatatcctgagactttgctgaaatcatttatcaggcctaggagtcttgacagaatctttaggattttctagtatacaattatattgtcagtgaagagagataatttgacttctttttttcctatttatatgtcttttacttctttctcttgccttattgctctggctagggcttccagtgacataatggataggaatggtaagagtggacatctttgtcttggtccagttcttaagggaatgcatctggcttttgcccattcagtatgatgttggccgtgagtttgtaatagatacctcttattatgttaaggtatgttcctttgatgtcaagtttgttgtggatttttataatgaaggagtataggattttgtcaaaagccttttctgtgtctattgagatgattatatggtttttgtttttaattctccttatgtggtaaatcacatttactgacttgcatatgttgaatcatccttgcatcctaggaataaagcccacttgatggtggtgaattaattttttgatgtgctgctggatttggtttgctcatatatataaatttttttttcttgagacaggcttactttgtcatccaggctggggtgcagtggtgcagtcatggctcactgcagccttgacctcacaggctcaggtgatcttcccatctcagcctcctgagtagctaggactataagcatgtgccactgtacctggctaattaaaaaattttttttggagagatgggatctcaatatatgtcccaggctggtgtcaaactcctgagctccagtgatccttctgcctcagcctccccaagtgctgggattatagatgtgagccattccacctagctcagtgtgctaatattttgtggaggaattttgggtcttatgttcattagggatattggcctgtaattttctttttttgttatgtctttgccagattttgatatcaggatgatactggttttgtggaatgagttagggaggaggccctcctcttcgattttttgtaatagttttattaggactggtagaattcagctgtgaatctctctctttgggggcttttgttcattggtaggtgtgtaatttctgattgaatcttgttacttgttggtctgttcaggatttctgtttcttcctagttcaatcttggaggttttgtgttttcaggaattaatcaatttcctctagattttctactttgtatgtactgaaatgttcatagtagcctctgaacatctgctgtatttctgtgggcttcgttgtgatgtcacctttgttatttctgattgtgcctatttggatcttctctctttccttttttaatctagctagcagtctgtcagtttcattcatcctttcaaaaaaccaattttttgtttcattgatcttttgtatggttttttgttctcaatttcatttagttctactctgactttacttatttattttcttctcctagctttgggtttagttttttcttgttcctttaggtgtgaggttagattgttaatttgagatccattttcttgatgtaggcatttagcattctaaactttcctcttaacactgcttttgccgtatcccagaggttttggtatgttgtgtctctgttttcatttttttcaaagaacttttttatttatgccttaatttcattgtttacccaaaagtcattcaggagcacgttgtttagttttcatgtatttatgtggttttgagagttcctcttggtgttggtttctatttttattccattgtggtctgaaaagatgcttggtatgattttgatttttttgaatttattgagacttcctttatgactgagcaggtggtcagtctttgagtatgttctatgtacatatgagaagaatgtatattctgtggttgtttggtagagtattctgtagatgtctatcaggttcagttggtcaagcattaaatttaagtccagaatttctttgttagttttctgccttgataatcagtctaatgctgtcagtgggttgttgaagtctcccactgttattgtgtggctgtcaacatcttttcttaggtctaaaagtaattgttttcataaatctgggtgctccagtgttgagtgtgtatatatttaaggatagttaagtcttcttgtataactgaaccctttaaaaattatataatgctcttttttgtccttttttacagtcgtttgtttaaagtctattttatctaatataagacctctgcttttctttgttttctgtttaactgatctttctccattcatttactatgagtctatgggtgttgttacttgtgagatggttcttttgcagataagagaaagagggattttgtttgttttttccagtttgccactctatgtcttttaagtgggccatttaggccctttatattcaaggttaatattgatatgtgaggttttgttcccatcacagggttgttagctagttgctttgtagtctcgattgtatagttgctttatagagtctgtgggttatgtgctttatgtgtgcttttgtgttagtaaatgtcattcttttgtttccatgtttagacctcccttaagcatctcttgtagggctggtctggcagtgatgaatttgcttagtaattgcttgtctgggaaatacattatttttccttcatttatgaagcttagtttggcaagatatgaaattcttggctggcatttcttttaagaatgctcaaaattggcccctaatcttgtctggtttgtaggatttgtgctgagaagtctactgttagtctgatgggtttccctttagaacaggggtcccccaactcctgggccacagactggtaccggtccatgaactgttaggaaccgggtcacacagctggaggtgggcggtgggcgatcaagaattacagcctaagctccgcctcctgtcagatcagcactgacattggattctcttaggagcgtgaacccttttgtgaactgcacgtgcaagggatctaggttgtgtagtcctcatgagactctaactaatgcctgatgaactgaggtggaacagtttcatccctaaaccaccccctccaaccctatctatggaaaacttgtcgtccacgaaaccggttccttgcgccaaaaagtttggagactgctgctttacaggtcatatgacacttttctctagctgcctttaaggttttttcttttgggtgaccttggatggtctgatgactgtgtaccctgggaatagtcattttgtgtagtatcttgtaggagttatctggatttcttgtatctgcatgttgatccctctagcaagattgtggaattttttctgaattatatctatcttcaaatatgttttccaagttgctcactttctcttctctctcaggaatgccagtaagtcacatatttggtcattttatataatctcatatttcttgaaggcttttttcatttttaaaaattatttttatttttatctgactgggttgatttgaagaactgatcttcaatctctgaaattctttcttttgcttggtttagtctgttgttaaggcttccaactgtattttgagattcctctagtaaatttttcagttccagaggttctgtttggttcttccttaaaataactgtgccgtctttcaaatcttagattatttttctgtttcctttgtgttggatttcaactttctcttggatcttgttgagtttctttgccatccatattctgaattctgtatctgttatttcatacatttcattctggttaggagtaattgcttgggagctagtgggaccttttggagtacaaataatttttaatgaatcttttagcaacgagaatgacactcttgaaattttctgccatgtaaatgtgtatcttctcatgatgggacagtcccatgttttcgtcaatactaaatttaatcattaatattaaattatttttgatttaatattgttaatgcaagaaatgcatattctaacataaaggcaataaatttggctttgggaccagttggacagtatctcttctctcccaaattggttgttttgtgtcagagaaattaaatgtcatctagagtgccttctgtattcttttactccctttccctttcctttatttccttctgtagatacttggtgcacacttatcaggtaccacttgagctgttaggaagtagtagtaagcacagcagacatgttcactgttcttttggaatttatagttcagtgataactagcattttaatgttagaatcatttagatttctgttttatttaataggaaagggtagataagagttttgttgattagaataggaagctatacactgtaaaacgtttattcagttatatgtatatattatctcaaattacataagatcatatggttgtagataaaaattttattattttgtcattacatactttacttgcatttctcccttgaacctacccttatcttcctttttttcttttcttcctactgttgtcttttcatttttttgtttcctgacagggtgtgtaggtgaatactctcccctcacccccctctctacctttggtttcctttcctttctcttccctatttttttgcctattttaggtgataccttgattctattaaccgtactttcacatcatccaaggatccagaggagtgggagaaatgggatcatcagggaatttcagtactgcttccaagacatggatttttactccatttgaaagttaagagttctctgctttgtggtcctgatacacattgaagggtggtggtggtataaggcatcctagaccctaaactggggattaaggtttattacagtgacagtttcaacatatttttgtcttgtcagagttattattctttaagacatgaacaagtgaagagaataaacaggtctcaacttctctagattaagcctgctggggtcacccctgatacttacacaggaaagaggcattcctactcttcgtctgtattctaaccttgctgttggtattgccaagtgctctgtacacatgattagtttggtaatattgaggaaataattatcattttcctactgacatacaaattatataaatatgaattatagttttggagacgtgtttccattaagtattgcttagagtaatacttactgagaaagaattatactacatttcatctttttaggattttaatgtgggatactgacaaatgcaatatttctctgtatttgtgtgggagaatttaaaggagatgagttaaattgatttattaatgattgaaagatgacatttacatttcagacttttaaaattgtggtccatggtagaaatattttcacagtgtgatccattatgcacatgtgtacagacacacacacacacataagtgaaacaaaatatacatgaaaccatacttattttccttatttgtgattcactctgacttctgttctatcacagtattctattctgtttcatcttttcgttaaaaaatgtgtggtccaaatccattacattgattttatgacccagtaatgatttgcaacttgaatctatagagcaataattactgaaccaggtgttggaaatccaaattctaacaaagtccgaatgcttctattgttgctacgtaataatggtgtgacctgatgtttgagacttgtgaggcttgaatcaattttgttatctctgaattagttataatggaccctcatccatctacttcacagagttctttttgaagatcaaaagggatagtgtatatgaacaatacatgtaaaatactaagtactgtagaaatatgaactagctttatgaagttgcttttgaagtaacatattgagactataaattagttcaggttcttacagaggatgcccgtttaatatttactattgttacttaaggaactttgagctgtggaaggatcgagcagttgtttttcatcacctgattttgttgtaggacattcagtaggatgggaggtattgggacgttacacagtacccaaaggaattactgtttctgtgcctgaacctgcttattgacagtttattgctagccaggggagattgctgaaaacttttaagttcttgcttatggctgctgagatgtcttctgcagcctctactggaagcaatatgaaaataatgagcctattaggactgtgatacattttatcttttctaatgatgaaaaacagttattttttacttcttcattttcccctatactgcatactagcccagtaatggaaaccatgattcacaagagggtagaatgagctgtttctggggcagagaattcagtcagcacatcttatgaaattgcacttaaatattgatgtttgtgcagatatgtatttttctggtaagatagttcatagttttccatcaaatgaaaataataactccttgaaacaaggattccttgatcgaaaataactgagaactgtggttcttaatatcagtgaccctcaagagtgtatcttgttacattgtgtatttagggtagtgttttgtttactattttctttatcatagcatattacagttctgcatttcaacctggaaccaaatgtagattatgatgtcttcctcccgtaatctttctacttctggaaagcttagttttagataagtctaattattgttagaagttcctcatcccactgatttaaaaaatcttttctttctttgaattctcatatcaccttatctataattttcttatggcacttttaaacttactgtgtattatcatagttattttgatatagttgtcgtatttccctactaaatctaagttttaaattcaagtatgtttcatctttgtgtgtctaaatgaatctagcagattctaacataagaatatccaataaatatttttgttgaatatgtgcttatttcctttcctatctcaaagatacttctgtggtgttaatactgaaatctggtaagctcagatttttctttcttaaaataataagtgttgtacttacaacttagcataagaatcaatgaaataaattaaaaagtgaaagtaattaaatgctaatcaaatccaacttgaaagagctgtcatccctcacagcttgcctttcaaacttttacttagcacaatttatttatttaacatttaaattttaaattgatataatttatattatttatttattttttggcactttagttcctgttccttattagagatcagaaaaatcagtagtgggcacccttaattttggcctcaggatatagtagctttggtttgctaattggggatgaaaactgttttaacagacaaccattaagcattattgaagatatatatcttaaaagcaattgtgtggacttactctgttggtcatagtaagttttattttattctaagccagtaatagtaactatttgtgccagagatttaagctagcatttattttaggagacataaatagctaggtgtgcatagggtaggaaggtggaaggaggtatactgagggcaggtatttactctaatttcatgtgtataacacttaaaaatttacatttttggaggaaatggtgtctctatcaggtttaaattttgaaattatgtgtcgattgatatttttaaaaagaaagacaagtcatacctgacttataaaataaatatgcattttagttaaattgctgtagaatagaattcagctgtcctagaagactatattaattacagattaattatttaattttgttaacttggttttaagtataactttcacatgaatagaaccatctttattacatctgggatcatttaatttgcataattaaatgtagttgtgctatgcaatgcaaggtaagaaataaatgattagcggtgactttgtaagcatttcggtaagtgacttataaactgaaggtcaccattttaattggaatgctcgtgaatctcttacattctgtaatcaaatgaatgatatcaaagaaagaagtaatttaacataacaattgtggcttacactgaaaatatgttcctgttaataagttgcatcatgatctttaaggacttgtatgtagttagtacattttggttcatttgatatccatggtttttcttcatttttattagtgagttgttacagtggttaacaagaaatacacagatttaagctgcaatagttttcccagggttatatgatctaacttcacaagcttcttgaacatatgtagatgcttttctattttgctttacttatgacatacaattgatataggcaagcatgaaagcttgggcagattttcattgctttttctggatcttgctcaggttctgtggtatttatgtaaagcacaattttgttacttgggaatgcatgttgaaattatcatgtgcactattttgctgtaggcccgttggcactgccacaaaggtaatacactgctagtaggccatttccttgtcgactgcatttacaatttaatagaaatattacatgactttttaaacaagtgttttggcagggaggaaatggcagattccatacaaacaagcatagcttcctttcctaaaccacactccagctactcaagaaattgtagttggtttcaagtttgggagtttaggggtagaatgggaagtcaggttgaaacaggaatgacattgatatttactgtaaaatagttatatatttttagctgctgaatttcattactgtatagtttgagtgacactagtatatttctgaataagtgctgagattattttcttaaacattcattttaagtattatggatatgtagtagttgtacatattatttttatacagttcatctgactggcctggttttgattggttgaaaaggtcaggaccaccagataggctttaacacttaaacattattaaaaaatttatatttttatttttttttacagttttggctttgctgtgtaaattggtccttcatgatacttgcctaagttaagctctacttcttttatgtcaactcttattgtatcttgaagatgaatcgctttgggggttagagagtatagaaaggtggaggttagaggccgggtgcagtggctcacgcctgtaatcccagcactttgggaggtcgaggtggttggatcacaaggtcaggagttcgagaccagcctgaccaacatggtgaaaccctgtctccactaaaaatacaaaaattagccgtgtgtggtggcacgcgcctgtagtcccagctacttgggaggctgaggcaggagagttgcttgaacccagaaggcggaggttgcagtgagccgagatcatgccactgcactccaccctgggtgacagagtgagactccatctcaaaacaacaacaacaccaaaaaaaaaaaaaaaaaagaaaggtggggttagaaactatagaaggaaaatttggtagactaattaaaactgatgtaaaacataatggattcccaccacatcttttgttcagtttctttttatactctattatgtatttcaaaacttgaaaggtcatatttataattttttatttggaagttattccatcttattcctctgttattttatttagttctctggatcttaaatcgtttgtagttttggataaaatgttgccttctttaattccaaagtagtttatacttttagaaactgtgtacagagaaaaaattgtgctttactttcagcctttatcgttgctacattctactttctagtatagatcccaactttgtcttctgtagggaaagagaacagtttatagttagttctttctcctttttttcttattgcttctgacttcttagccaacttacctggcagctgtagtaagttatgctgctgcggtgtggtagagactggcattgggtgtgttcttatagccatcatagcatcggcttttgttattttccatgtttcagtttgttggtaatggacatatggacatcatatgttccacagagtagtgtatgaagccaatttgaactgtttccatttgcctcaagttcaatcatgatatttatttttccatggcacttacccagattatccatacctcctgcttagctctgtcactgccaccatggactgtatttcttctgattgcctccattttttcacagtatctaattgcctttccctcttagctctgtctgcacagcattgattgatgtttataaaagatccaaagatctttcagataacagatactcaggtgcatagtagtatgatattcagctagttttttgtttgcataaggaaagttatatatccagtttcacagactggtattgaatattctaatggaaaagttagaagagtaacaatatgattttagacagttttgcttactttttagtaccaacaataacagcaatatgatctcagggtaccttacctttgttataccaaatcaagtcataattttattcataaattttgaagctaagatcctagatgctcccttttaggcttgagaaaatatgtctacattattgtttactatagctgttcttcagctctcttgccctatgcaaagtcacttagaaagtcattgattctcagaatatgaataaatgtgttgctatcatttcatgacattcattgagccaactattactgtaactgagaagctgtgggtttaagcttgtggattcactggaatgcatttatccatttattcagtagatatatattgagtacctaccatgtgcttgggactattctaggtactagggatgcagcagcaggaaaaacaaaggtaaaaatttctctttattgagtttatattctactgagggagggagataatatcaaaaataaataaatacatcatgtgtcttagatagtcataagtgctagagtagaaaaaataaaacagggaaacaagataggaaatttcaagggtagggtggagtggttgatgtgttgtgttggattgccagtgaaggcctcattgagaagatgatactggaataaaaagctgaagaaaatgagggtatctggatgtagaatatctaggcagagccaacttactgcaagttctgtggtgctgaagtgggagtgtgcatggtgattcctggtccagatcatagagcctagaaggtcacaatcagtgcttagacttttattctgaatgagatgagaagtcacagaatttctaagtagaggagtgacattagagccagaaaggtggtaagggtggaattacatagactagttaggagacttttgcataaaccgagagatgacggtgacttctcttgaagaagcagtgaaaatagtgagtagttgaattctgttatattttgtaagtggattaacaggatttgctgatggattaggtatatgagagcactgacaatgctaaagagttactctgcacagctttgaaagatggtcctttcctagtctatcaaaatataagcaggaaggcagaaatggaatgaaatatagagtttattcttccacaaaactcaactgtaaatgtgatgcatgtttgctatagaaaggaataaaggtataaaggaagaaaacaaagtataaggaagaaaataaaaatacttgtactacctcaagatttaccattaacattttgatatatgggcttctgtgtactttgtgtatctactgtgcccattagtacatactggtttttaaccaaaattggaatcatgagattacattgttttataactttctttttttcctctatcactacatcttgatcactttcccatatccttaagtttttgagccttaaaatactttaaaaattgctaaagtgaaataatttcatatacattctgtttttatgataaaactttaaaatgtatggtttctttgtttaaggcgaaaggaagcaacttatgcaaagaagccattactagtcattaatcctaaagtttaaaaaagtccatggttttaatttttcatactcataaattatttattaaatatcataaattatactttttaagaatttaagtattctgatgataagttttaatttaaggtgtagcatatcaattctctatggatttcatttttctgtttcttttctacaaattttatttccacatagaatgttaagaactctctattggaggaaattattattttttttaaccttaagaaactgatatttaattgcatttgtacatcctatctttaactttgtatcagtaagcagtcttaaccagctgagtgattacatcaagcctaaataattaaccatatcagaaaacatgcaattaataatgaacagattgttagatacttccttctatcagtacaatcattttgaaaagaaaacattctaaatgtttttttcatttaaaatgtattgtacctgccaaaaaatacaaatgtggttttcttaaccttggacactgatatatacatgtgcagtagggaagcatacttctgttgccagcttcttagttactggggtaggcagaattgttctccaactacctgactccttctgcaacctcttgtgctgatggtattcatataaaatgtaaaaaacattttcaaatgttttgcgaagttttgagaagaaaagttctgaaaaattcctaggagagggaagaaaaagggtgaaggcagaatgacaagtacccatatttggagatttggtggaaggagataaaagagaccagagagtaagagaagaattaggagagtttcagccaagggagaaaatagttttaaggaggttgtgattgatgaccttttacaaatgtttgtcctcttctctgtctccatctccatctccgtctccttctccttccttcttccttcttccttcctcttcctcctttgtctttcttcttctttcttcttttttgcctttagtttgggtagtatgaataataggttatcagattggaggtcatggttaactttcaggagtgtaattcagtcaagtagcaggctgaagtcaattcctgggggatccagaaatgaagttcggtagccaagaagaggagtaagttgggtggcggtgggggcggggggtgggggtgcggtgagatttgaaggtttgagagtccagggaagattttaatggcatgaggagacttagtctgattttagaatgagatgtaggacccagaggagaggattaaagatgtaaggagtagggccaagggcgacagataatgaaacaaggccccagtcaggtagcagggaatgtgactgaggatttaagtctagtcatcaaccatggggaaagtagatttaagcatactatgtctataacctgctcctgccctggacatcaagtgttacatttgaagagctcactgcttattaatgcagaagcagtatcaagcattttatatggttgccagacttaggcagggccagtgggttgaaaggcagtaatactttgctaggcaataattggtttaggggtgctggttagctgtagtggtggttcagttgcttacaaagtatttagaagcctctgagcaactatattctgatctgccttaaaaataatttagagtgaagctaattactgaaagaccttaaccagcttttaaaaatattgtggaaataagcataaattcaccattttaacatttttaagtgtacaattcagagatgttatatacacatttacactgttgtacagccgtcactaccatccatacacagaacttatttttttttacttttttattgtggcaaaatacacttaacaaaatttaccgtttaactttttttttttttttaaagatagagtttcactcttgttccccaggctggagtgcaatggcatgatcttagctcactgcaacctctgcctctcaggttcaagcgattctcctgcctcagcctcccaggtagctgggattacagtcatgtgccaccactcctggctaatttttgtatatgtagtagagactgggtttcaccatgttgattgggctggatggtctctaactcctgacctcgggtgatcccaaggtgctgggactacaggcgtgagccaccgcgccccgccccatttaactgtttttaagtggcattaaatactttcgtattactctgcaacatcaccactattcatctctagaacttttcatcatcccaaactgaaactccatgcctgttaaaacagttacttcctactactttctcctctagcttcaagttagaactattgtattttctgtttctataaatctgactattctgggtacctcatgtaagtggaatcaagaaatatttgtccttttctgtctggctgctttcatatagcacaatgtattcaaggttcattcatcttgtagtaactgtcagaatttcatatcctttttatggctgaatagtatttcatttatgcgtacacatcattttgtttatctgtgcatctattgatggaaacttcgattgtttccaccttttggctcttgtgaatcgtgctatgaatgtggacacacaaatattctgtttgagtccctgcttttttttttcttttttgagacagagtctcgctctgtcacccaagctggaatgcagtggtgcaatatcggctcactgcaagctccgcctcccgggttcacaccattctcctgcctcagcctcccgagtagctgggactacaggctgcccgccaccacgtctggctagttttttgttatttttagtagagagggggtttcaccgtgttggccaggatggtctcgatctcctgacctcgtgatccacccacctcggcctcccaaagtgctgagattacaggcatgagccaccacgcccagcccgagtccctgcttttaattcttttaggtatatacccagaagtggaattgctggatcatatgataatttcatgcttacttttttgaggaaccaccatactgtttttccatagctcagccattttttttatagacatacagataagatggcatataaaatgcataatatttgtattcaaagatttatggaactcatgacgtgcaagaaaatcacatctttaggttgaatcacatttacatcatttcaggaagctagctgacttatttgtttaaagatgttaacagaaaaagataacatgtatatttttaatataacaattcttgtagttggagagttctttctcatatatagtgtagtgtagtgttattaacattcttggcatgtttgatataaaatctgtacagtgctttattttccacaagccttgttcatttgaactacttttattcatgaagcactttatgtatatttttctttacttgttaaaacatttggctgttttaaggagcttgacctaaactctgtgcttttgaaacagtgaaggctacatgcatcatgccacaattctttgactgcgtcaacatatgtttgaaagtttattctaataatttaattccatattaaaattaatgacagttttctcttttgttgtttataaatgtgtatgtgaaatgtagttaccattcccgacaggaacttttggtaacacatttaatagaaatttataagataaacattagtcatgacaaagaaaacaaaaaaacagccttcttctaatagtaaaacaaatatgtgaggcaaagaaacggaagatacgaattattctcttgcttttgaatatttcatgagttttcttctgagatattagtagaaagtacctcatagtctctcctagtagctttttatttgaagtgaagggtttttagacttgaccttttggctgctataattatttgggaactgtgatctcttcatttgttgacatattctttaaactatagtataaatgtgttaagtttgatatatagaatgcttttttactttgacctttttttgcctcaaaaatgaattcattgatttctcatatccacaaatctagccctatgattttgtctttttaaaatttgctttccccaggctgatccagttctaaattccatttttgtatcccattatgaagatgttttctcatttttttctgattcatcacaaattgaacatttcattgagtttataaatatgtgtatgagtcttttagtggtattttatatattgtttaaacaactgaatgtaacaatataatatttataatttgtggggttaaatttacaaaataattctttggttgtccttttgtgtatattttcttcatgcatgtcatctctttatttcccagatagtttaacacataagcactgtatgttaaaataacataacttggatgacatatagcagtaaatgtacaaaataaatttttagtttccatttttcatatgcattttctctctgagtgtctcttttggaggaagcgagagttccttgtagatgaattacataatttcatgctgaatttaggagaaataaattgttaaaatgagtacttaaaagaaaacataaactccaaacctatgtatatttattttaatctttggaatgtagcatagtattctacatatttaccagtttatgtggcattgataattattacagtgtacatttactgaactcattttgtatcactgctattgttctaagtatttttttggatggtgttaataaattgttttttatttctttttttaaaatttgaaattattgagatgaatttcatataacatataattaaccattctaaagtgaacagttcagtggccttcagaactcttatctagttctaaaacatttctttcactccaaaatacaacccggtacttgttaagcattttatccccattctccaccatcccacctgcccctccccacccctccgatcctggcaaccaccagtttgcattctggctttatggatttatatattttatctaaatggaatcatgcaatatgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccccccacacccaccgcccaccatgtctcagccttccaaagtgctgggtctacatatttgggaggctgaggttgggggatcacttgagcccaggagttcaagaccagcctgggcaagtttgagagaccctgtctgtgttagttcattctcatggtgctatgaagaaatacccgagactgagtaatttgtaaagaaaagaggtttaattgatgcacagttccacatggctgagaaggcctgaggaaacttataatcatggtggaaggcacctcttcacagggtggcaggagagagaatgagtggcaagcaaagggggaagccctttataaaaccatcacatctcatgaggactcacttactatcatgagaacagcagggggaaactgcccctgtgattcagttatctccacctggtcccacccttgatacctgaggattattacaattcaaggtaagatttgggtggggatacagaaccaaaccatatcactgttatctacaaaagattttttaaaaagtagccaagtgtggtggtatgtgcctatggtcccagctactctggaagctgaggtgggaagaacttttgagctcaggaggtcgaggctgcagtgagccatgattacaccactgcactctagcctgggtgacagagcgagagaccctgtcccaaaaaaacaaaaaacaaaaaaaaaccccaaactaaaaaatttatatacaaaaacctcagcatatttgtcaaataactgtgtcagtgagttcttaagcattttgttttcatataatataaaatattttatttcctgctgtctttctatgtatacaaataaccaagttgctagtttctttgttgtatgagcttttatgtaatttatggcatttccatttgtatgtagctgtaatgaactttgtctctgctttgttccttaccatggaaatgggttttttccccctcagatggattcagacaatagttctgggtggtaagtctccatgtaaggagttagcccttctatttacaaaggctgtccttaatttcataggtaatgtttctggaagttcagccattgacagaatgttataagagaaggttcttatcccacagagctttattatacattctctaatttcattttgccttatcattaatatatttttagtgtgttatacatgttacttatattgacttttcctttaacatttaaatagtgttgatgcaggatttttcttggcccctttgctgggctcgcaggagcaggtgccccatttactcagcctgccaggccgcatctggcttgcactccagtgtggatcccacagctgccacaactgcacactcagcccccacattcagtgggtcccgagttcttgtcccatgtccaagaagaatgaggtatcactgacaattgaagggtgatgaggacagagaattttattgagtgatgaagcagctctcagtctagagaggggacaggaaggtggtctctcactcgaagttgggtcatctccctcagtgtggctggatctggggtttttatgggcacaggatcgggggggcccatgggccacaggtagtattggaaaaggcaacatttgattggttaaaaagcattattcagaaagaaccagttgggaaagagcaggcaaacagaaatagaagttctctctctgggtcatgggtttcaggctgtttttgacttgaaggtggggtttcaccctgtctgactaggatttttctgcttcctgcctctatcagtgttgattgacttaatatttagtgagcttccatttgagcctaaagatgttatattaaatctaatgatttttatttgcatctagattattgcttatcatgtgtcagtacttctttcctgagtccatacttctttcattttttttctttttttgagatgaggccccactctgtaacccaggctggagagcagtggtgcgatcacggttcactgcaacccctcgagcctgggcacctgctcgcctcagcctctggagtagctggtactataggcacacaccaccacgcctagctaatatttctattttttgtagagatggggtttcaccatgttgcccaggctggtctcgaactcttggactcaagcaatccacttgccttggcctcccaaagtgctgggatttacaggcatgagctactgcacctggcctctattcatttttatatacagtgttgtgagtactaattttcaaatatttgttaacctgaaacccttcaaaagggttgaaaagttatctaaaagtacagttatctactacagatataggtggagaagcttatggtggaagaatgctagcagctacagccttctgaacatctcttcattttatcatctatcgtgtgaaagagatcttctatcgtttgaaagggatctttaatctttcctgtgtttgggtatcttcgaagggctaggccatacatagaacagggtaggagaaaggaggtaagtaaggtgaaaggagaaacagatttgtttgacacaagtgttgtagggactgatactttgttaccctcagttgtgtaacatgttgcttgattctgttgaagaccctgtattccgggtgttcattgattttttttgggatacttccttgacgatctgtacgaagcaccctaagagaacatgttagaacatgtagtttctctaaaaattccactttgaatttttggaagactgctatgtattagtcaaaaaatattttagataaatttctttcccctgccttcttattctttgactaattagtcaaatgtatacaaagggtgtcttcctgtatttgaaccaaccaaaaacacacatctgaactgtcagctaaggggtaggcttggtgttatgatcaattagaggagtcttgcttctagaacaatacccactagaacaataaaaaatccaagtctttttttagaactgttgatatgatttaaaagataagattaatgggccgggcgcagtggctcacgcctgtaatcccagcactttgggaggccgaggtgggtggatcatgatgtcaggagttcgagaccagcctgatcaatatgatgaaaccacatctctagtaagaatacaaaaattagccaggtgtggtggtgcgtgcctgtaatcccagctactcaggaggctgaggcaggagaattgcttggagccaggagacggaggttgcagtgagctgagattacaccattgcactccaacctgggcaacagagcgagagcaagactccatctcaaaaaaaaaaaaaaaaaaaaagacaagattaatttggcacgtgtaatcaagtagcagaggcagtttgaaagctgaacacaattgaaatataattggaattatacagaaaacacttatttcatattcttaaacaaggttttaattaaagtagaattgactcatctttttttgatgtgcctctgagaaggaaatttgtaacacacttcagttgatggttggctttctctgactttgattaatcactttcaaagtaagcaatagatgagtatagtaattttataattatatgcaagtgagattattttaaactaactgtaaaggaagttttatattgttcaacattatataatgctgtatatttttcttttactattaaaatacatgtagtaatctgaaaaaagattttgtattatttttataaatacaatttaatggaaactttaagctagaaatattagtttcaaagacatttatctattaatactgaaactttaagcttttttgaaaactagttgatgaaactaataaatattggaaataatccaactggtggagctgactgtaagttatgattccacactagtgaaccaacttgtgcctccctgaagcactgctaaaaataaaactttgaactgtctgaaagatttgaaatgacaatggaatttgattattcacagtcaagataaaaggactctcctcagtgcaagattaaatgcccctaaaagtttaagaagttttcacctgtcaaaactaatacaaagagaaattaattctgtttaaattaataatactgaagaatgtacacctcatcttacctgtatctagaatcctcactgggtaagtatttaatccattctgaaagaatcttaaacagttttattaagaagaacataaccaatctgcaatattacctatttaaaaatttcttatatgttcatttcttaattaaagcttttaacaaaagtaagtgtattttgtcactgaaactgtattaaacaactgagaaagtgtctaatactctaatgtatttttaagcattgattaacttttatatggtgagtcacttgcttcatcatctcttttaagagtaaaaataagtgctatttaatggtagaaaccaagtatttatactcttttcattaccaaaataagacacaaaaattaatggatttttttaacattgaagattgtagttcaattaagtttatgaggaaaagttatgattgtcatgttactaattgtatcactttttccttatatgttgtgaatttaacatttgttttgtacttcgttttttatttttaaaacagcataggctcaaaacaaagtaaaatctttcagaaaagactatcagagtctatacttgctctcttttcttattttgacttgccttttatacattcaatttttaaaatgatgctgcatatttaatgaaaaaagttttttaaaaggaagtgttgccaatcagtcaaaatttgttacagttaaaatttgatggtctacagacaatttataatccttttcttgttataaaatattgtcaaatttatagtagtatcagttagaaagtttatggaaacattgtttaaggtggtttaaaatagaagtaaatctttaatttgaatttgatgacacctgttttcattttgttcccccggcaacactgctagtaccaaaattgcccatagaccaccctggtttttgaaaagaatgaaatcattctgttttttaaaaattttatccttttactgactaaatatttaaacagggttataaaacatctgtcagagtttgtgaactcatgttggagtaaaagagtttaggacacataattggaagttttgcatgaaaattcctgagtagttttagtttgtctttcttagttatgctgaagtttttattagaattataattagaaattagaaaagtaattgacagcaacaatggaaaaaatatctggactcagttgttttggaaagctatgcttgctttccttcagttattgacaattgagattttttaaaaagacaatatgatccttttctctggaaggctctgggcagtcaagatatacgaattaaggtttacactgttgagactcctgtgagagagaggtaaagctgacacaaatgttatcttttctagcattttttccacctgctgtatgattgattcatgtgtttgggacattgtaaaatgtcattattctatcttttttagttgtgaataattgagacttagatgtaataaaacaagtggctgaaaattattagtttttcatgtccagagaccagaattgtttataataggcaaactgagccagacatgttagatcaatgtgtattcttttgataatttccttcatcagatgggatttattcctgtgttctccaaaggaaaatttatatgggaaaattttggtttacttttaaagaattgggtatttagaccagcaaatctttgttttatttacatttgccttgtgtattaagaaatataggttatattctgttatagaaatatttatgaggctaaatctctacacttaacatgattaggtataactgtatatagaactaacagagacactaaatatttaacatctattacaagtaatattctgctgctgttttttactataaggttactttttcttacagtagataaatcatttttcttattgagaagcatgtggctgaatatatacctgtctacccctaagttttcttgtatattactttattctatatgttactaggctaatatagaaaatgtccttggatgaatcagaatacctctgtgtgatttttttttttttttacatttacaaaaaccattgtgtcaaggtaaggagattattctggtttaatataatgccatttgaatgaggagtcagttttctttctggataaaccagttattaggtgaaatttacttcttgacagtgtccatcatttaaaagggactggaagaactcgtgttgaagtttccttaaaaatcaggatggggccaggtgcggtggctcacgcctgtaatcccagcactttggcaggctgaggcaggtggatcacgaggtcaggagatcgagaccatcctggctaacatggtgaaaccctgtctctactaaaaatacaaaaaattagccgggcgtggtggcgggcacatgtagtcccagctactctggaggctgaggcaggagaatggcgtgaacccaggaggcggagcttgcagtgagccgagatcgcgctactgcactccagcctgggcgacagagcaagactcggtctcaaaaaaaaaaaaaatcaggatgggtactgggtgtggttgtggctcatgcctgtaatcacagcactttgggaggctgaggtaggaggattccttgagtctaggagtttgagaccagtttgggcaacatagtgagaccttgtctctacaaaaaataaaattaggtgggcgcagttgcacatacctgtagtccccagctgctccggaggctgatgtgggaggattgcttgagcctgggaagactgaggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcccgttctgtaggttgcctcttcactctggtggtagtttcttttgctgtgcagaagctctttaatttaattagatcccatttatcaattttggcttttgttgccattgcttttggtgttttagacgtgaagtccttgcccatgcctatgtcctgaatggtattgcctaggttttcttctagggtttttatggttttaggtctaacatttaagtctttaatccatcttgaattaacaggaaggggaacatcacacaccggggcctgttgtggggttgggggaggggtgagggatagcattaggagatatacctaatgttaaatgacgagttaatgggtgcagcacaacaatgtggcacatgtatacatatgtaacaaacctgcacgttgtgcacatgtaccctaaaacttaaagtttaaaaaaaaaaaaagaaatacagcttgacatatagcacattatacatttttaggtctgttggaaattttgtggtttcaaagccttcataacacatttgcaaaacagtagatagagtgttatttaagctttacttttaaaaaactcattttcactttttaatccatggtgttaaaaaaatccctccaatactgttaataagacaaaataagtttaatagtcaaggcctacatatggatcatagatcatattgtttaatttgctgcaagattacttgggaattccacatcagaatttgaaagaagctcattttctggttgtaaaagttttggggagggtctccatttttttgctggatcccacttgcttgaataaaatattttgaagaatgaactacaaaaattaagaattacattagtatatcgatttacttatttttactgattacaaagtaaagattaattttggtatttcagttttatcagattattaattttgatgtttgtctttgttatagatagtaaaaattgaacagcttctccatgggtctctcaatgtacaacctgcttcatcctttcattcatttttttcaaacattgattaaacacttactccatggcagacattttttgcgtatactagggacaaaaaataggagtaaggaaacaatctttatgcttaagaagcttacagtctgtgggataaatacatagcaagcaggtgtttatagtacattttggtaagtactgtggtaattgtgactagaatctatgagatgatataactcagcattattgggagttagggtgggtggtaggtataggcactgagtcctgaagactaaagaagtagagatgggggtagacaaagtaaggtttttctaatcagagaaggtaagcatgtataaaagtagatgtgtggtattctgggatcctaaataactcttaagggctgtagcagagaatgtgggtgtagattatttatgtatgtggtgattctaatactggagacagaggtagtggtcatgtcctgacctgtatattatttgggaatttaaatttttcctccccgaagattatgggaggccacttgaaaattttgagcagaatggtgggatctgatttttgttgttgttgttatgtcactaatggcatcagtataggaaacagattaaagtggagcaggactaatattaggaatacccattaggaggctgccaataatccaggggagaaatgatgataccctggattaaggtattagctgcggtgatagagaaaaagggacaggtcccagagatataaaagaggtaaaataagatgtggttagtattttaaaacttcattgagctaaataatcaagttataagagtactatatgcctatgacatgtgagggatagttcatctaccacagatttgttttgaagcatttccttattttcaaagaggctgtatttcctttagttatctctattctagaagtgaaatataaaacgtacttcttaaaacaggttcagtatttacctattgaattgtagcgtgacattttaaaaattgtaatttatacttatggtaggagtgctctaaagagttacaaagaaaagaaaaaaatacatttatactgtcttttacatttacctctgtagttacctttgctgtactcttgatttcattgtgtggatttaagttagtatctagtgtcctttcatttctacctgaagaacttcctttttgttttttgcagggcaggtctgctagcagtgaattctctcagtttttgtttatctgggaatgtcttaatttcttcttcatttttgaggagggagaggaagtcccaggtagcagaggcttctacagtgatgatgggaaagtgaagagaagagggaagggaaaacctaatgtgatatcttgactgacaaatactggatggaaagttgtatgttgggtactgattgcattggtaaagggcttcaaagcagaaagtcttggcttggaatcctacaacattggtgggagaggggtgaatgaatatggctaagggacagttttaagaaataaagttgatagtgtttgtcagaattgatatggagagagctgctatatcacattcatggggcatcagatattaaaacctttggcttccctaaagttgtaacacataacatacatgttttacctgtaagatgtaccatttctttgcccgtaagaaaaattgtgcacagatcttccatttttactttacattcttttaaaaagctcttatttttaattgtggttaaaaaaatttaccatcttaactgtttttcagtgcacagttcagtagcgttaaatgtattcagattgttgtacagcagatctgcaggattttttcatctagcacaactgcaactcttacccattaagtaaccactccccattgcttcctccctccagcccttggtaactaccattctactttctgtctctatgataatttaactactttagatacttcctgtaagtgtaatcatagagtatttttctttttgcaatgggcttatttcacttagcataatgtccttaagcttcatctgtatttagcatgtgattttcttcctttttaaggctaaataatattcaattatatgtttataccacgttttgtttatccattcatcgtcttcgttcattttttggttttgtttttagtatagattatctttcctttttacccactaaatttctttatctctaggcttcagcttatttagggacataaaccatttgcctggtttgttctttggaagtcattttattttttgtttttgtttttatttttatttgtttttttaagctacttcctaccgaaaggatggaagtcattttaatggttatattttccacctgttttgcagctatattgctaacttatgtattgctatgttaattatacatctagaaaactttgagttattttattagttttcttagatatttaattgattggaagtgtttttaagaaaacttggagtttgctagttaaataattatcaacaatgtagctaataaattcttttctactagcatgcaaactctacactgcatcggttcaaattatagcacctaatgctgcctcaaggcttgtgacattataacttttcaactgagcaatgcttaatttgttatgaaagtaaaaaaaaaaaaagttaagtaattccatcaaaattgtattgctgacatctgtttctgataaaattttagtaatatgataagaattaaaagcattgtgtgatactggtttctgagtctcatgatagtaaactgtagaggacttgtcttttgtgaatcatttgtatatgtaaggtgttattaagtccaaatggaaaagaaatttggtgctgagagacattaaagcaataactgagtttctttttgacaccaatcttctgaaatatcctgttaacatttgttaaataagtgatatattactccttgaattttgcaaaaataatgaaaaattgtatgaaagaatttttaatacagtcatgcattgcttaatgatggaaatacattctgagaaatctgtgaagaatatcatagagtgaacttatacaaacctagataatatagctgtctgtacacctagggtatatggtatagcctattgctcctagattacaaacctttacagcatgttactgtactgaatactgtaggcaattgtaacacaataagtatttgcatatctaaaggactaaaatgttgttaatgcagttgttaatgcagcgcatgttgtatttagggcataatttttttctaaagccatataatattttaacataaacaggtcagtgtgtttgacccattttttaactctgtgacatgtggaattgtttcatgttaacctgtggatttgtctcattagtaattcttaaattactaatattggaagaagagctatgacctttgagatcaaaatgtatttggaggtaatgaagttatttaagaatcctcttgaaaccaaactggtggtgagagggaagaaagcagttcaatagggggtgattgaaaggaaaaaagagacctagaagggaagcgtcagcaagaaagagtcaaagagcaaggaaagaaagaaaaatgaggtagttaacaggaggtaaaagtagtagtattgagaagagaagagaatgagggctgaaagggagtaaggttcttaacttcttacatagtttgggttggttgccttttgatctctcagaactaggaacagatatgtttgctttagtttgctgttgttgctgagcaactttgtcactggtgcatccactagggttattgcaagcatgaccctgcaggtactaatctcagcagcactcccacttcagttaactccatagccttctctgcctgacctgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtggtgacaaaatctctcagcatttgcttttctgtaaagtattttatttctccttcacttatgaagcttagtttggctggatatgaaattctggtttgaaaattcttttctttaataatcttgaatattggcccccactgtcttctggcttgtagagttttgccgagagatccgctgttggtctgaggggcttccctttgtgggtaactcgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctggataatatcctgcagagtgttttccaacttggttccattctccctgtcactttcaggtacaccaatcagacgtagatctggtcttttcacatagtcccatatttcttggaggctttgttcatttcttttcattcttttttctctaaacttcccttctcgcttcatttcatcttccatcactgataccctttcttccagttgatcacatcagctcctgaggcttctgcattcttcacgtagttctcgagccttggctttcagctccatcagctcctttaagcacttctctatattggttattctagttatacattcgtctaaatttttttgaaagttttcaacttctttgcctttggtttgaatttcctcctgtagctcagagtagtttgatcgtctgaagccttcttctctcaactcgtcaaagtcattctccgtccagctttgttccgttgctggtgaggagctgcattcctttggaggaggataggcactctgctttttagagtttccagtttttctgctctgtttttccccatctttgtggttttatctacttttggtctttgatgatggtgatgtagagatgggtttttggtgtggatgtcctttctgtttgttagttttccttcctacagacaggaccctcagctgcaggtgtgttggagtttgctagaggtccactccagactcggtttgcctgggtaccagcagcggtggctgcagaacagcagattttcgtgaccgcgaatgctgctgtctgatcgttcctctggaagttttgtctcagaggagtacccggccgtgtgaggtgtcagtctgcccctacttgggggtgcctcccagttaggcggctccagggccaggggtcagggacccacttgaggaggcagtctgcccgttctcagatctccagctgcgtgctgggagaaccactgctgtcttcaaagctgttcagacagggacatttaagtctgcagaggttactgctgtctttttgtttgtctgtgcccttcctccagaggtgcagcctacagaggcaggcaggcctccttgagctgtggtgggtgctacccagttggagcttcctggctgctttgtttacctaagcaagcctgggcaatggcaggcgcccctcccccagcctcgctgccaccttgcagtttgatctcagactgctgtcctagcaatcagcgagactccgtgggcgtaggaccctccgagccatgggcgggatataatctcctggtgcgctgttttttaagcccgtcggaaaagcacagtattagggtgggagtgacccgcttttccaggtgccctctgtcacccctttctttgactaggaaagggactccctgaccccttgcgcttcccgagtgaggcaatacctctccctgctttggctcgcgcatggtgcgctgcaccccctgtcctgcgcccactgtctggcactccctagtgaggtgaacccggtacctcagatggaaatgtagaaatcacccatcttctgtgtcgctcacgctgagagctgtagaccagagttgttcctattcggtcatcttggctgccctccgggccattcttcaaaagtaaacattttaaacagtggaatgctaatgttatttctaataacaagtatgtcctctattatcattattatcattatcgttatttagttttgttctagcatgttgaatgaggtaaaaaatgaaataatctgtatgaacattagaaaagaagaggaaaaatacattttattttgctgatatgattgtatgcttatgatatccaaaaggtaccagtaaaatattatcagacttaataacataatttggtgaatagttgtatataaaatacacagaaattggtagcctttctcagtgctgataataatgttattaaagaaaaattggaaaaagtaatcaattaaaagtagtttcaaaaactagaaaatccttaggaataaagttaacaaaagaagtacacttctgtaggaagaaattcgtaaaaatctaattgaaagacattacactggaattgaaatgaaggaaagagcatgctggctttaaaaatatgttcccaattcttataatattgtgttgccatgcaaaaactatatcataataatcttttaccaaaaattgtttaaaagttaattgcagttctagttaaaattcctttatggtttacattggaattgggtaacataatgttcatacttgttgactaagaaaattatggagaaaaaagtgagaaatgaatagctttaccagatattaaaataaattctaaagctactgtaattacaatagtctgttgggaatttaatatgataaatgtgaaaatttgagctcaatgggaaaatgataatcatgcatttggaattatctgttcatctgaaagaaaattgaatctttggtctcttacaatacctaaataaattctaagtatactagagacttacatggaagaatatgaattctggactatatgcatgaattagaaacttgggagaagtttctaaccaacataggaaatgcaggagctatgaaagaaaaataaatctaatcatataatgattttttttgtaacttatatgtgggatctcattggcagcaaactcaatagataagcggtaggttgggaaaaatatttatacttcaaattacagataaatggttgatatctacgatattaaaaaaaactacaaattagtgtcaaaagacaatccagtataaaaaacagggagagagatgaatagttgacagaaatgcgaatcccaatagactaatgacacataggaagatgattaatagtactttaggatatgcagattaaagtaacattgagtttttttttttttttttgagacagagtcttgctcttgttgcccaggctggagtgcagtgcacaatcttggctcactgcaacatctgcctcctggcttcaagtgattttccttcctcagcctcccaagtagctgggattacaggtgcccgccaccatgcccgggctaattttttttttttttttgagacggagtcttgctctgtcacccaggctggagtgctgtggcacaatcttggctcactgcaacttccgcctccaggttcaagtgattctcctgcctcagcctcccgagtagctgggactacaggtgggtgccaccacagccggcttatttttgtatttttagtagagatggggtttcaccatattggccagactggcttgaactcctgatctcaagtgattcatctgccttggcttcccgaagtacagggattacaggcttgagccactgtgcctggctgagatatcatcatatatccaaaattaaaaatgttatggctccactcaatattggtggcaaattagagcaaaaggcatttgtggtagaaatgtgacatttacttcttttcttggaaagcagttttggcagttttacccctagaatttatctcataaaaataaaagcataaatatgtaaggatatatgcatttttcaaagcaaggatctttttgcagtatttttattagtggtaaaaaactggaaacaaggtgggaaaagttgaatacatttgatacattttggccttgtaacatgcggccattaaaaagaatggagttctgtgtataccaattaatgtagttatattccactgtttgctatgagatgagaaaaataagatgtgaaggagcatatatggggacaacttcattcccaaagaaacaaaatagaattttaaatctctacatatgtttgtacgtggttatttaaggatggagaagaaggtatggagtgatacatattaggttgtcattgctggtcacctggagttgtagagaaaggtaggggaaaaatcaagaatgggaaagtaggagggatggaaaaagattcagtagttttataggcttgtatttgaataaagcccaagtagaatactgacagtgcattaataaaaggcattgaggcaaaaaagatacctcctgatgcacacaggatttatgggacacattaatggtctagagttgtattgtaaaaggtatgttagccacaatttattaagggttattaacaatttattaaggaggagacattagataatgacatcaaggctgggtgcaatggctcatgcctacaatcccagctactcaggaggcctaggtgggaggattgcttgtatcaaggaattcaacaccagccttggaaacatggcatactgtgtctctacaaagaaatacagaaattatctgggcgtggtggcacctgcctgtggaccctgagaggctgaggttgcagtgagccgagatcgtgccactgcagtccagcctgagtaacagaatgagaccctgtctcaaaaaacaaacaaaaagaacatactatatatttattgtattttaagatagtctagtatattttcatgtattcaaatttttattcggtgtctactctgccagatacctttctaggcatttgggatatatcagagattacatcctagaaggaggcaatagatataaaacaatatataataagtaatttatatagaatatgagaaagccataagtgttttggaaatgattaaagaaaactagagtgtacactaagaaggatacagggagttttggtggacaaatttgtgattttaaatatggtgttcagagcctccttgggaaggtgatatttgagtagaggcttgcaggtattgtgggagtaaaccacacatatacctggggagatcattttgggcagatggaatggtcaatggaaagcccttttgtgtttggagaggcagaagggagcagagtgatctagggacaaagaagtaggagataatgtcagagaaagacaggaagtaagggaggtgatggaggtaggtgagatcagtagtgccttgtagacagacccctggcaggccttgagcagcagagtgataagatctgatttacatttttaaaggattacttaggttttgttgagaacagattgtgggggcggggtgggcaaagatagaaggaaagaggccagttgggaggcctctgcagtaatccaagtgagagatgatcgtggcatgtgttaggttggtaacagtggaggtggtaagacctaatcaggttttggatatattttgaaacaaaaacccacagaatttttttggacacattggatgttgtatgtagaagaaagaagagtgaagttagctggagagaattactgtaaaacagaaaaaagcaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtcttctcttttgcataggctagctctgaatagagttactacaattaaatagaaataaacaattgaatagataatagataaaatacaattaaacaattgaatagataagtgggttattaatattacaaatattaagatactaagtgagcaaaaggaaaactgggtgttttctgggaactaggtcaagtacaaattgaaaccagtgtgtaaagtgcagtcaagaagggaatgagataataacaggaattcttgtctagaaaggggaagaccaaggaaaggaggtaacactagcaatgaaatagttcattacagtggtagcatttgaaaagttataaccttgaagagtttagtcatagcagtcagagaagagactgatgtccagctggctggctgactttttattttcccacacattatgtcatctgctcttagtgttgattcttagcagtttagggtagacttaaagtttgttcagaaaggtgcaattttcattttcttgaagttgacattgaaaagtggtgaagcacgactgggcatgatagctcacgcctgtaatcccaacactttgggagttcgaggtgggtggattgcttgagctcaggaattctagaccagcaacatggcaaaaccctgtctctactcgatatctatatctgtatctatatctatctatatctgtatctatatctatatatgtatatatatataattagaaaagtagtgaaagtgttttgtaaaatcagaaatctcattacatagttattcttcaagttgtatttactcatttttctattcaatcagtgtttactgaatatcaactttgtattcaagcactaggaattaaaagatgaatgaatcacacactctgtcataaagtacctcacagtttagaggtatgtcattatgtgagtacttgaaaatttcattttgattttcctcatagattcattcacttttgctacagtttaatatataatacagtgtttagcaagaaagggtgtctaatataaaatgtgccgtttagcctatagcaactttatatactttaaaaccttattaactccacagtatttgagacagcaattatttcttaggccttgtgtgttcctttaagtcagagatccaggtttgacatatttttgctagacattctgaaaatgttttgaagctaatattggagtccctgtatgtttaaggactctactgagtaggaggatgaacacgctgctaagacattactggtgatttttgattacaagttgatatttaagtctctgcttctagttctgctgtttaaatgagtctcgttcagcagagcaaaaattgaaatgttttaaatcattttggtacctgtaattgtccataaacaatcaatttcaactttatgaactcccaaatctttggtacaccaagggttgtactaataactgttctaattggtctttgtggctgcatgtttaaatgttggaaatgagactttaatgtgaacatgcagtaaatcttaaccacggaggcacacacaggtccccctgtaatgtggaccgggaaagagacacatgtaaacagacatattcctcatctgaatacgtggagccatactttcatagaattgcattcaatgtttatatatagagagatggcaatgaaaaactgctgtttgtatgggtttactgtgtattttgatctctaggttatttacttcttctaaatgtgtagggatgatattaaaacatgctggtatcagttaatttaattaaaataataaaaagttatataattggggaggagtcatatgccttcattgaccttaggagaaaaagattgttgagtaaaaatattttaatataataaatagttttggataatagtttttttgttaaacataaaagacatgaataatttaaagcttaagttatgatgtgattataatttctgttgcatttgggaccctttattcatgtgaatgtcctaaaaatatttggtcacagactgtaaacaacataaggaaatcaattttctcagaagcttttctaaagacttagaaatattaaacaaatgcattcaatacaatggatgccgtaaagcatcagataaaatattaattttaatttttaatctgtgagttgctctctcaaaagattatggatttaataacagtttattgaaatgagagctaaaagatgtgtctatacaagttcggtttcattcatactttgacttttaaagtcaaacactgattttcatcatgttaaacttctaaagagcaatgaaaagaagatttttggccagagtaaggaggcaaacattttataagaaggggaagttcagtagtgctaaataatataaaacttggctttaaaagaagtctttaattgaattatttatcagtgatgaaattgaacttatacaattcctctttaggttccaaataatgaagttcatttagtattattattattgtggttgttattattattgttgagttggggtctttgtctgttgcctatgctggagtgcagtggtgtgatcatagtaactacagcctcaaatatctgagctcaggagattttcccacttcagcccacattgacctgagtagctgggactacaggtgcatgccatcacacccagctaatttttaagttttttgtagaggtgaagtctcagtatgttgcccaggctggtctcaaacttctaggcacaagctatccttcctttggcctcccagagtgctgagattatacacatgagccactgtgcctggtcacaaagttcatttattcattcaacaaatatttgttgtgcatcagccacttttctatgggcaggatatatagccttgagtaaaacaaaaattcctgccttcattgtgtttatattctggttgggttagacataataaatataacacatacataaaatatatcattggatggtgattagggagtatgaaggtctgattgtacttttaaatggtagtcaaggatgccttgttaagaaggagatatctaagctaaagactgaagcacacaagggagtgagccatctggggtaagactgccttgattggagggaacagacagtacaaagtctgtgtgagatgggaacatgcttggctctttgattcttaaccagaggccagtgtggctggagtgagccagaaggacattaatagaagatgaggtaataatagggataataaaggtgttacaaagatctcaaggtaagtttattttttgtttaattgtgctttcatttattgtattttattttttgagctctctgtcgcccaggctggagggcagtggagagcaatcatgtctcactgcagccttgatctcccaggctcaagtgatccttccacctcagcctctggagtagctgagacgacaggtgtgtgtgccaccacacccagctaatttttaaatatttttgtagaggtgagggtctcactatgttgctcaagctggtcccaaactcctgggctcaagtgatctttctgccttgccctcccaaaatgctgagattacagacatgggccactgtgcctagcctaattgttcttttagaaatagtgtcagtcaaatggacttgccattgaagatttataagaacactgtgcagtagatttaaacagtttggatgtcattatacttgagattttgttcattcttccatctgcctgtccatccatctgcctgtctgggttagcaggctaggtaatcatatgtgatcctgttttcaacaaggatgtaaactgttttagatcagtttacatatttatctacatataggatggttaaaaataatcatagaagaggaattaatatccctcaatattagattctttatgggagtgggcagctatcaggtagagtgaaaagatccttgactttgtgttcgtatggatttcttttacattccaggccaaatggtgtacaaccttgggcaaattatacaatctctcccactctcagtcttcacatgtgaaaaactgggtaataaaaatactaatcttctaaaggtttaagccttagaaataatgttatataaagggtgtacacagtgcctctcctgctggaggcacttaataaatggtaactaatgtcttcatgtgaataagataaggatggtaaggataattattaatattattattgaaaatattttaaaaattaaccatctttaccattgttaagtgtacagctcagtgccaataaatacatttatttcccttttccctccatttcactcctccctccccgctccccttcctggcctctggtgatggcaagtgtactccatatgtcatgagatccactggtttgagctctcacatatgaatgagaacttgtgacatttgtgtattggaatggtagggattattgaggcccacggttaacctagaaagtgtatacaagttaattttttaaattgtcattctttgagaacttttcttggctactaaaaagtgtcaacatgtagtgattagaattttccctccttttccattaactcttgaagatgctaaggggacattaattatgaaggtctgtaaagcagcaccttgatttacctctaagaaagacaacatagagttagatataaagctgtattgggcatatctgttctcaggttggaatgcctgtgtttgattgttataggcagagagaattatactccttgtgatgttgtactcagtaacatctgcacagaggcttcttcccctctactcttcatggcactttatatatgcttctgctaccatttacatatgcatattttagcattatatgataagttgcattgaggacatttttcttgcctttgattagattaaatcttctttaagtaaggggtagtatcttcaattttgtatttttagtgtggagcacagcacagggttggtaaattggcaacatgagggcaggaatttcttatttcttttgttcactaatatatgttaagcactagaacagtgcttggcccatagtagttactcagtatgtatttgttggatgaatgaatcctgtatgccaaagataaaagtcttaatatttaagaatgttcttttggcactatattggttcagatttgacaaaatggtgtagaactgattaataggtaaattccaccagaacttgcagtcaaccaacacctttgctttagactgcctcctgtttgggagggcaagaatttagctaatttggatcttgagcttaataaacactaacatggtcaaaagtcaattagcaggagagaaaaatggaaataaaagagctaaatattttgcagattcattaaccaatctatcattaattaatccttaaacattgtatgttagtagccactagaaagggaaatcttcttgtggggaagatatagtgctgggaaatttgtaaattataaactacaaagttaaagtagtaaataaaggaaattaggaaatgtatttaaaaagccagtattatatatagtagtatatttttatactatataaatacatattactatagttataaatgtgttaatatatagtctgtatttataacatataaatatagtagtataaacatattatactcttaaatatttaagactggtaaatagtttgatcatccttttttatgttttttcaatgagctaaaaattagattttatagttaaattccattatttgagcatatgttttctttattagaataaaaaattgtaaaatgtgataatatttataattatgcttattatttgttaggtatactgtatttatatttaaggaaacatgagcaaatgaccaagaataattaaattatattggaatgttcctttcaagtaggtgctttggagttttaaatttaatactttaataataaatgcaaattgttaattattgtattgttgtttattggtacaatgaaagtgttgaagatattttgcataagaagaatggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtttctacagactagtataactattgccttttcacagctttatgcgtagttgttagaacagtaatcctttcccataatatgtctatttcagaccataagcccattttaattattgttaatttttacttaatatttactatatttgcccttgtctaaatagtaattactacattaaataagatttttatataaccaacatttcattgtaacattatttccaagaactgtcctataaataattgagtaaaactgacattttaaaccaccccctctgtgctctatgtttaactcttaatactgttctcatgctctgaccccactgctgcctgtctctttgctggtgttgctgtcctctgtcctttgcctcttagtggtctcagttttctcttaatatgaacaagcaatgggaggaatggtgctgctgtttcttccaccttggtcacaagctaacctctacatttttgtctaaagaagtcacttttattcactaagtcctttctattcccattctgtttcagtaatgccttgattggttgtgtcacctgtgcagtagttgaaaatggatatgagtacacaatttcaggacctccctgcttccttgtagatcatttggccgtatgtaagtgatttaacagtcatgcagtcagaattgttagagtaaataatttccatcttcattactgtatctttgtattcatgaacacttgcaggaacataatattcttcagttaaatttaggcaagtttaaaaaaattaggctaaataagtaacaaatttaaaaatcaagctagtttacatatttggagacttccatttttgtaataatggtgaatgaagagtttcttttgagtactttttaaaataccaacaattgataaagtgtaaatttacttaaggaattaattaatgtaggttttttgtatgaaagcagtcttgatatcaaattatgattatatgtacattttaacttagttacattataactttcaaaaaatttcttagccaaaaaaaattagcagagagtttagtatttatttctagaaacacacctaaagtagcatgagtagagagtttaaaaggaatagtaaaacagatttctttacatgatagattataagaaaatgttgggtgccaacacctaataagatatttaaaaataatattgcttttagttatgaatatttctattacttagtttgtcatatacctaattgtatggtggttcaggttgatttgagattacaaacattgatgttgaaacttcatagctttagaccatctttttttgtgtgggtttgtgtcagctaaattatcagtttcatttgctcatttaaaactgtaatacataaaaaaattggttaaaaaggattattatacttttttagacattgtgcagattccattttagtagctccaaaataagacattggagttgaattaggggaaaactgatattatgcaggagtgctgtcctcactttcaccagaaaattatttaaattggaatttccaaatgtgagaaatctgaaaggaataaaaaatgctagtccttaatgttagccgtatggttggtgttagccaaaatgaagttcaggctgtgatgctctgtagccactgtatgacctacccaaaggcaatcagaactcactcgtttcttccttttttcttttcttcctcttttttttaaactaattggcccatgtttagtttactgaatgtcatctggactcagtaaaaagcaagtgacctgcattgaattagtgtaattgtaatacaaacagaatattgcatagttttggtcttatacaggaaaggagaaagttggaaagatttttctgtttgataaatagaaactgaagatgtgggaatccaggcctggttcatacttgattttacctttcatgtctctttgtaagatcagtatttggacttttaggcatttttcctctgtaaaaaaacattggttttcattttgaaatttattatgaaagaagtctgctttttgtaaaaaaaaaaaaaaaaaatcttacaaatgatgtatattaagtcatggatctaattcaatcataagaaagttagcattgtccaaaatggaagtactttatgcactactaggattgtcaggaacttggcatattattttacctttatcatgaccaatattgcaaggacattttcaaatgctattttattagttttggatagtttatatttattacattctgtgtcagatgcgtaatagctccatttgctaaggggaaaaataaagagctgacatatttaaatttcattttaaataatatgttttaaattttaactatatgactttggtcttataattaattaatttgattttgaaagcgtcattttgaaatggaattatttggcatcctgaaatgcaaattctgtgtaacttatactcttgtaataggacactgccagtacaataactataaacagcttagatcttcctattataatcttggagtgccttgtactttttgtctttaacacatatttcttgaaatatttctctgatttttaatttaatgtttggtttttccactggattccatgtctcaagagagcaggtactgggtcttcccttgtattttaacatgatagtctttcgtgcctaacacaatgcctggcatatgataggcagtcagtaaatgtcagttaaataagtgtaaaaatgaataaggaaattatttacattagtacttagaaaaatctagtatctaaatagtatccaagtactgaacaatctagtaattgcttatatagtataattgcagtggtagaatcctagcttttctacttgctgattgtattaccatgcccaatttaacctctccatgtctcacttttttcccatatgtacagtgagaataattataatctttatcctgaggagttgttatgaggattgaatgaggtaattcatgtttccttgggaatgccccacagagttaattgatattattatcattgttctgttttttactattttagaggtgctttggaatcatagaaggaatgtatggctttattaggaagggttgtattagggaaagcataaaaaaataggtaatgtactaaaaacttattgaaagatggttagacgatgcctcatggccaaaggtaagccatgctgaaaagaagttgtactttatttcgtaagtaataggggaaagattggggtttgaagtaggggttcagcaatctgcatttaacaagcccaccaagaaattctgatgcatagtaaaatttaagaacaattattatatgtacatatttatatagatgagaactattgttatatatacatgtttatacagattaaaaatgtacagatgttttaaataatattttaattctgtgtgtttttttacttaataatgtagtctagcaagtttctgatcagtaaactcaattttctcctacatgtattgtaaaattagaaatatttcctactagaaaatagttgtcttcagattaagttagtaaccaaaagtattctttatccacctgaaaagaggtagtataacttgatgattaagatcatggactttggagctagactgcctgggttccattttcaactctgtcctttatttgctgagtatttgagggcaagttatttaacctttctatccctcagttttctcatatataaaatggagaaatacttcctcatagggttttggtgaggattaaaagaaataatttttgtaaagctacttagtacattgccccatacataataagtgctatatagagaaaatgtaatagtaacaacaataattacaacatatgataacatgaatgtatcaaaagttacataattaaagcatttaacaatagtgctgagacagcctaagcacagcatgcttattgcttaaaaagtcctagttaaatggccatatacatatgcctgaactttggggcctcattttacccttttctggctgtagtattatagaagggtatgcctctttcttcttgtttttttttctcctacccatcacttatttcctctctgctatggaactttacaggctcacgtgctccttgatttaggagacaaacagttttcctttgggagaatgaaaaaacagtgaaaataacctggggatattgcatttgaattctctcaaaatagtataaaaacgcatgcctgtagtcccagctacttgggaggctgaggtgggagaatcacttggacccaggaagcagaggtgccagtgaactgcttttatatgtggctctgaaagaaagggttaagacagcagtagagaacactgctgtctccattccctggctttcctccagcttttatctctgtcttgaattctagacatatttctagtaatctgcttatataattttctttactattttgagataattcaaatccaatatctccaagttgttttcactgttttttcatcaggcttgtttctccctttatatttgaaccaactatgtatttgaaacaactggttagatggtggtgccattaaccaagagtatcctccctctgtccaatcttccgcctttattttttattttattttgagacagggtctcactctgtcacccagactagagtgcagtggcacgatctccgctcactggaacctccgcttcctgggttcaagtgatcctcccacctcagcctcccgagtagctgggactacaggcatgcaccaccacccctggttaatttttgtatatatatatattttttcttttagagacagggtttcaccatgttgcccaggctgttctcaaactcctggactcaagtgatccgcctgccttggcctcccaaagtgctggcattacaggccactgtgcctggcccaatcttctgcctttaatcagtcaccaggtcctgttgatgtttccttccctccttcctgtccagctccactgccactgtgctgattcaagttttcattattcaccagttcccatctctgtaactttcttaatatctctcaagtaatatccccttcttttcgtccacatctttatttttccttccagatttttttaatactccacatcaccaactaatttatttggaatcgagattaaaagaacatttgacagttgtgaatgtatgtttattctgaaacttctagctagttgtacagctaacccttgacaacttaccaggttaattttactttatttcttcaggcctggggttttttgatgacttcaagtttgggatcttcaaatttgaagttagggaatgtattcatgtctgctttaccatacacttgcttgagcttaaaaagcttcttctctggctcttgctggtactctggatcagtatcaacagatcctccagatgtctgtcacttagatttgtattctctaaccttgtacataaagagtttctgtacaggatcaagttccttattaaacgccactgctgtaacaccaatgttcctccgcaaatggactgagactgctgactgaaagacagaggagaacctgaagagcctctggagaatctggctgattctctgttacttgcactcagtcctgagctggcaaagccaacgccaccgccatcgttctaccttcttctggatcagtaccaactgatttaataatctgcagtctcaatctcctctctaaagtaaacttcatgatgctgctagattgatcatcttaaatgaaacacaactcatattactgtcttacttaagatcctccccattaatagccaaatttttaagggtgtcatgtaagaccttgggctctgcatacatctttattcatgtgatatttcctttcctttagccatactatcatttgtaggtagtgttaggtttacctctgccttcttctaagtgttactttatgcctgcattttctcccatcttttttctacacattctatcttgggaacttttcttctgggcttcctttgcatcttgtgtgccccaagaccatacaagttatcatcttctgttatagtttatatgacttctctaccacattatgaagttattgatagcagcatgtgtaatttttattttgtgtcttcagtatctaatactacgctttatgacatactaattattaaataaatgattaatacatttatatacaaatttggggtacataattttcatttgcattttttaataactgggaaggttgaggtggacatatctatatttaataaaccttgaaggaaagaatattctctctcttatcagtgaacagcttgagtgctaccatgtgttcagctgtgggtgaggcactacatgaatgaaatcaaaatacgagggaaggactggtgttataaattgctttttctttgacaaaatattatttaaaataattcattttatactcataatgcatatttttttagtgcagtttagttttaggaaaacaaatcatttaggttaacatctaaaatgttaatgttgaactttactgactatagtatggcatatgtccaatagaatctgttaaaaattttcctctgcgtcagatctaagttgagaagaatgaggtaactttaatgtgaacctagattgtaatgcagtctttctctccagtgaattgccaaattcacaatttcatttgtatctggaattggggaagctgagtttaatatggatgtttgccaagttagcaaatcttggcaagatagtcttattctctgtgcttaattatatagttttattataaagtttttcacatgttcatttgtaggtatctattattctcttgaggtgagttcacatggtcgccaatctctcatttatactttattcttttggtagttaatcatttactgtcaagccttctatctttcttagaagactacatttttatttttacatttttatatattaccactagtgatccagttttgtctctttgcgaggtttatggatttttgagcagtacaagtgtaaatccctcagaaaggctttggtatattaatttatttcatatttattgagtgcctgctcagacactgttttaggcactcatacataacagtgaatgaaacaaagttccaatctcttaggtacctatttgtagtggggaaagacagtaaattacacacaaaaagctgggcacagtggcccacgcctgtaatcccagcactttgggaggctgaggcgggtggatcacccaaagtcaggagttcaagaccagcctgaccaacatagtgaaacgcattttctattaaaaatacaaaaagtaggtgggcatagtggcgtatgcctgtagtcccagctactttggaggctgaggcaggagaattgcttgaacccaggaggcggaggttgcagtgagccgaggtcgtgccactgccctctagcctgggagacagagtgagacactgtctcgggaaaaaaacatacaaaaaaaacgaaaactatagcatatcaggtactgataacagctatgaagaaaaagcaggataagagggatacagaatgacagatatgtttgtgatattatatgtaggatggtcaagaaaggcctgtctaataaggtgacttatagtagagatgtgaaggagctaagtaaatgagcaatgcagatttctggggaaagaacgttctagtcagagtaaactgatgtgtgactgtgtttgatgttttagaaacagtaaggaggtttaagtggctggagctggataagatggtgaaagaagtaggagatgagatcagagggatggcagggaaccagatcacttagagccttcataaaccacggcaggacctttagcttttaccctgagtgaaacaggaaaccattgcagggttttgagcagaggaatggtatggtctgatgtgtgatttaaacggctcgttcttcattgagaagggattgtagcaggacaagaatggaagccaggtgaatagtgaggaggttacttcttcagtagtccaggtaagagataatggcggcctgaaccagggtagtaaaggtaaagttgttgagatgtggccagattctggatatttgtattttctgattatctaaatgtggaatgtaaatgagagtcaggatttttggcctaggtttttggctcagatatcttgaatgatgaagataagaaatgatgttaaacatatttatagttaatgtgttttaataaaaaaaaagaaatgtttactatatgtcaggtttatctcttaaaacattctgctttggcatctctcataactagaaaatctcatctttatactgtttctttctttcttcttcttcttcttcctcttcctcttcttcctcttcctcttcctcttcttcttcttgttcttctccttctccttatccttcttctccttcttctcctccttctcctccttctcctccttctcctccttcttctccttctcctccttctcctccttctccttctccttctccttctccttcttcttctgttcctctctgtcacccaggctggagtacactggtgccattagggttcacagtagccctgacctcccaggctcaagtgattctcccaccttggcctcccaagtagctgcaacttcaggcgtgtgccaccacccctgctaatttttaaaatttttttgtggagatggggtctcattgtgttgcccaggctggtctcgaacacgtgggctcaagcagtcctctcgccttagcctcccaaagtgctgggattacaggcatgacccaccatgcccagccttaatactgattcttaatacttcacattttattctctaagtacgtgctgtttgtttggtgcttggtcctgaactatttttaaaatgtggtttatattattattcaaatatggtgaaactaacacgtcaggagacaactgccattgaaaagattgatacagtttctaagtggagagggcatggcacatcagacagggtggcatatatgccacgccacatagtgctcatagggaagcaccagggttgtttaggaggcagaaatagctagggaaatcatgggggagagcctttatcatgattttagtgagaaggaacaggcgaggcagggtaaggaggcttagaattggctggttttaataatgtcggcatagtcacatataagagcagcccccaagttgtttgatacctggccctggcgtgattattagaacaggggactattctaatagtcccagaatataagagttctgtgagagctgaatactggggatggatgggaggtagttttagattgagtggtttgcatgcgaaaagcactcaaggaggggtagtttgctgtctaagaagtagctagccttgggaggggcagtctctcctgggtcagcatggttcccatcaagaatacggaaaacaaagtgaaaacagtttctgtatgttatatttgcttggcttctgtctttttaatactaccatcctagtttatgccctccattggtctggtcaggaaaattacagtaggaccttcctttccatctttagtttttatctttgtttcctccctagcatttattttcgaatcagtagccacaaaggggaatcttggttgtatgactttacctggatccctctagattagtaaacttttgaccatgttctaaagtagtgtttagggttccccatatttgatttgaagtccacttgattatatgaaccaatgtttgtgagaggaaggaaggtgggtgtgtggggtctccagtttttttcatgcccctttcaattattgtgggtttaaaaaaggtttctgtactagggttccatgtatgagtttatttggaaagtagatttcactgctcaaaagttggtaaactctcgtaaatgactgtcaagcttccttattatagcatgattatttttttcttctgtgtctagggtgatgggcctaccagctgagcctatcatactaaagagattagtctaattttgtgtatgaagtacttgagtcttttctgagtcaaataatttagccaaagtcacaaatctcttattgggggaaaagagaattggtataatctgtgtctaaaaatccatcaagttaccctaaaaaactatcactgtacaaattcctcacttggcctttactcttgctgtcccatccaggtttccaggcttctctcaacatccccctatatagacaatttttcctgccaaacaagatgatttaatgttttccaaacctgttgccttcgtctactttattcctttaccttcgtcactgtcttccatttataggcacattccttttttttttttttttttttttggagtgtggaggggagtggagacaggatattcctctattgcctgggatagagtgcagtggtgtgatcatagctcactgctgtcttgaactcctggcctcaagctgttcttctgcctcagcctcctgagtagctgggaacataggcacataccactaggactggctgatttttaaaattttacttttgtagagatagggttgcgctattttgcccaggctagtttctaactcttggcctcaagtgatcctcccacctctgccttccaaagtgctgggattacaggtgtgagccaccatgcctgcctgtgtattcctttaacttagcaagtgtttatgaaacacctgctttgtgttgggcactctcctggactcttgaatatagggataaataaaattctttctgcttcagggaacccccaggttaaggaaagccaaaagtctagcatgagtaatctacagagtctttcaagagtacttcacatcagatgtgtctagtaacattgtgtagccagaccaagtggttgggaacaatggtaagagatgagcctggaaaattgaaaagagaggaaggaggccatgagcgaaggattgtggatagcttgtataaactggaaaaatcaggggcaagttctgtctcagaatttccagaaattctaattctgtcagcagtaggtatctttagttttatgtagagttgttgcattactggactgtgttttacacagatataaaacagatattaaaggagaaactagagacaggagaattaggttacatgtttgttgtagtattctactgagctgtttgcttagtacctgaattttaacaaccacaaatatttgtagtatcaaattatcttatatattttctcatttgatgttaaaacaacatagtgtgctggcacaattagatacccacatgtacaaaaatgaaattagactccaacctcataccctgtaaaaatgttaattcaaaatgcaccaaagacctaaatttaacggctaaatctataaaatttttggtagtaaacatagatgtaaatcttaggctttgctgtgtgtgtgttagcttgtttttgcattgctataaataaatacctgaagctgggtaatttataaataaaagaggtttaattggcctacagttctacaggtcatacaagcatgatgccagcatctgcttggcttctggtgaggcttcaggaagcttttacttcctgaggcagtgggggcatgagtatgtcacatggtgatagcaggagcaaaagaaaggggaggagtctcaggctcttttaaataaccagaccttttttttttttttttttcttttttctttttttagtgcagtggcacgatctcggctcactgcaacctctgcctcctgggttcaagcgattttcctgtctcagcctcccaagtagctgggattacaggcacatgccaccacgcttggctaatttttatgtttttagtagagacagggtttcaccatgttggccaggctgatcttgaactcctgacctcaagtgatacacctgtctcagtctcccaaagtgctgggattataggcatgtactgctgtgcccggctaatttttatatttttagtagagacggggttttaccatgttggccaggctggtcttgaacccctgagttcaagtgatctgctgggcttggcctcccaaagtgttgagattacaagcatgagccactgcgcctggcctatgatgactcttaagacttgagtccaagccacatagccattagaggtggcatggaatgtttttccaggtatgaagtggggacagaatttttttctctcttctcaatcttttctctctacattctgtactcttaaattgttttactcaacaaacattatcttttgtatactaagcattgcacctggaactgaggatacagaaagcagtgtggagctagaatcacttaccaaaattctgcagtttctagtttgggaagctgtttggttggtgattaaagagagtgactccaagaggaggaagattggtgagatcaagaaaatttcttatttccccatgcagacttgcatgtagtcttcctttgttcctagaggctgtttgaaagaataccttatcctcattgtctctactttattagaatacatttagtttcttttaaacttcttttaaattatttcttcatatttgccagagatcacttattatcaaatccgatggcctcatctcagtccccttcttacccctgacctcctaaagcagggccttttttctgtaaagggccagatagtaaatattttagtctttacaagttatatggtctctgctgcagtcattcagctcttccattataatgtgaaagtagccatatagacagcacataaatgaatgagtgtggctgtgttcccataaaactttatttaccaaaacaggagactggttagatttggcatgtgggccgaagttttctgatccctgctctgaaacatttgattgtatttctaccttttttgggaagagagtgtttcttttcttcagtgatacttttcccccttttctcattgaatggcaccttttcctgtatagtcactttttcatgtgattctatctacagctattttcttgctttatactcaggcttctgttaaggcttctatgctgcagattctttccccacttctaacaggaaataactaagatggagagttcactcctgctgctgcctttatggctgcctcctttttccccacctccttttatcaggggagcatctggggggcagggtgaggggcagcctctgtaataaagggaagagaaaagagagtcattaccatgacgtggtagatggttctgaaccacttttttcagggttatagtagggtagattgcttcctcatgtttgctatcataagccccccacttcagcatcctatgcaggcctgtacacctaaaaagtacccttaagtgtagcagtctagcattctgagctgctgtggatgttttttctgtggtggttgtctgttgtcagttacgacaaacacttctttttcttcctcacaactttaaaacagggaagaaagaaaatctccttgccccaaattatcccctttccattctgcctgaaattttgccaaatagattcgtttcaatttttaagccaaacacacttgggaggtttaagcacagatgagttactgttcatcctggcatcattatgaaaaggcataatcagtttgccttttcccttgttaaactgagatagactcagtggaagttttaataggtgggagggagggaagaaaggtcaaagagaaacatggcactttgggctttttctgggagcagagccagcagtgagagctggggtttttgggcttgtagaggtgggactgggagagggaaaagggaagtgggaggatgcacaagacaaatgtcagttttgaaaatgtgccttctttccagatctttgctcttgtttactgcctttcttgatctttactataatgatgagtgtgtatgtgtgtatgtgtgtgttgtcggagagagggtacagtggaagtggaataaaggagaaaccagaggtaatttgtcagtaatcctcaaatagcagtaaggctcacagtttaagcgccttctttcaagatacactgctagctaatgacaaggccacgaccatttagctggctttctttttttgttatgtttctctgtggtgttacatataagaagtagctgctgattcacactcagcagtcttctctggaggattttattttaattaccaatctttcgatctttctcattttcttgggtttaaaattcaactggacttcatcctcaggccatttaacttatttttcctcctgttttccagcttgtcagtatcctcaggcattcactttactcctctatctagccaagactctactctgtcacttgaaccactttcttttttttttcttttttgagacagagttccactctttttgcccaggcttgagtgcagtggcacgatctcaactcactgcaacctccacctcccaggttcaagtgattctcctgcctcagcttcccgagtagctgggattacaggtatctgccaccatacccggctcattttttgtatttttagtagagatggggtttcaccatgttgcccaggctagtctcgaactcctgacctcaagtgatcccacccgccttggtctcccaaagtgctgggattacagtcatgaactaccgcacccggctgaaccactttcttttaattcctttttttccttctcttttttgctgtatcttcctaacaatgtaccaatactacactaatcccatagtaataagtatagtagctattatttattgtctactatctgaccaactctatgataaagttttacataactctaaaacaactctaaaaggagtagatattattattggcacactctatgtaactatcattattataactctagataacaacccaagacacagctacactgatagagctaggttatcactcagacttaaaaaacctcaaaggtttttacctttcccattttgctgtgttcctcgtaaccaggctgcttaactgcaattatgtaactgtgaagactgatgcccccaaaagattgatttctaatctgaaatggacagttggcaatcctttcacatgttcccctacgcctaccacctcattctcttctgggtctgttgcaaaatttctttaccccatctctccttggttttgtcagacttgctttctggtccaaagaaaaactggagactattagcagttcactgtttctgtccctccatctaacttaatgtattagtctgttcctgctgctataacaaaatgctaaagactgggtgatttaaacaacaacagtttattttcttacagttctggagtctggacttccaagatcaaggtgttggcaggtctggtttcttctgaggtctccctctggcttgcagatggctgccttctctgtgtgttctcacatggcctttgggtttttgtttttgtttgaggcagggtcttgctctgtctcccagtctggaatgtcatggtgtgatcacagctcactgcagccgcgacctcctgagctcaaatgatccttccacctcagcctcctgagtagctgggactacaggtgcacaccaccatgcctggctaattgttgtatattttgtagagacgggctgtcgctacgttgcccaggctgttctcaaactcctgggctccagtgatctgcctgccttggcctcccaaagtgctgggattacaggcataagctactgtgcccagccctggcctttggttttgaatgtacacattcctaatgtctcttcttcttcttataaggacacaagtcatattggattagagccccacctttatgacctcatttaaccttaatacctctttaaaggcccaatctgcaaatacagtaacatggagcattagggctttgacataaaatttggtagtggtggtggtggggggacaggacacaattcagtccgtaacagtcaatatctatacttttccttccttcctttatgtcttttttccccctctctttcttcctttcttccttccctttattttttcttcgtttctttttctcctccttctcatcttattcttccctccctcacaatatgttccatgtggaggaagagggttccttctctgctcaagtccaatctctcaacctctattctgtatcccattctttctttttcttgtattttggagcattactcatcatttgttcactctagcgtttattttcttcagtttcttctacatgggttttcttttatcggtatgtaaatatactactgctcaatcattattactactaccgttgtgttctattatgcatattagtcccatgtaatttattattgtaagatgtaacaattaaatgctgtagaagtaatccttctgattttaaaatgggaaatagtacaggtttttgcaatttcagagcaatttctatttcttagtttgatagaatgtttctaccttaatgttaagctaaaaatatactaaaactattgtaataaaagtttaatacattaggataggcgaacacataatttccgtcttcttctgagatatagaaatgtgttgattactttaaatgtagcaattgtagggaattctctgccaagttacagaaatctatgtattaatatagttcttcttgaactcggtcctcgataatttgattttttacagacccttgagtttaccatgatgaattgtcattgcaatacttatttgcacttactataccaaacttcagttgtgctatatcattaaagtttgttacttttagattgctttgggaagctgtatattatagtctagctgtaggaaatttacatacaatgaatgaatggcaatgtaatatacatccttatgtttatttatgagtcataactaatcctatttagtatttggtttattgtattcagtgattaatagaatcagggaaagtaaaccaaaaaaatccaatttttttttttttggagatggagtctcatactgtcacccaggctggagtgcagtggcgcaatctcagctcactgcaacatctgcctcctgggttcaagagattctcctgcctcacgaatagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccagttggagctttcctggctgctttgtttacctaagcaagcccgggcaatggcgggctcccctcccccagcctagctgccgccttgcagtttgatctcagactgctttgtgctagcaatcagcgagattctgtgggtgtaggaccctccaagccaggtgtgggatatagtctcgtggtgcgccgttttttaagccggtctgaaaagcgcagtattcgggtgagagtgacccgattttccaggtgcatccatcacccctttctttgactcggaaagggaactccctgaccccttgcgcttcccaggtgaggcaatgcctcgccctgcttcggctcgcgcacggtgcgcacacccactggcctgcgcccactgtctggcactccctagtgagatgaacccggtacctcagatggaaatgcagaaatcacccatcttctgcatcgctctcgctgggagctgtagaccggagctgttcctattcggccatcttggctcctcccccgatcgagacatcttctttgacacatagattatttgaaagcgtgttctttagttttcaagtgcttgattttcctattatgtctctgttattgatttctaatgtgattccattgtgcttggagactctactctgttcagttctttaaaatttgttgatgtatgttttatgcctcagtatatgttctctcttggtatatggtccatgattacttgaaagtaataagtactctgctgttgttgaggtggggtattctataaattttgttgatggtgttgttgatttcttctgtatccttgctgattttctgtctatttgttttatctcttgttgttagaggatattgacatttctactgataatggtgaatttatctatttctcctttcaagttttagtttttgcttcatatattttatagcttgttggttggtacatatacattagtgcttgttatattttcttggtgaattatgtctcatcactatgtaatgtccctctctgtctctggtaattttctttgctgaagtctcctttatctgttattaatatagccacttctgctttggtttgattattgtttgcatgttatatttcttccatcatttttctttcaacatgcctgtatttttatattataagttagtttcttatatactacatataattgagttgcattttaaaatctaccttttcagtttttgccttttaattggcatatttaggcgatttacatttaatgtaattattaatatgttatggctaaagttttgcatttttttaatttctgttttctttttttttacttcctgtgggttacttgattttttttaagagttttcttttgatttatctatagtgtttatgaggatatttctatgcaaaactttttggtggtttattttagtattattctatatgtacataaattatcacaaggtactggtaaagctgaggctttctatttttacattgtttcagttattttcatgattgttcattgaagcatttttttaaagactcttaaaatatttgtcagatacttctgacatgtctttttttggtgttgacttttatcttttttgtttttttggtcagtttgtgatttttttgactcttggtctgatgagtaatttttggttgaaaacaggacctatttccccattatattctgagactggatcttatttaaaccttctgttttaggtgaatgtttatgacattactttaagaggggaagggagctcatcactgccaggtagagtttgttgaagtccagattcccctttcagtctctgttgccctactcaagtagcaggagtggctcctcattattgctgagtcagagtggtgattctagctctccgtgtgtagtctctattgtattggtgcttacctaatttccactggttagtgaaagtcttaatttaacttttttctagtcctcctcagtgggtagtgggaggatcacctcattgctgccagtttggagaggaagtacaggttctacttgctgtctactgacactgctagggggggctgtccttttactttccagaggggtgaaattcttggctccctacttgttcttttctcaccatgtcaggagtattgtgggaccttgttatagtctcatgaggatagaactttaggctgtccactaagcctttctgacatggttagagtgggactacagttttttctgtggtgtttggctgacatagagtgaaatttgcctaaagttttcttctttccatggtgttcttctcttcatcttttgggcagggttttgttggagcttttttgtttgtacctgttagctttttctggttgttggcttatctggccccaagtgtggaatatataagggacaaagaagatccagggaagtcatcagttatgttccttgggttccaagatccctagctgttctgccttctctccatctttcatatatatatatatatattagaatctctctatatatatgggttgatatatatatagaattgatatatatgtatatatagaattcatatgtgtgtgtgtgtatatatatatatatgtttagaaacagtggtcttgaactggtcttgaattcctggtttcaagcagtcctccccactcggcttcccaagtggctgggattataggcatgagccactgtgcccagtctggatcttcgtatgcttgtttattcataatgtccatggtttttggttgtacttaacgagagaaataggaaaatgtacatctactctatcttcctagaagcagaagttacacatagtttttaaacagcaatgactttctaatttatggaattttagatgaaatataaaatatagtgacatacatacacatatatatttatataaatgtctattatatgtatatttatatatattttatatactatatatgtatttatttatttagcaaggggaacagtttgattgttgttgcctagagttggcccctgaattagttttcctagtttctcccattctatttatgaactctgtctctaaaaatggtaagtttttattccccaaacttgtgctaaatgtagtgggaatttggatccatactgtttgattcatgcagtgatctttgacccttgatacaccttacactcatataggacatttttttaaaaaccaaccaacctaggcctagacaacaccagattctttgggttgagttcagggaataagcaattttagaatgcttcccaggtgattctaatatgtagccagtgttaagaaccactggcatagagtttggaattggttggttgcttgtgaatcataaggttttcttaaagaaatttggagttagaaactaatatatgaatttttttttatcattttaattaacttatggtagaatctaagggtttatttatctggcaatcatatttggccaaggctgtagattaagccttattttccctaggcacgaaaatgaggggctgtgttgacagatttcttttctttctaaaacttactatttactcttaaatttcacactaaatttctgagatctattgtttttttctgattgtagactttgatgtatgtatatatgtctgtgtgtctttttttaattataaacttttcatattttcagttgtttcttttttgttcttcatatattttttgttgttaattttgattttcttaatcctaatttacattgacttctattatagatttttgtgaaattgatttgtactgggcattatactgttttgggaccagagcctcacttattgcatcatattcttgctatcttaggactagtgtattgttttattgtgattcaatcacaggagctctgtgctgacctctgcttgtttagctttaacccagttctttgtatcagtttgagtttataggcctttgtgtaaacatctgcttaagttttgtagtctctattagatatgactggattttgaatgatgtgttctttataatgagcatttttatattttactatgttttgattacttgattaactttcacagattctataacaacttagtctttgcactttggttgtaaagtgacataatattttaactcgaatcaggatgattttatgctaaatgataattttgaggatagtatgtcaattataggcactaggcccggtaactggagcctttgcccaaagattatgccctgcatgggccatgctacatctctgtgctagagcccatagttttccctcctagatcatgctctgcagacccaggatcccaggattccccatttaaatggtcctgagcctatgcgggcatcttccctgcttttcctcattaggacagactgcaccaggctagtgatggacaagacacagctattgcaagggtggcatatggtggtgggggcactgggatagagctaagacgtgtgtgccgcactgttttaggagtcagaggtgggaatagaatagaaagaaaatcaatggatgctattgatttactttggattgaattgaattattgttgcactttggtaaaatgaagctaggcagtattgcatataatattctgatcttctaatagtacttcatggtgttgaacttcttgtccttggaactcttttaccagatgatacaaaaactgctaatgactagtattaatttatttccctaatcttatggtcaaattatactaagttacattacatgaatcttttgttcattatttccttttttctcattttgtaatcatatggtttttttttttctgttttgaaacattttggtacattccagatagttcctttggatgggggtattggttcttctttcttgcttttgaagctctgattcattttctgttttattactaagataagttactatgaaagttttcttccagattcttaattttatcatgcttctgaaattgttttgataatacatgcaattagtttatctgatatatgtcaattatttctttttttttttttttgagacggagtctcactgtgtcacccaggctggagtgcggtggtgcgatctctgatctcggctcactgcaagctccacctcccagattcatgccattctcctgcctcagcctcctgagtagctgggactacaggtgcccgccaccacgcccagttaattttttgtatttttagtagagacggggtttcactgtgttagccaggatggtctcgatctcctgacctcgtgatccacccgcgtcagcctcccaaagtgctgggattacaggcggaaccaccatgcctggccactgatttctaatattttgtcttcccttaagttttctgatacattcaaggcaattagttcatcagctttatttttcaatctattttattgatgtttttgtactgtcttcttattttttgtaaacttctagtggttgttctagtattttttccgcatagtcttacctttcattttgttctttttatatgtaaatgtttatgatccattatttattgttatagctaatgcagtgtaaagtatacattgtaccatatttcagatgagatactttatttaaatagctgagataaaaatttcatggcttaaagtgacatccaaaccatacacttctttttttgaggagttattatgctgttaaaatgcctagaattattctaaaattaaacattaaaaggccttatctcaaaacttatttaacatttaaaatattattttattcactattcttagtaaagtttcactcttattccgttattctgaaatatataacttaatatgctttgttattggcagagccctcttctttgtcagggtgtgaatttaggtaatcagtgatgtagtatgagcataatgcttgcggaagggttgtggttgtgtattttctaaggaagatcagttggctacccagacaagatcacagagcagcatttattattcgaagaccgatctgccaatgtaataaatatagaactgtctcataggatggacttaaccaagttcactgatatacaaatcaaaattccaatttattactttaaaaatagatatttaaccctcaagtaatcagatgttcatcaccatattctcttctgaagtcagttttacatgggaatccaaattttgaccagaaggctgtcaggtgaaaatggttactagaataaggtgattagttggatgatcttattgactactgcatcaagctatgctcatccgtgtctaccacttgaatttatctattgcaaggaccaggtatattttttagtggtccagggcatcctcttggacagaatggagacacattaccaatttcatttttctggatgctcttttgatgtcttgtgaaccatgtctcttcattattttttcaggcatattaaaatacagttacttagaaaaaataaactatataccaaattttatctgtgttaaaatttcaaatatgtaaaaaagtaaacaaattagaaggacataatataaaatgaaacaagtttgtggtactgttgctggtgaacatgcatcaaacagaagaaaatattcctgttagtttccctggtttgcattcactatagaatagtggttttcaggctttttggcctgagcagtccttttcactttaaagaattgaggacccaagagcttttgtttatatgaatcaattactattttcataaaaataatgagtggatagcttaatagaagatggttgaatttttttttttatttgtgagtgttgtaacacattatttcaatggaaatgtatgaaaaatatctggcctaacacatatatgatatgtgattaagatggagcaatattctaatcatttgttttctggtaattatgatattcttcctttcatactacaccaaaattcaacagtgataattttctaaagattaattccagtattagaatctgaaaccatagtagtgagtttttctattttgttacattaaaatctatttctctatcttgtacttggaatagatctttattcatatgtgaacgggtaatgtcatgtatttgtcatttggaaaaatcagaaaagtttctaaatactaggaaactgttaagttcatggtggcagatagaagcttttgaaaatttgacttttcaactgaaagcttaaattttataattgttatcaaaaaccatctgtgtttccatgatgtcataggttcagttgattcatttttgagaaaatgtctgttgagtatccaaatctgaataatcaaagtttatctctcagtttttctttcaaatgaaaaagatgattcatgaaaaaagctgtagttcaacatgcaatttaatcacagataattttccttgagacaaccattgtacttcattatgtagcaggtatagtttatgcgtatttctcatttcactacaaaatgctaaaaagatgctaaaaagatttgctaaaaagagtattttttaaatcaaggattttcttaatcaaaagtgtcttttttgtgaattcacagattcaaaaaaattgtgaatgcatgacaatgaagaatacaatgattacagttttgttccactgtcttcattggtgctagggagccagcaattttatctgtcattgcttttgtacctgtagtgcaaatgtcaattgagagaaaaaggaaaagaatggcttagtgtttttatgaaaaaaagatttgacttggtagatccctgaaagggcccagtgaaggagttcatgaacacctcgagaaccacaactgtagagaaaagctgttagagaaacagtatttttcacctttgtctaaaaagtgcttcttatatcagttgcttatcaatttcactattttgctatgtttgaaaaacagtgaaaatacatttgaataccacctgaattacagtattctatttcaacacaaattgagtgtactgtggttctgttctactgctaaccatccagagttagctcagaccccacaagttcaagggcatgatccccaacatgaccactcttcagataccagctacacttaatttgtccctaggttacccatacttctgactaaatggttatacattcagcagttcctttgatcccctcaggtttgataacttgctagaatgactggcagaattcaggaaagaactatacttagaatgacaggtttattataaaggatgctaatcaggaggaccagtcaaatgaagagacccatatgattgtctgagagggaacacagagcctgtgtgacttccttttgtagaatcaggacatgtgaatgtgtttgccaaccaggaggctctgctaagcctagatgtacagagtttttactggggtttcattaagtagtaatgattgattaaacctttggccatttgtttgagctcagtctttagtatccactcaccagaggtcaggcagctaaatatactaacctgctaattacatgcttattctttctgctgaccatcctgtatcctgaagctatctaggggcttcagttggcatgtgtcaactccttagcataacaaagacatttatatctctggaaattccatgggcttttgcagcctcttggaaaagagcttcaaaagtgttcagaacactgcaaaagagaaatgttgtgttggacttccagggagcctgggtaaagagatctgattaatactctatattgccattcccttccccttttttttgagttctggagtcagtgtgtggtaatgttcaaccacccatcttaaaccatgaagtaaattggaaggtggagaccacatactgatggcactacagcagtatcatactagcctgatactgcccatttatggagataacagcttcttcaagcagttctcttgcctcagcctcccaagtagctgggattacaggcacccaccaccacacctggctaatttttgtatttttagcagagatggggttttgccatgttggccaagctggtctcaaactcctgacctcaggtgatccgactgcctcagcctctcaaagcgctgggattacaggcatgagctaccgcacccggccacaaacatatctttcatggctagagcaggaggaagagagaaagggggaaggtgctacacacttttaacaaccacatcttatgataactcactatcatgagaacagcaccaaggggatgataataaaccattcatgacaactccacccccatggtccaatcacctcccatcaggccccaccgctaacattggggattacaatttgacaggagatttaagcggggacacagagccaagccatattgtacttctaacctaaagagctgtaagataataaacttgtgttgtatgaaccactacatttgtgataacttactacagcagaaatagaaaactagtatagacggatagctgggggcagggcgaagacagagagggaggaagtaagagaggaagaagttgttatcaccataaatgggcaggcggatgttgcagtgagccgagatcatgccgctgcactccagcttgggtgacaagagtgaaactctgcctcaaaaaaaaaaaaaaaaaaaaggtgtgcttgcttccccttcaccttccaccatgattgtaagtttcctgaggtctccctgaaacagaagctgctatgcttcctatacagcctgcagaaccatgagccagttaaacttcttttctttataaattacccagtctcagatatttctttattgaaatgtgagaatagaccaatacagaaaatcagtgccaaggagtagggcattgctataaagatacctgaaaatgtggaagcagctttgaaagtgggtaacaggcagaggctggaagagtatggagggctcataagaagacaggaaaatgagggaaagtttggaacttcttagagacttgttaaattgtgaccaaaatgttgatagtgatatggacaatgaaatccatgctgatgaggtctcggatggagatgaggaacttactgggaactggagcaaatgtcacttttgttatgcattaacaaagaacctagtggcattttacccctgccctggggatctgtggatctttgaacttgagactgatgatttagggtatctggcagaagaaatttctaagcagtaaagtgttcaagaggtgacctggctgcttctaacaacctgtgcccatatgcatgagcaaagaaatgatgtaaaactcaaacttgtatttaaaggggaagcagaacataaaagttgaaaattttgtagcccagccatgtggtagaaaagaaaaacttatttgagggtgcaaaagccagctgcagccattttcataactaaaaggaaggcaacagttgagacttgggaaccccagcctagattttagaggagatatggaaaagcctgaatgtccaggcagaagtctgctgtagggctgtagctttcatgagaacctctactagggcaatgcaagagggaaatatggggttagagtcttcactggagtactgcctggtggagctgtgagaagagggccaccatcctccagacccctccagatagagctaccaatagctggcactatgcacttggaaaacccataggcacccaatgccagcccatgagagcagcctcaggggctgaaccctgcagggccatagggatggagtggctgaaggctttgggagcccacgccttttatcagtgtgccctggatgtgggacatggagtcaaaggagattattttggagctttccaaaatacagtgtctaacacatatctcactaggctacatctgaagtggtggcagggaagcttttttatcctggagtatctcagagagaatttgtttccttgctttttcaagcttctaaaggctgcccacattctttggctcatggccctcttcctttatcttcaaagcagcattatttgaagactgcttcaaagcagaccattattccaaactcacatctccctctgactctcctggctccctcttccactttttaggacccttctgattacatttggcctgcctagataatttaggataatctgtccacctcaagacttttaacttaatcttatcttcaaaatcctttttgccatgtaaagtaacatattcacaagtccggggattagaacgtagacatcttgcggggtgggggcattattcattctatctctctacatcatctttccctccttcccttcccttcttcctttccttcttccttcctttccttcttcccttccttcccaggccccgcttccagcattgaggaccacatttcaacatgagatttggaggggacagatatccaaactcaagtatccattggtgttccttgcctgaattgatcattaaattacattgagggtgcaatatgttgatactgtatttcagttactgtgtatttttagaatttttctataaagaacagcttttcttaaactctttgaaaaatattgtcataggccaggtgcggtggctcacacctgtaatcccagcactttgggaggccaaggtgggcagatcatttgaggtcaggagtttgagattagcctggccagtatggtgaaaccttgtctctactaaaaatgtgaaaaatagccaggcatggtggcgggcacctgtaatcccagctacttgggaggctgaggcatgagaatcgcttgaacctgggaggtagaagttgcagtgagcctagatcatgtcactgcactccagcctggatgggtgacagcgagactccatctcaaaaataaaaaaaaaaaacactgtagactaattgttttcaatttgttataatcagttatagtcattattactattattattttgatgctcaaattatcctaaatttggttatttatatgtccttttgacataataccattaatctttgagtgtttccttaccttctggcctagcaagatacccagagctaaccttgtgattttcctattttgacctttgaaattagtcatttcctcaaggagcataggtttcttttactggggattggcattttagaagccaagatcttggtaccaggtgtgctccttgttacaggtgtccactatctttagatatatttggtacttccaagttcttaggctttttttttttttttagttatttggagggaattgatgtgcttcttactgatttctcagatcttttgagtcagttatgactctttcatctactttctatttccaaaattttattgctgtctcttattttctattgcccttctctctttggaggttaagcctttttaaaattcttactgtactttagcaggattttggggaaggagttgaagtaaatcagtatgttcagttaccatacttaactggatgtctttatatcaacactctcagtataaatttaggttttactatggagaagtactatgcctaatgcagttgacatataaaacttaagtgattgtatagtctgtttgggttgctataacaaaataccttagactgggtaatttatgtacaaaagatatgtattgctcacagttctggaggcttggaagttcaagatctaggtgctagcagatttggtgtctagttagggcttgttcctcatagaaggcaccttctatgtgtccttatttggcagaagggattagatggttctgtggggacttgtttatgagggcattaattccattcacaaaggtggagcccttatgacctaatcgcctcccaaaggccccaccttctaataccatcacgttggtgatttgctttgaacataagaattttgcaagagacacaaacattcagacaatagaagacactgtcttgccttcaggtagttttcatgttatccagggcatttagaatgagtttataactaatcagagtacaatattaaaatatggaaagttctgaagttgagatattaaacagtgatagcacttgtcttgtattttatattttagaatagtggttctccatgttactcacatattggaattgcttgggagatgtaagaaaatattgtgccttgtcgtcaccccagatcagttaaatcagactcttttatggctgatactaagttctacaagtgctgaacttctgatgtgatccagttagtatttgagtgatttctttctttatgggcaacaagatgcctttggctcacctcgtaatttccctgccctacatctgaaataagtcagtttctctcacagctccatgaggtttcaaacttcacaactgagaagatgctggtctcctttctgtgcttcactgactcactcattctttatgactcagctgaaatctcatcttcccatacccatttagctcacatacctatttgggctaagtcatcctttgtaatacctattgctcacatgtatttgagcacttacactattttattaaaatgatctgatatacatttttatattccattagactctaaatttcttgaagaagttaatatattgcaggtatggatacatttatgtgcttacaaaagtcagttgaactgatcataggacttctatctgagagagtgaaatttgtgataaagttctttaagtgttggcttttgttcacttttgcttttctctacagccatgttttatgatattgttggattgtattaaagggatattatatttcagtcttgaaagatggttaagatttacacattgattgtattgggatttaaatagtgcatgagtaagaggtggttgtggggcagactggaataggtgacagcttaaggggtggtatcaaatgaagcttttgcaattgcgagtataatttttaaatacttttaaatatatgtatatatatttaaatagagtcaggatctcattgtgttgcctaggcttgtcttgagctcctgggctcaagcaatccaccttcctcagcctctcagctcagggactacaggcatgagccactatgcctagctgcaagtataatttttaaaagtaaaaaaaaatttaaaaaccatcatagtaaaaataaattttaaagacacttatacaatcttgtacataattgctgctatgaattgacagtttaaatttttaagattctataccatcttttagtttttattgctgcatactagtcatttttatgtgaaagcagtctttactgttttactccctcatttttgctttttaagaacttttctttgtggttttgtaattcacacatttgtcagtttttatggcaatatgttactttatgttattcatatatagtttacttagcaccctcaattgtttgactttttttttcttcagttttccaccgttagagacagtaaaactataatcttctttgttacaaatacttttccacttttttctagagactgaatgtatgtaacagagcctttatcttaaaataaaattatgtgcagcagaaatctgatggaagcagtggtaatgtgaggtagcatatgctaaggaatcaaacttgttctaattttgacattcactttactagctgtgtgatcttgaataagctagcttactcttgtgagcctcagtcgtaaaattaggttaataatagctcacattattgagcatttacaattgtgccaggcactattctaagtgttttacatgtattaatctatttaaaattcagaacagccctaacattcccatattaagatatgggaacagaggcatagagtagttaaataggtcagatagttactaataatggtgctgttatgtacccagtgccatctagagctggttctcttatttgctttgtacttccagaataccagctgcaccctctcccttaatttggtttccaggctggcacattggcctttcttggccagattaatgattgctactggaactggagtgaattgtgagttcatgttcccaatactttaactctgtgcttactgtggaaactttattataggagaaagtttcactttagatttactattctcttcaaaatttctgtatatttcatatttgcttttgagggaatggtgataaaaatttagattcacattttttttcttttttagatggagtttccctcttgttgcccaggctgtagtgcaatggcgtgatcttggctcgttgtaacctccatctcccaggttcaagcaattctgcctcagccaccctagtagctgggattacaagtgcctgccaccatgcctggctaatttttgttttttgggagagacagggtttcaccatattggccaggctggtctcgaactcctggcctcaggtgatccacctgcctcagcccctcaaagtgttgggattacaggcatgagtcactgcacctggcctagattcacatttttatattaacatctaaaaggccttttcctgtccttccctctttttcctcttctccatccctttcctaactagcaatttaatacttgtttagtataattttacccttcaattgctaggcagttagagtgccagggttttttaatacgtggtaaagagtgccagggtctttttatacccagtacgggacctgataaacatccagttcaacctccttacttggaaaaaaaaaacaaaatgatactaaagccacacagtcaggtagtgatttagaactcaagccagtttttctgactcatgtccagtattggcctcatcacattgtactgtttgcttttatttgtactgtcttttataaattagtgtaattactttatttcctttccagaaattattttaaaattttatttagcttgttacctgtgtattatgtttgctatcaggaaacagctatatttgtttacttctttatagttttatagtgttttctcatcctttatctcatttatttgttgtgaagataaccttttgctcatatatctgaggttcttaaataatagcatgaatttgctttgttattgctggcatgcccatcacttctatacattcacagactcagctgctgtagagtcagacatgtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtatgctcggtgttcatgcttgttcaatgcatatttgagggtagaatgtgacattttaggttcactttatgagagtactgggtaaataagagttagagttaagctttttatccttgggtttctaatagctactgctaaggtgagccttatatgttaagattatctcaagataagactgcaactcattgcctcaaagttcaaaggagagcattggcttcaaggacataaatcattgtgttatccaccagtttacaacagaagtgcagatgaacaatatttatctagacaatctagtataatttacctgcagtttgaggtcagtctatataggggcttatgtaagtcctttgaactgtttcacagagatgagagttcaaatttatttttattctctagttggaagtagcaggtggttttgtgtgccttttccagcagctgcttttaaccccattttactcattttttaaagccttattaggttctgcctcaactgtggagctgtctgagattaattaggttatttgcaggcagaatttcattgtctggcactcagttgtttgctattcgtttcatatgtgtttttttttttttctgcacaagttgactgtgagctctgggggtctgagatatgtatcctattttaaaaactgtaatagccgggtttataaggtctgatatttaaagggaccatcacataaagtagataattgagccaggctagatagagctcacgcaaaaggaagaacatatgtcctagtttaaattagtctaattacagcagattcatcttgtggcaatgtgagattgattttgtctgaacgaagtaggtccactggcactatttggcctgtggccctttgttttgatacctctaaattatagcattgttctgaacacacagaaatgctttataaatatttgtttgattgaaagatgtttattgttttgtaatactggctacactgcttttgaaagactatcatagatgtaatatgtataacatgacgtgaggtatataaaatattctaatctattaaagaatttacgttttttgaaagaagatgcatatactggtaaaaagattgactcttaacctataatcaacagacttggatattgagtctttgctgctgtgtccacagaaagtccatttgatcactttccaagtaagaaaccaatgataatgcattatattaaatggctgcatattctgagggcattcaaaagaatgatataggcaattattaaaatacctgagtgccttgcaatttaaggtacctatttcttatttcttgaattctggagtaatttttcatgcttccttttttcacctctccaaaacaatattattagcatgtactcttggttcctcctttgaagtatctcatgcttcatttcttccatttcattcctgtagatactattctagtttgaacattttattactcatgttgggacatctacattaaccccctaactgacttgtatttcatatttagaatgtcttcaggtttttgtttttgtttttttaatctacttcttgggtcataaacatactcagattaaaagcaaaaacaggccagggtgactatctaggaggcgagagatgagatggactctttttatggcttttgatttttgaggtttctgaatgtattatcattaccactaaattataagtactcaatcattagtaataaattaaagtagtatattacctttgaaatttttcatttgaaattttgactcatatttaaaaagagaaaagtcttggctctgtcaagtattatttcaaattatagcagtaattttacttaaatattctggattgcaaaagcaaattggactcctactacccattttaagcagcaatgcttatataaaactgaaacaagaagtaaatctggcatgtagtagcaaaatttgggaatatatatgtttagggaaagtccttagtgggtcagaaatatagtcttctttagagactgataaaaaaaagtaataggtaaaataaagaatgatgtgctcaatgagctacaattcaaatagaggaaatttaatgggaaatgattacattagtagcagatggactggcttcctgaatttcagtgttactagaaatcctagaacagcttaaatttgtttttcaaatttagagtctgataaaaagacagataaagagatttgtttatttgattgtgctagtgtgattcttactgtcttttggatatttcatttgtactaggctatttttatgattcccacaaatccaccaccaacattcagaaagccagaactttggtccgatgatttcaccgattttgttaaaaagtgtttggtgaagaatcctgagcagagagctactgcaacacaacttttacaggtcagtgcttgtgcctcgaagggaaggatattttcttcatacctttcagctttctgacattggccagaattgctgtgtgtttcataactgatttctaaagatgtaaacctcccctcccctcctgtttgctcccttcttttctttcctcccctctcgtcccctcatttcccccagagtcattttaaaacaaaatttccaaagcattctcctttcagaaaggaatctttgtcttcatagttactatttctcatgttttttttttcttctgttccttgactcagcatttatcctttgactttttgctccaccataaaatatgtaagtacaagatccctggactccttgaagagattatcacgttgtaaatatcagttacaggattatctaaatgaagagcttcagagtttcaattttttttgatagaataattgtaagtagactttgtatccagaatgtcagtagattttaaaatctaccttaaaatttaatgcaaatagaaataatttaatatttataataggtgtttgtgaatcttaatttccccaacagaatagtcttagaactttcagctaataataagtatgtctcacattaacaaaacttgatatttgctaaatgatttctattgttaagtgacaaaaggatgaaaaacatggttcttgtaaaaagggacttccctgtctctaaaggaaccattgggttaaaagaacaaaaaaagaaaaaaggaaaaaaaaaaaaaagtaactttccaaagtcccatttttccaaaaggatgtattgaggggtatggaaaacaggctcttaagtataatgtttattgttatgaaagtgtaacttggtactcaatctccatagatgccagtacagcaatatctatttaaaataaaaatccatatattctttgatccaacagttgcacttctaggaatttattctacagaaatatttaaccatgtgtgaaataacatgtgtaaaaatattcgtagaacattgaaattgtaaaagattggaaagatcctaaatgtctgtcaacaagttggaaacaatttaaagtacaagaaaaagagttactggaaaaatacacctatgtacacacaacatatatacatatcttaatgcttataatgaagtatctctggaaaaataagcaagaaactggcctccagaaaaggtaactaactatggatggggcaggactgggatggagacttgctttttgatgaaaactgtttatgagacttttgcgatttgggttatgtgcaaatactacctttcaaaaagtaatggttaagatggtaaaattttatttttccacaaaaattgattaaaacatttattttgaaatattgtcaatattcatttgaaatatatatgtatgtgttatatatgtatattatatgtgtgtgtatatattttattttattttttatttttttgagatggtatctcactctgtcacccaggctagagtgcagtggcacctggctcactgcaacctctgcctcttggtttcaagtgattctcgtgccttagcctcccaagtagctgggattacaggtgtgtgccaccatgcctggctaatttttgtattattagtagagacagagtttcgccatgttgatcaggctggtatcaaactcctgacctcaagtgatccgcctgcctcagcctcccaaagtgctgggattacagacatgagccaccgtgcccggcccatgtattttttgagatagggtctcactgtattgcccccgctggagtgcagtggcatgatctcgctcactgaaacctctacctcctgggctccacctatcctcccacctcagcctcctgagtagctgggactacagatgcatgccaccacatccagctaacttttgtctgtttcgtagagacaggattcgccatgttacccaggctagtctcgaactcctgggctcaagtaatctgcccactttggcctcccaaattcctgggattataggcgtgagctatctcgccctgctgaaatatatatgtattttaaagtagtccaaagggtactacctttggactcctagtatccagtacttgtacatattaaagttaatatgtgtgtatttaacctaacaaacttctgatttaaatttttttttgggggggtaggataattatctttggcctcattagagtcttatttagcaggaagcctaggaaccattctgtctcttcaaggagttttgtatgtcttatctgttatgatttaaattagttgtccccaacctttttggcaccagggactggtttcatggaagacagtttttccatggatggtgagcagagttgggattgtttcaggattaaactgtcctgcctcagatcattaggcattagttagattctcataaggagcatgcaacttggatccctcacatgtgcaggtcacaatagggtttgtgctcctgttagaatctaataccactgctgatctgacagtaggcagagttcaggctgtaatgctcactcacctcctgctgtgcagcccagttcataacaggccaaggcaggtaccagtctgcagctggaggttggggacccctaatttaaatcatagtttaactctcagtggacaatctgattaccaaattttagttgacatatatctatagcttacgtgtacagattataccatattcatttccagtaaacaaagaaacaatatttaaaaagaaattcctgatggatttttaaaatagtgattgattttctatgacacagatagattattgtatacatttttaaaaatcatagaagggaaggatcctttgagattattaaattgaaattttagtagtttttaaagataaattaaaaccctggagatgttaaaagacaaggttcagtttcagtctattagcaccggagttcctgatctgaagatgatccttatacctgctggtgggcagccgagattctaaagtcagtaagtggccaggcaccgtggctcacgcctgtaatcccagcactttgggaggccgaggcaggtggatcacttgagatcaggagttcaagaccagcctggccaacatagtgaaaccccgtctatacgaaaaatacaaaaattagccagacatggtggtgcacgtctgtagtcccagctatttgggaggctgaggcaagagaatcacttgaacccgggagacagggattacaatgagccaagatcgcaccactgcactccagcctggacaacagagtgagactctgtctcaaaataaataaataaataaataaataaataaataaataaataaataaagtaagtcagtgagcagtcttccatgatctcttccctttttatcaagttggaaaacagaggtacttacaacacaacttcaaacaactgtaaagacaaagacagtgtcctagaggagtgtagagcaataagaaagaaaagactcctgtcctactctaaacatttttgacaaactagtagaaaggtcacacacacaccccaaaaacacacaaaaaactgaagttatattctttgagaaatgaaagacaaaaatgttaaaaaattataatacaatgtagaagttacattcatgatgcacagcctatatgattaagaaatgtaaaagtagaagaatggatatggtaatcacagatacctcatacagaagaagcagatcattttagggaggagaaatggtatgaacaatatgaacaaagacacaaaaatgggagatgtattttagaacacagtaagatctgcttagccagaatagaaacaccagttagagaagtggtgtctgagtttagatacagacaacagtgaagcaagaagggtattctgatgcctaggatgagatgcctcaattttgtctgagagccaccttacttacatatgtaaacaagagaatgtaagaaaagaatgtctttgataacataatattgcaacaaagtatagaaatagaatgaggaggcactgtaataatacaggtgtgaattgttaaggacctgagtttaaaaaaatagttgccaaaatagaaaatagtaaatctgatgaaagaatgagaaggatttagtgactgattatgtattaacagaagtgagagaagaccaacactacagaaactagaaaccagtagaattatatttctttaacaaagtatagaaaattcaaactacattatactttatcttctcaggggaatgtataaactacccttctaagctgcagttatttttaagaaaagccaatatacttatctggttcgtccaatttaccacaaccctgcttttatgcaattcattgtcaattcactatagtgttatgctacagttagtctatagagcttaacattcttaatctcaaaatctcggtatgtccaatttcatttgtactcatgctttccctacataactgctgcagacatggttttgatcaacaaagaggaactggctaataaagttaaaagggtacatgaagagcaagaccatattatttgagtattcttgagtcagaagagaagttttatcagacaaattgccaagtttttaagtacaagtgctccttaacttacaatggagttaggtcctgataaaccccaatgaaggtttaaaatattgtaagtcaaaaaggtgttaaaatacacctatcctagcttagcctagcctaccaaaaacgtgcccagaacacatacattagtgtagttgagtgttttgtagacgcaattgaatgtgaaaacacaaaacacaatatccaaaaaatgctgacaacacagtacactatagaatattggttaattaccctcatgatcgcatagctcactgggagctgggacttattaatacctccatgctcagcatcagaagagagtattgtaccacatattactagcctgggaaaatatcaaatatcagaattccaagtatggttcctactgaatgcatatcacttttgcagcattgtaaagttgaaaaatcctaaattgaacctttgtaagtcagggactatctgtatatttttaaaggcattttaagattagcaggtggtaaaattaaaactgcaaagcaacgtaaaaaagaatgcagaaaaaacaagatggcaaatgtaaaacatttatgatagaatattatgataaaacatgtatgttttacataatgtaaaacaattgtgataaaatggcattagcatataattatatactaacataagtggttaatttttttaaataatatttagttaagtactaaatggttcacttagttcataagataaatgcaactccatgctttctacatgagataaacttacaaacttacataaaatccaactcatgtttctacatgaggcatacttaaaagaatttgggttaaaagttaaaaacagctgtttagtggtctcttcacacggacgtgcatgaaatttggtgctgtgacttggatcggggggcctcccttgggagatcaatcccccgtcctcctgctttttgctccttgagaaagatccacctaggacctcaggtcctcagaccgaccagcccaagatacatctcaccaatttcaaatccgccactcccagagcccctggaactctggcccaaggctctctgactccttcccagatcttctcggcttagcggctgaagactgacactgcccgatcgcctcggaagccctctaccccatcacggacgccgagctttcggtaactcttacggtggaagaaaggaacggcatcagggcacattgaggctcagaaatttatattccaagaagaggtgcacaggaacagagcagatccaaagacaaccacctggaagcactcataacaacagaaatagcaaatcaatgctggttattttcttttgtcggaaatgagaaatctttatttgtccattcacttttctcaagagaagattttcggaggagccaagatggccgaataggaacagctccggtctacagctcccagcatgagcgccgcagaagacaggtgatttctgcatttccatctgaggtacccggttcatctcactagggagtgccagacagtgggcgcaggtcagtgggtgcgtgcaccgtgtgcgagccgaagcagggcgaggcattgcctcactcgggaagtgcaaggggtcagggggttccctttcctagtcaaagaaaggagtgacggacggcacctggaaaatcaggccactcccaccctaatactgcacttttccgacgggcttaaaaaatggcgcaccacgagattatatcccgcacctggctcagagggtcctatgcccacggagtctcactgattgctagcacagcagtctgagatcaaactgcaaggcagcagctaggctgggggaggggcgcccgccattgcccaggcttgcttaagtagacaaagcagccaggaagctcgaactgggtggagcccaccacagctcaagaaggcctgcctgcatctgtaggctccacctctgggggcagggcacagacaaacaaaaagacagcagtaacctctgcagacttaaatgtccctgtctgacagctttgaagagagcagtggttctcccagtatgcagctggagatctgagaaggggcagactgcctccttaagtgggtgcatgacccctgacccccgggcagcctaactgggaggcaccctccaacaggggcacactgacacctcacacggcaggttactccaacagacctgcaactgagggtcctgtctgttagaaggaaaactaacaaacagaaaggacatccacaccaaaaacccatctgttcatcaccatcatcaaagaccaaaagtagataaaaccccaaagatggggaaaaaacagaacagaaaaactggaaactctaaaaagcagagtgcctctcctcctccaaaggaatgcagttcctcaccagcaacggaacaaagctggatggagaatgactttgacgagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgagtgaaatgaagcgagaagggaagtttagagaaaaaagaataaaaggaaatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaccaaacaccgtatattctcactcataggtgggaattgaacaatgagatcacatggacacaggaaggggaacatcacactctggggactgttgtggggtggggggaagggggagggatagcattaggagatatacctaatgctagatgacaagttagtgggtgcagcgcaccagcatggcacatgtatagatatgtaactaacctgcacaatgtgcacatgtaccctaaaacttaaagtataataataaaagaaaaaaaaactttaaaaaaaaaaagattttcactaccttctccactagcagagatacatgtttgcattttgttaaattaaaagacatacttttttaaaattgtgaaaccctacagagagaaggtttaggttgaattaaaaactaaaatacaaataactcctatttttaaaagaagtatttattaatctctaagttaccttctctctctttcttctctctgtctctcttacacacacacacacacacacacacacacatacactctctctcttacccataggtttattttcctgagcttattttctcatctacttcttaaactaatatagactatgaatttcataagatagctcaaattgttttcagaacaagacaagataaagattaataataatatcagaatattctgcttggaaagacgcaagaagctgccttagctgtattctcaaggaaataaccttgaaaagtttcattaccatgtaactgtttatcaagagatacagaagagcttattgaaaaggtacttcatccaaaccacagtgaggatgacagtgctgatgcttcctgggctgctatttcccatgaccttgtcccaccccagcccaccccaaccctgctgttaactttcaatcttcagaagactgggatggaaaatgtcaatgcagtatttttaattttggtttgcataaaaatcacttggaaagaaatgctaaaatgcagattctatggcaacattcttagaaattctgattcagtttgtctaggggaggccgagaatttgaatatttagaagtaaccctctgccctcgctcccatgattctaacacatgtgatgatacacaccaaattttgaggaatatgatttaagtaaacttcttaattgtattcaatggtattggtatttttgttattgttgtagtaatgtaaaaagtgaaattaacctaataaaaatgtttcaattgtctgtttttatttaaaaaaaaaagttaaaaacaggcaatgaaattttaataaaatataaaaagatagtatgaataacatgatcaaaaaagcaaaattgacagcagaaatcagtaaatgaggatggagtcacttaatattgataaagaacataatataaaggaagatatagttataaacttgatatattaatatagcattgtatgttacaaattaaagacataagaggttgctctaaataaataaattgggatattttgatattccgttttcagtcactgagtaaccatataggcaaaaaataaacatcatctgaattatatagtgattgatttaatagaaaaatcaaattttatgtttaataaacaaattacatctttttgttaaatgcttagaaaagtatgtaacgccagtatgagatagaataatgaagcagaattaaatgcccacaaatggtatataatatacaaaggaaactagcatattatgaagatagcatttctaatcagtgagggaaaaacaaagtaaaaatggtgctgagataactgcctgcctttagggggtgttgggaggattaacttagatcttcaccacagaaacaccaaagtaatttccagatagattaaggtcttaaatgttaaaaaaactaaaacaaaaaatggaaataggaaagaactaggggttaatataggagaatatttatatattcattccggtgcaataaagcaaaagaaaaatggatgatttgaatacatataacttaaaaaatgcatgaatggcaaaaaacggaaactaaaaaatatatatatatatttatgtcaggcaaggggctgattatatgaagggttttataaagtatttcaacaagaaaaagatgaatgtaccagattctaataggcagtaaagttttcctatttctaaatgtgtctaaaataaaaattaaagagggtgaggattcttaaaccacctaaagtaatgagaagacagaaattactgcagatcaacctatcacattcttgatgatgtattttaaaaattgagactgcttgaaaagtttattcttttaaaatctgaaatatttcctcttaaattttgttcatgttctgaattatcaatttctaaactgatagtgttcaaaattaatgatttatacaaaaacacttcagataaaacaagtgcttaaagtgagttgaagaaggcatttctgccgctggacagattgagtaaccatatttttctctatacttcctcattaaagtacagctaaaaccatggacattgtaagtatataaaacaagcataaaaagactctaaaaggtggaaagaaggcaatagactgctagagatggtgggactcaaggaaagacatagctgtgagttccctggggtttctttttccctcatttatcccacactgggtagtggagaagccaacaacccagaaacaacattggacacaaactagaaataaaaacctgctctttcaagcagaaggacggagaaatggacagcctagtaagactgaaaactttcagatgataaccgttctactctagccaaacaccaccaagaaaactatggcctaccccggtcaccagcaaaggctaaatggagaacctagacttctatccttttgaggctgtccagtccttctcaggcggtgtcagagaaggctgtcatgctaaggcattcatctccacaaggcagtgtagaaagtattccctccctaagtggggagtgccagtgaagaccatgtgggagcctagacttatactcctaccaggcaggaataagaacccaacaacctccctgttggagtggggtcagaggcagtctggtgaagggtcaggactttcatcgccaatcagctaaaatgagactacttcccacagtaccagtacaggactctgggagaacctgacctctcacccttatccattagtaacaaggagccctccatagcccaggccaggaagtggaacacagtatttgctcccgcattcacttagtcgcatataaccacctgaatgggttaagttgagaaacgtaggatccagttgggcaattgtcggtccaaccacaactctatttttggtgtatgaccaggagtctctaccacagatatgttaataggacttaatttgtttggtaagattaatctataactgttctaaaataatttattggttctttacaattgattttagtatttctgtactctgaaaaagttctttcttatagttgtcccaaatgatatgtttgccattttaaaccctctttcaagtatctatttcttcttcagcacaattttttttgtctttaaatatatttttgtgttctcttgaagtttattaaaataactcagggctgggtgcagtggctcatgcctctattcccagcacttaggaaggctgaggtgggagcatcacttgagcccaggaggtcaagactatagtgagccatgattgcaccattgtgctcgcatctgggcaacagagcaagcccctgtctcaaacaaacaaataaacaaataactcactcactcagtcaggtcacttttacctgatgctatctactgacatgtaactatgaaaattactgaaactgattgctgccccaaatttaggttatctatccaaaattataacctttcactctactttctctcatgtccctccttctcaataaaaagaaattcaaaacctaggtctattctgatagttttccttctctttgtcagaatgatagagagcttagctattttagctagatcagggtgatattttttaaaaagtgacaagttattttatatatagtaaagaaattaggcaacattcattttctgaaaaaatatttttgtcttggttaaattacttaagatacaataaaatagaaaatatgttaaagaagtaacaaaatagttgctctccttttggccactgattttggctgtcaacttattaagattaattaaattacgtaactcagtaccaaaataagtttatttctatgtgtaatataatctgtaatcctatttttaacttaatcttttttactcctaatgtacacttcctttggacaattagatctttaaggatattatagttttattaacagggttgcatttttgcatgtgtgctttaagttttttttttaaacaagccccaaagcaaattctttatttctaggcagtggccatactctcttttcttaacctatacatttaattctagatgaaaaaacaatcattgaagcctgtgatcctggttaacatttacatgttgttttaacatttgttagctataattcggaaaaatcttttgaatttataccattgaattttacttttttagcatccttttatcaagaatgccaaacctgtatcaatattaagagacctgatcacagaagctatggagatcaaagctaaaagacatgaggaacagcaacgagaattggaagaggaagaagaaaattcggtttgtaattatcttcaaaaagttgatttttttcttctgagttatttgtctgtaattctgttaaaatatattaaaagcacttactgttttactatacaagtaagatatgttttttcattgaatctcaaaatatatttggtttgccttatatgtttgctatctttttctgatgtcttaagaattagtgattagtggaatgtaatgttgataggatgaacttccacagtacctagtatctagttgatactaactctgggtttgttaaataaatattgtcttgaatttatacagttttgtgtcatatcttctggaattttcttttaactggtcaccagctatgctgtagataaaacgtaccatagcaggagttgcaggtgggacataaaaaggcctagcatattaaactagctattaattccttttactttatattgatgttactacatttaaataacgaaataaaataattgtatttatttaccacattttgtagtgtctaatacttttttttttgaaacagagtctcactgtgttacctgggcgggagtacagtggcacgatcttggctcactgcaacctccacctcccgggttcaagcgattctcctgcctcagcctcatgagtatctgggactacaggcgcacactaccatgcctggctaatttttgtatttttaatagagatggggtttcaccattttggccaggctggtctcaaactcctgacctcaagtaatctacccacctcaacttcccataatgctgggattacaggtgtgagccactgcacctggtttgtagtgtctagtgcttctataccttgctaattattttttgcctttgtgtttcaagttatatatttttttctggataaagatatagaggagaataacccttggtattcaaatagtcataaaatctgaaaacacatgtattattttatgttttactgattgaaaatgtatttcgtaacagtatgttctcccataaaagttcattttaaaaatcttacagtttctgtatacaaatggaattattttgctaaattaaattcagttttaatttcagagactggttatccagttgggaattcttttgaaattcttttactctttttaccaattataaaaccttttatcacatggtagcccaggacaaggagaaatgtgcatctttgtagagctgatttataatcatgttctttagatatgcagctacatgagttatttatttggccgttgtcatggactacctagtgaggagatacttgaagcctgtattctagacttaaaatctttcaccaatgaattcattacttagaattttaaatagtgtcttcaaaaggtatttttttcaggtttgtcattgtgcattaattctacaaagatgagtaggtgatatgggagatgtaaagacccttggttcttgctctcagggggtttcatatttcctaccctggattcctgtgtgatgatagatacatttagtttcagatttctctccagttaatgtttctaaatgttaaatttttgtagttgtttcttgtggtttcaaaggcactttatcatatattatcagtttttactactttttaagactttgttatagtaattttggtttctttctgcccctttgggggtctctttcttcactatttttctttccttcgctgagcttaagtcacactagtctttcagatttttaattttttttttaacatgcttaagatctttccttactcagggcctttgcatgtgctatacccggtacttgaaacactctttttcttagaactcttggagtggctaggttcttttcttttgagtctcagctttaaatatcatgtacccccaaaacatagcaccttaaaacaacacacatttattatcatggtatttgtagattgctatttcaggagggtcttagttacgtgattcattctcagggtttcttatgagattgcaatctaagtgttcatcagagctgcagtcatctgaaggcttgacaagggctggaggattcacttccaggatggctcattcaggggctctcagagtgagtggtccaagagagagaacaaagaggacctctcactgtcttttatgttgtagtctcaggagttaaatactgtcacttctgccacattctatttatttatttttattttattttgtttttgagaccgagtctcgttctgttgcccaggctggattgcagtggcatgatcttggcttactgcaacctccatctcctgggttcaagcaattctcctgcctcagcctcctgagtagctgggactgcagactcatgccactatacccggctaatttttgtatttttagtagagaccaggtttcatcatattggtcaggctagtcttgaactcctgactttgggtgttccacccacctcggcctcccaaagtgctgggattacaggcatgagccactgcgcccggcccagtttttaaaagcaagtgagtggtggagcaaggagctctaagaatcagttacctccacagaagcaactatgttaaactggaaaaaactgacaaatcaacttttgcataactctggaatctgatagaaaacttaacagcatccaggggagtgccagattttgataagaaagcattatgacatttttgcttatatacctaatatcctttattttctagctcagcagcagctatggggccagcaacccatattcccggtgtagctcactggtgccaggacggggacaataagatccttgttctgaaaaaaaattgtagttttcattttgacctgtctggtggttccctgagggactggtgcagatacctttgtttcagccccccatgagctagagcaacttcctgtttgttatctgtcaaccatctaaatctgctagagctagtaaataaatttggcaaagtttcagggtacagcatcaaccacaaaactcagttgtatttctaggcaccagcaatgaaaaatgtaaaaaggaaattaagcaaacaatgccatttataatagcatccaaaagaatgaaatacctaaaatataaatttaaccgtggagttaaaaaacttgtacagtgaaaagtacaaaacattgctaaaagacctaaatcaatagaaagacatcttgtgttcagagattagaagacattatattgtgaagatggcagtactcctcaaatcaattcacagattttaaagatctatttccaaatttcaggtcattttttgcagaagaggaaaagtcagttctcaaattcatatgtaattgcagggggccccaaatagccaaaacatatcaaaaaagaagaaccatgttagaagactcacacttctgttttcaaaacttaatatgaaactgcagtgatcaaatcagtgtagtactagcataaggataggtatgtagaccaagggaatagaatagaaagtctggaaataaacccataaatctatggccaactgatttttaacagagttgctaagaccatttaatgggaaaagaacaatctcttcaacaaatggtactgggatagctggatagccacatgtaaaagaatgaagttagacccctatgttttatcaaatacagcagccttttagtataagatctgattggctggatcaacaccctacatgtaagagctaaaactttaaaactcttataaaaaaacatagggttattcttcatgactttggatttgtcagtgaattcttagagaatgatactaaagcagaaataacaaaaaagataaactgaacttcatcaaaattaaacatttttgtgcataagagaataaattatcaagaagtgaaaagacagcctgtagaatgagagaaaatatttacaaattatgcttctgataagggtctagtatccaaaatgtatagaagctgggtgcggtggctcatgcctgtaataccagcactttgggaggctgagacgggtggatcgcccgagcccaggaattcaagactagcctgggcaacataatgagaccccatctgtttaaaagaaaaaaaaaaaagcaaactgtatagagaactcttacaacttacaattgaattataggcaaattgttgttggttaccagagaccaggacagggcccagttgtggtgtgcagggtgtgggaaagaaggaaggatggagagcaactccttaatgggtacagtgttttcttttgaggtgatgaaaatgctgtgatactagatagaggagatggttgcacattgtgaatgtactaagtgccactgatttgtatactttaaaatggttaattttttgtatatgaagttcacctcaattaaaaaaaaaaaaacaagtcactaggtctggcctgcactcaaggcaataggaatgaggctccaccttttgaggggagaattgccaaagaatttatggttatgttttaaaactggctcagactatcctctggccgcaccttatttacattccttgcccatgcaaaatacacgcactatcccatctaccccaagtattatttctttacaatatcagctcaaaatctagaatgtcatcttctaaattacattcagatagagataatgttccttgggtccagttcctttcaatctgaagacctataaacaaaagagatgtttcttacctcacccccaccaccccgaatagccaatgtacaatggtgggtcaggcataaaattatatcattatgggtagttctgtttaaaaaaaaaggaagacaggaagtgcacgagtcactattccatagcagttttggaatccagccaagcaaatgttagaagtttcttcattaaaactaagttctattcctacctcaggatagtttttcatggctcctttctgtgttctctgagttttttgctctgcccactgagttcttcctttttcatggaaggtagcctgtgtgttgagctagatagttttctcagcctgcttcctgtggttagaaattttggagtccaaagccctcttttcatttcgtgcatctctgtgctatgcagtcaatgctggtagtgtttctgccaaaaacactttgtgggtctcctataaatctcattgcagcttactccattagaataatctatactcatacattttgttgagataattgtttccctgattttggcctcttgatgagattgtgcagggacaatgcctttaagcttcttagaagccctgttgaggaactgcatggatctgtcagaaatctgaacaaaggattttacagtcaccttttcagcttgatatttagaccataatttcctgactattgcctggatttgaggtttgcttgcaagctgtctcataactgtagcatggtttgctgtctatagaggctggagatttacaaaatcgacaagtctcagtccctcttttgtttaattgtcgtttcttaagcttatctctctccttttgtgtttgattataagcagcaagaagaaaccaggcaacatcttacatgctttgctagaccacccagttcattaggtacattttttacttttcctgttacttttctggttcctatagccaacagttgatatggtttggctgtggccctacccaaatttcatctttaattatagttcccataatccccatgtgtcatggtagggacctggtaggaggtaattgaatcatgggggcagttactcacatgctgttctcatgataatgagtgagttatcatgaggtctgatggttttataaggggcttttccctctttgctcggcgcttctctctcctgctgccctttgaagagttgccttgtgccgtgattataattttcctgaagcctcctcaggcttcatgtgaaactgtgagtcaattaagtctcctttctttataaattaaccagtctcaggtatttatagcagcgtgagaatggactaatacagtaaattggtaccaagtagtggagtgctgctgtaaaggacttgccttgtctcagatgagactttggacttgtacttttgagttaatgctggaatgagctaagactttgggggactgttggaaaggcatgattgtgttttgaaatgtgaggacatgagatttgggagggggcaggggcagaatgatatggtttggctgtgttgccacccacatctcctcttgaattgtagttcccttattcctcacgcgtcatgggagggacctggtgggaggtaactgaatcagggaacaaccaccccgttcttgtgatagtgaatgagttctcaggagatctgatggttttataaggggctttccccactttgctcagcagttctctctcctgctgccctgtgaagaggtgctttctgccatgattgtaaattttctgaggcctccccagccatgtggaactgtgaatcaattaaacctcttttctttataaattacccaggtattccttcatagcagtgtgagaatggactaatacaacagtttctaaattttctgccaccacataagaatctccttttctccagctttctaatatttcccttaccttcctgaaactttcttaaaggctgtcaggcttctgacagttttttaatgactcttcaggctcttactaaaactgtcttcaaagtgcttctagcttctgcccactgcttagtttcaaatccaatgataccaagtcgttttaggtatatgttacttggtcctgtccatattcaaggtgaggggaaatattatgagcacttaaaaattatgtcaggtttttatgatttttttttcctgaataaacatttattctctggggcaaagcttagtgtttctgggtaaaactcttatagtcttttttactgaaattataagaaaaaagtaaaaagtttggagagtcacacattgagcaatattcacatgctttcttcagattattttttcaggcagtagcttccattttgaggttattttatctgttgttgccctgcatagaaaatatacaatatgtacacacatacactctcacaagcacttaaaagaacgagataggcagaatgaatctgaagtctttctacagtaaatgtatatcctacattgccatttatttttagcaacttttaaaattagtagatgtaatttctcaggaaagtttatccacattgaaggctcagaatcttaaatagtttatatcatttattcctttgggattcttttgtgaattggcttaaattgaattacatatacagttttaaatcagctaatttatcatagactacacatctcttgatgttcagtaggacaatttatttcattgaagtgatactctttttcataaaagtaaaatattttttataaaatttacattcatttttgactaaatgaacacaaagtttaatctaggttgtgtatataaaaagcaggcatacaggatttgtgcagttagtactagtttaactctagtattcaaaatgtaagcatgcagtttggtaatttggtagttacacaacaagcagtattcattcttatgtatttcttgaacttagttgatgatttttaaaatactaatttgtaagtttgctggtatggcttattgaatattgtacaggtacttgaatgagtttttaaatatttatacagtaaaagagtacttgtttttaagtaaaacagcaaagcaaatattctacatgtggtacattggatgatgattttcaaagcagaatgatgttaattgaatttataagataaggcatagaatgtagcattgacatgctatttttaaagcactttaaaagactgataaggagtttagaagaattgcttgtcactggagctcagacgtttcttaaggatcacaatgttaagtaaaatacaaggagttaaatggatgtagaagaattttaagtgaaatgttgagcaaaaaatgggatactttttgatgttaagcttgaatgaaatcttttcacttttatgcatgtatcaggtcctttacttttatctgaagaaaggtgttatttgacttcatattaacttattaatgactcaaagaaaagaagtctaattggtcttagactatgtcttagagcttctatccttggaaaagaaatgaggactttctggtgacctcttatggtctgaactcagagctgttcaggttgcggtccttaatgtctgaataatgtcatgttctctttaaacatgcttcactaaagcaattaattctcagcatgggtgtggggagaaatgccagggtgctttgaataacccattcccctcaggtggtgatacagtttcaggtgagcatttcttagacagaaacttcccccgccttcccctctttccccttacccctgttcaatagggaccttcaaaagtctaccttctttttttctttgagatggagtctcactctctcgcccaggctggagtgcagtggcgtgatccccggcttactgcaacctctgcctcctgggttcaagcgattctcctgcctcagcctcccaggtagctagggttacaggcgtgtgccaccatgcccagctaatttttgtatttttagtagagacaaggtttagccatgttggccaggctggtcttgaactcctgacctcaagtgatccacccgccttggcctctcaaagtgctgggattacaggcctgagccactgtttctggccaaaagtctaccttttgagaaccttttgaattaggtaaagaaaagaacagcaggagaattagcccaagtcagtccagaagcctgtaatgtacttacttggtaaaagggaggttgcattatctaaaaatagatcatactatctggatgtgaattctagttctgttcccaaataactttatgtctttgggcaggttacttaacctctctacttcagttttaccatctgcaaatagagttgttatgaggatataattacatatatacacacctagaacaatgttttgcacatagtatgctcaataaagtttagcttttgtttttattaatgccactacttataccatcactactgctgttgtaacattttggccaggttttttgtttttgttattgttctgtttgtttagttttcgggttttttttgctggttgcccttactggttttgccctaccttgtggccaccaaaataacattactgatctggtgtgaactgatatagattcaattttttaaaaaacattttaaaacaaattttaactggtcaaatatgtttggaagagttggtagatattaaatctagttttaaaattaaaaataaatatatttgggccaggcacggtggctcacgcctgtaatcccagcactttgggaggccaagacaggctgattgcttgagcccaggtgttcaagaccagcctgggcaacatagtgaaaccctgtctctacaaaaaaaaaaattaaaaaacacaaaattagctaggcttggtgatgcatgcctgtagtcccagctatttgggagcctgaggtgggaggatggtttgagcctgggcagttgaggctgcagtgagccatgatcatgccactgcaccccagcctgggtgacaaagtgagactctctttatctctctctctctctgtctaaaaagaaaaaacatatatatatttatatatttattatatatttatatttttacaatatatatttttatattctttaatatttttatttttattaatatgtaatatgtatttgttctttactggttttcctaaatataagtatagatatgtatatttgtatacatatatttgaaaatgtgtataaatatacatacacacacacacacacacacatattttttttttttgaggaaaaccagtaaagaacatttacttattctcattcctttacatggtaaaaagtaaattttatttaataagaaatatttcagataaaattatttaccacaaattgaaaacttgtaaaagaattgattacttgttatgtctaatttttcctatgtaatcacaattaaaacaaattcttatatagttataactgtgtaaatactgttcacttatatcatattatcattacatgttatttctttttgtgattttcagaaccaataattgtctccgtttttgttactgttgttgtttttacagttttctaatcactagtttgttcccaaatgctatattcccaaactctctgctggatctctgagctcctctgtgtatgttcaaacacaatttattaatgccgtacttttttttttttattgattcatcccttcaatagtcttctgtcctttactaatcggaactaattcctctttaggagtgttgagcagctgtcatcctaagacttcctttcaacatcaacctgtggaatgtcctcttttttttcttctgtaatctctttatccctgatgctgtcttctgtctttcttgttttacttccttatttttatgtatcatatctcccagtagcttcctgacagcagcagtttttttcagtcattgcatatctgaccgtgtctttattgtacatttacccttaattgattgattgattgattgggtgtaaaattttggattgaaaataactttcttttataattttgaagaccttgctctttttccttgctcagcaataatgctgatgagaagatagatgccattcagatacctgattctttgaatgtttgaatgtgggagtttttggatctttgcattgtccctgttatttaaaactttcctaataatgtgccttggtatacatcttttccccattcatcgtatggagtgtcttttgactttttaaatctggaaacacccttcagttctatgtgatttcatgtttgctatttcttggtaattttcactgtctctcctctctgtctctggatctccttttatttggttgttgaaccttttaggttagtctttcaattatcttttctgtttccttttccctctttttctctttttattcttctgagattgcctcaagtttatcttccaaacttgctattttttcatatcagatatttaatgtctaagatagctttctcttctacgttattatttcattattattattttgagttatcttttgctccctgccttgtgtctgttcttttgtgtttgttttgatctctgacatttcactttatgggctttcttcaaatgtacggggattatatttgagagaagcactaaaattacctctggcagctctgtgtgtaagagtggaactagttgaccagcaaattttgctgtaaaagatgttagggttcactactctgaattcacatgcttcttgtgacttttctctttgcaagcttaagtcttatttttggtctgctgagttagctgcttacatatttatctgttttctaacttccaaacatttttctagcttccacatttttgacatctcccatatactgttatctattcaattcctgtgctgtttgtcttttggggtttatccttttctgtggctttattgtagttttgagagggttttgagagggataggtgtaaacctgtgtgttctaatctccattttgatgggagctcctgccatttgtaatttcttggactgttctaaaattataatttttattttattttttaaatcagtctatctatctatctatctatctatctatctatctatctatctatctatcatctatctaagacagtctcactctgctgctcaggctggagtgcagtggtgtgatctcagctcactgcaacctccacctcctgggttcaagcagttttcctgcctcagtctcccgagtagctgggattataggcgcctgccaccatgcctgggtaatttttgtactcttagtagtgacagagtttcaccatgttggccagacaggtcttgaactcctgacctcaagtgatttgcccgtctcggcctcccaaagtgctgggattacaggtgtgagccactgtgcctggcctaaaattataatttttgatattgagtttgtaatatgatctctttataaatctataaaaccctccgtatatttcagtgattaacaaactccttgagtgcccataaattagaacaattcaaagaaaaaatcatagtttgttcaattctgatttgttttagacaagttgtcaaagtgacaagcagggaagggaaaacttctgtaaggtagcattacaaggaatcaggacaattaaagcaaatcatatccaaatttatagttgattagaatagaagtaaatggtccaggcacggtggctcatgcctgtaatcctagcactttcagaggccaaggcaggtggatagcttaagctcaggagttcaagaccagcctgagcaacatggcaaaaccccatctctaccaaaaattcaaaaattagccaggcatggtggtgctcacctgtagtcccagctactcaggaggctgaggtggaaggattgcttgagcccaggaggctaaggttgcattgagtcgactttgcgccactgcagagctagaccctgtctcaacaacacaacaaaaagaatagacataaatgatatttttctttttcttaaccactgtgtcttttacaataattttgtctaggttatggaacgaaagtacaagcttggaccccttgttatctaattgatactgtgcttgacttaacatgtgtatctgttaagtcaaggttgttgcattgcaacctcttgtttgtgttcacagcttagcttggttacctttggcccatgaaactttctggttcttttctttttttcttttgctttagtttgagggattcatttggccattacctacttagttttggtactggggaactgactttcttttaggatatggcggaaagttttagatggatattttggtgtcccagttgttttcagtgaaatttttctccattcttttttctcctttttgattatttcatggatgaaaggtcttttcagcatggtgagagatctgtattgccaacttttgcttctgatttattttcagcccagaggacctgtattctctggcagcttttactgtagctgtttccagtccagactctggattggtccttaagcagtggtggagcaaataatgacacagagcaagtttagcattggaccattgaaaaatttcataaaactaactttttagataatgtagatcaaattttttctctgatttcagaatttcagaactgaaattcgctgctacattaagggagagatttatatttcacatcaagtattgatacttgggtctattgtgtgtggatcctgcattcttaacataattttcagaaaatgtatgggttataacaatataaagaaaaatttccaaatttaatttacttctatctagtttggcttattgcagttggggaaaaattaggggcctaaaattaaattgccattttcatcaatttataatgtggcttttaaaaaggaaatggtatatgataaccattacaagatatgttggtttttaaaattttagtgcatacacctgtgccctgggtaactattataaacaaatcttttaaaatattttttattcaagaaaagtatggagcatgattgggaaatagtgccttatgaatttgatttttatacctattatagaaaaagnnnnnnnnnnnnnnnnnnnnacaaattgcaaacagagatttctgtagaaggttaatccaatatcaaagtttttgtgttagtttaagtgttgttaaatatgacaaagatcttcttttggcatttctgagtatgtgatgtaaattaggtgttgagatgggtcaactgtattacatagtaagaattcgttttctggatattagtggaagatattcccaaatctttagcatgagttgattaaataatatatctgtttgttcatatttactgtaaacacttgaattgcttatggcaagtccacctttaaagagtatgtattaacaaaattggtctttctatgcaataaagcttcaaaatgcaacattttgttgttaccaaggagcattctacggtagtgttgtgtatgatataaagcaaatttatgggaattgtctctgccatatgaaagtttaaaatatattattgaataaatgatgctattttgaaaatagaatgtacttaagtgcattttttaaaagcatatacatattgaaatttgtaaaatattttaaaaatactctgaaaagaaactgcaaaaagtttttggtgaagtaatggaatacagagttcttgtcaatataaaaattgtagacattaatcacttagagtttatatgctttattacctctaatagaaacatgattctttgggatttgtgatactcgatatagtatgtaaaatatttaataaattgctatatcatttgagctttctctttgtggtagtggtggcttttggaaaaagcaaacaaaaaacaatgcttgatttttattctgggaaatttctcatttaatttttgtaggctagggcctaggcatcaggatttttttaaaaaccttcctaacagattccaatgtgtggcctgggtgagaaccactgacttatgggttgtagtgttgggccttgtgataaaacagataataaatatttgctcaaattaaaaagcaaaggattttctcaattttttaagttaactttttatttttgaatagttttaggtttatagaagaaatagaaaaatagtttagagagtttccatataccacccacattcagtcttccctgttattaatatcttatattcgtatgatacatttgtctaaataatgaaccaatattaatacagatttgaaactaaagtgcctattcttttcagatttacttagtttttacctaatgttctttttgtgttttaggacccatcaagttaccatattacatttagtcatcatgtctccttaggcttctcttttttaaaaaaaattgatatataacgattatacatatttacagggtaaagtgtgatattttgatacatgtatacattgtgtaaaaatcaaatcagaatatttagcatttccatcacctcatgcatttatcatttctttgtggtaagaacattcaaaatcttctgccattttgaaatatacagtattgttgaccacagtcactgtactatgcaacagaacaccagaacttattcctcctaactgtaattttgtatttattgaccaatctctccctaccacccctagcctctacaagcctcccctacctctggaaaccaccatttctactctctacttccatgagatcagcttctttagtctttctgtgcttggctaatttcacatggtatgtatataccataaaaatgaatgaaattttgtcatttgtggcaagcacgtatttacctggaggacgttaaatgatataagccaggcacagaaagggttcatgatgtcgcagcctctcggaatgtccttgtttttggtgaccttgagagttttgggtaataatggttagacattttgtagaatgtccttcaattgggatttttttttctaatgatgagacgaggcttattggtttttgaaaagacccagagataaatataagtctcatcacatcaagagtaaattattctgtcaacatgacttaccactgttgatgttaaccaggatcacatgactgaggtagcatgtcatgtttctttacagtaaaattattctttctttcttttcatactgtactctttggaaggaagtcacagtacacagctcacatttaagaagtggggggttattctccactttcttgaggatggagtatttagaattttttctacacaggagatttgtctcttctccccatttattcagtcattcgcatcaatattgactcatggttattagtttatattttggattataatccaatactactatgtttatttatttatttattttgcttaaattgttccagctttggccattgggaaccttttgttttgactcctttgtccctatgacatatccccatcattgtgcggttttgttttgtttttagctcttccttactctctgacactataagatattctaggctcatcttgtatatttcctgttccagtactagaataaggagcctacttccttttactggaaaactgtaggaaatcaagtttggattccagggggacttttttgtactgtgggatgttgttgcttctgtgccctctcagcttatgaggcaaggagaatatatgtgtgtatactagcctatgtatatacacatttataactatatatgtaggcacgtgtgtgtgtgtatatatatgtatgtgtatacatctgtatctgtattaaactaaacattaatttatactgttgtgtctgactctaatccattattattctagatgggtcctcttgcttgtttataacctacaactccaatggtgagaaacctggctcctatcattcatttactaagtttctcaactccagtatacatgtatagtggtttcagaattcttaacccatgtggaaaacatggaaaacaacattatcagttacactgcttatgtatcatttcttttgtctttagtctaacagaattcacagttcacttactccaaagttacttaggttagtaccttttcttctcacctccttcagtgaatttgtttcaatatatttttaatacagttacttttttttttttttgccacattctacatttcaccctgggatcccctgacctcctaaatttttttttttaattttgcatacattgggttcactctttttgttattgttgttgttgttgcttttgagactgggtctctctctttcacccaagctacagttcagtggcacaaacatagctcactgtcttgaacttttgggctgaagcgatcctcctgcctcaacctcccaagtagctgggactacaggcatgcaccaccaggcctgacttttttttttttttttttttttttttttcattttttgtggagatgggagtcttactatattgctcaggctggtctagaactcctggtctcgagggatcctcctgcctcagtaggttcactctttatgatgtaaagttttgacaaacgcatggtattaggcatcaaaacgatacacatgatacactgtactgtcaaacagaacagtttcatcacccttaaaaaaaatccattgtgcttcacataatcaactctcccccaaccccctttcaaccgctgatctgtttaccatttatagttttggcttttccagaatatcatataattggaatcatatattatgtagccttttcagactggcttttttcatttaacactacgttttttgtaacagtcatccatggttttttttgtggcttaatagcccattttatcactgaatagtattacattgcagagatacatgacagttcatttatccattaacttattgaaggccatcttcaatagttacttattagtttggggcagttatcaataaataaagctgctgtatacattcatatgctggcttttgtatggatataagttttcaggtacattgagtaagtatctaggatcatagttgctggatcttatggtatgttcagcttagtaagaaactgccaaactcttttccaaagttgtatcattttatattcctactaaccaaggaatgagagtttctgttgctgcgcaccagtagtttgtatggtcagggtttttgtttgtttgtttttgcattttaaccattctaaaaggtgtttagtggtatctcgttttaatttgcaattccttagtgatgaagatgtcgggcatctttttatatgcttatttgccatttatatatctttggcaaagtgtatgttcaatatttttccccatttttaaattgtgttgtctgttttcttattgtgaatttttaagagtttgtgtattttggatacgagtcctttataaagtaagtatttaacaaatattttctcccatttttgatttgccttttcattctttaatagtgtctttcacagagcagagatttctagtttttagtttttgccttttgtttttttagagacagggtctcattctttcgcacaagctgagtgcagtggatgatcatagctcactgtagcctcaaactacaatcctcctgcctcagcctcctgaagtactgggattaccaggcatgagccaccatgcccagctgaagtgtttagttttattatgatgataccagcttttttccatggatcatgcttttggtgtctataaattcactaccaaactcaaggtcccatagattttctcctgagttttcttctataggttttatggttttgcatgttatatgggtctttgaagcattttgagttaatttttgagaaagctgtaaggtctatatctgggtcctttttttttttttccgtatggatatccggttgttctagcaccatttgattaaaagactgttctttctccaatgagttgcctttgtgtcattttcaaaaatctgttgactatatttgtgtaggtctgtttctgagctctttattctgtttcaatgatacatcattgatatatgtgtgtattcttttgccagtactgtgctgttttgattactgtagtgttatagaagttttaagattggacactgaatcttccaattttctttttccttttcttttcttttttggacacggcatcttgctttgttaaccaggttggagtacagtgacagcaatcacggctcactgcagccttgacctcctgggctcaagtgattttctcacatcagcctcccaagtagctgggactgtaggcgcatgctgccacatgtggctaatttttgtattttttatagagatggtgtcttgctgtgttgcccaggccggtctcaaactcctgggctcaagcaatccacccacttcagcctcctaaagtgctgggattacaggtgtgagcctcttctcctggccaaattttgtttttctgattcagtattgccttggctgttctaggccttttgcatttccatagaaaggatcattttgtcaacatttctaaattaacttcctggaattcttattgggattgaatgaaatctatacatcaagttaggaagaaatggcattttaacagtattgagtcttcaaattcatgaacatggggtgtttctcaatttatttagatcatcttttattttttgcatcagtgtatacagatcctgtacatgttttaatatgttagacctaagtgggttttttttctgttgaaattttttttaatttcaaatttcagtcatttattgctggtatgtaagaaagcaattgacttttgtgtattgcccttgtatcctgtgacgttgccacacacactaatttttattagttctaggagttttttgtagattctgtgaaattttctacacagacaatgatgtcatctgcaaatatagatagtttctttccaatctttataacttttttcttattgtactaactagacctcagttttcttttaactttaatatgtttctgtatcctcactatgtttccttgtctccctggttcagaggttatatatttttcccatttataaatatggatatggaagaaaaataagacatggtaattgcctataagaagattgcaatctaatgagtgagacaaataaactgataactgatcataatgcaatgtagcaagtactgtgatagaggtatgcatgaacagtaattgttttattgctcttggttttctttttacttccctcaaaaggccccttctctgcttgtttctttagtcagctacattatccctttcttctgggccctttttcctcattcaaaatatagttatcctttgaccatttaaaaaataagggaaaaaacaacaaattatttacaactaaacttcttgatagcatagtcagagcctttgttttttcactttgcacttacactgtggctgaagtattctccagcagtattctctccaaggcgtatttctgtgtaagatgagatcactttagcagttatttaatttgcgatgtccataggtcatttaagtcattttgtgtagcaggcagttggatacagcggtctgaatcccaagggagaactcaggcaaattaggaaatcagtgctttccgcagttggtagttaaaccatgagcatagattggattgctcaaaaagtggttaaagaaaagtgtaggttgctgcttttgtcttgacatcctagccattgcctcctctggaaagaggaagcctttcatggggctcctccaggcttcagtttggcaagtgctcctctgtgttcaccatggaatactgcgtttagctctgagaatatttatctcactgtgtttgtctattttgtaactccccattaaactatacatttctcaaggaaaagattataccttaacacacttgcctggcacacagcaaacatttattacataaatatttaattggtaaatacttatcaaatcaagaaacacgtgtataaaactgttttaaacaggttttgcctgacttttactcatcattaaggatagtgccagccacaaaatcatcaacacagaatgtatttgcatttaataattaataaggtgtatacttgcacatgaagtatttcttcagcaatgcttaagtcaaatgtgtgaaaaatatttgggttgtgggggagattgttttttgttgccctgacatttttctgccccagaatttcatttttatcaggaagttcagtgatgtaaactgtatgttaaaatcaatattgttactttagcatgtttcaagtagtcttcttttgaattgtatgttttggaaattttctaaaattattttacaaaattatatctaagtttatgtaggtgatatttctgttgttaaaatttaaacaataaaaatacaatttatgtattaaaatttctgtttactaccaacaaaccaaaaagaacaacaacaaaatttctgctaactcttaaaaatactatcataatggaagagaaaaggaatgagagaaagaaagaatgaagaaaagaaaaaaatctttttaaagaccctttagcccttagttgtatttgttctaagaacataagatatatacaatcataaatcttttcatataaaagcaatttagaatgaagttttgataaattaatatgaatattcattatttacttttgtatacttctataaattttgtggaatcaccacctgttcattgagttcatgctattatatgcaagtggaggttactgaatgtgaaagacatttgttgtccttgaggaacataaacattgcttatataaaggtatcaacatgacagtggttacagtatttttaaatatatcactgcttaaaaatgtatcaagaaaccattagcctatttctgaaagctattgatggtatgttagttaatgtaataacctattttataaacctatttgtgtaaatctccaaatagtggaattttagtcttttgtctttggttccctcttgtggatgttttataaactgcttgtaagaacacaacagtttttaaaggtgtcattcttattttaaaatatttgattttataagtttctttatatttgtcaatcctttgacatgcttttggctgtgaaagaaaaaagaaatgtcacggttaaggttgcttttacttttaatttactctattgtatattagtattgtgcacaggagatgtaaggtaatcttttgtttggaaacttctcctataatgccaaaaacttgtacagtcttgcatcatggagcctctgaagtcctgcccacatgccttttcaccaattaggcttgttatactgatgaataagtcttttatgacgtttggagatcctgaaagctttgatgtaactttaaaacatgcctgtgaatgtgcaaaaagttaggatccatgaagtttctgtttgctaaagacaggtatgtcaaagacagcagctgtataagctattaagctgatttcgtagtgaaagggaaagaccacctacttacagcagtgagaagacaattaattctttttatagattttcagatactgtaaatcttagtttttaatgggtgaataccaatttgttacttttttcagcccgtcagacattgaagtggcacttaagggcggctatttgaaagagactatttttgatgttttctcagtaatttttagctcagttggatcagagttaccagttgacctactgtgggcaatttcacttggaacacagaaacaacaaacaggtacaaccttgtgtattaataacaaggacaatgggataactgctatcctttaccagagttggaagtacagtttcaaggtaatgctctgttggtcacatcagtagtttcaccttgctataggaaagagtgtttttagtttagtaggaatcttacatgattcgagacatacaagcaaatgtacgatagtaccctttgatttttgcctttctaactcagtgattaaaatatatttatcgacctaggttaacatgttagcatcaagcagtcaccagcccccgaattcagttatgcatggggaaagaagtgaaagattcttaccctagttttccccagttttgtgctcatcttgcagttgcattggacatgccttgttgatttcttacttgatgggaaaatgaataattagatttcatttccttgatcatatggtcaagtgacaaagtatagtaagtcattttttgattacaaataactggtgttacctattttattcaaattaaaatctctctcaactttctctttagattcagtttgatctctttaggttctgaatattggagttattgttgatccattatatttgactgcctagaaactttctagaaaatgttaattcctctttggtgatttctttcagattcagcttgtcatttctgttactatatgaccctttttagtacaggctctaattaattatcctcaaatctggattctagtaataaccgtctgattctagtctttctccagtctttcccttctccaaatcatcttttagttcccaaggttcctatcactcctttgccaagcaacttatgctgggctcccagtgttgaaagcatccatgagctgtaggacattccctaattcaatcaaacttactcattgctttccattctagctggaatatttctacttttgttctcggttatttctgcagtttagaatgccactgtctattcttccctaattttaccccaagatccagctttctaaggggactaaattaattctaaggagcaagggcatcttaattctgttgtttgttctttctacccattctcagtggcttgtttactcatgtatttatctttgggatagtgagttcacgtttggctagattttatctctgagaatggtgtgagttgagggttcagtatgcgtccctgtaatatggatttgtatttgtttctatcaggcacctggggtgctaccttactggggctatatttggttaacttctcagtttgaggttcccctagagcgtgtgagtgatgtaaaattgaaggcctaaaccatggttataaattctaaagggaggcttcccaatccctgtcccctaccttagggaggcttcccaatccctgtcccctaccttacctagctcaggtaagacttgtcatctcctttgccactgggtaaattgtttcttgcctatccttttgctgaggatgtagactttcaaaattcccaattttaagtggaggtttcatttgtactttggaaagaatccaaatacttcccttttcccttttatctgttaaaatataaaccttatttaaccactaatcccccacccccatcatcacatgcctctaaagaagccttcaagttagatttggcttattaccatagctccgttttgagcccttactatcttgaaaactcagctatgtatttgtagtatgtttgttacatttattgtttgctgtttaattagcacctttaagaggttttaaaaatatttagaccactataatgcaactttttgtataattgtttcaagtatatattttacacgtttttttctgaagaatatttttttcatgctatagcagaatgcatactcgttagaattgtccagttgaatgaaagccattaagatcactgctctgatactgatactatgctgttatgtgattgcatgtgcaataaagaagtgtttaatgtcattttaagaagaaaaataaaattagaatattttccgtttaggacacctgtttaaggagtagtctaactgtctcactaaacaggtatcctaactgagaaatattctatttttatattctaaacattttgagaatatagaaacaattttatattctaaagtgtttgtcttttgtgacactaatgacaaattagtctcacaagtgataaatactttttatccttaattcagtcaattactgagtatttagaaaatgctttaaggtagtagatattacaaatatctactagtagataatgcaaaatctctgattatttctcaggctgttttagcataagcatgtcttagcagtggagtaggatttcctaataatgttttcaaatatttgtattccatgtggattttatgattcataaactggattatcatcagtactgtgttttgcattcctggcacatgatggccactgattgaaaatgctattgtattccttactggaattggctgctttctacagtggggaagcatctgttctgcagacctttttctatgaagtatcaacatgtttttcttctgcttttcttttgtgaggaataacagagtatatgtaagtgaaatataattttgaaaaaacataaatgtttcattataaaaatataaaaagtatcaaatgaaattataatactaatctaaaatatcaagaataagttaagaattttaaaaagtaaaagctgtggcttaaaagttttcaacaccatcaccaaattataagtgagttttctaatttcgtttaactagttatcattccatctgtactttattaatttctatttgtgtgtcaccctctcattagtgaattgagtgttcatgctatttttattgctattttttactgtcaatttgtaaattagattagcattctttagcaaattgactacgtaagtaaaaataatatgcagtaagatcaatcccttccaaacttaattcaatgtttttacaattttatctaagccaattgtgtgaatccagaggttcaggctttattgtccctttgtagattcaactctaatgtagaatatagggaggctaaggactattttataccaatcagatgttatgtttcttgttaagtttaatggtcacagcattgaatctcacaaggataagagaaaaatgactcacacgtgttaaaatagagttagtgttttgggaataaactggttgcaaccgtgacaaaataagatattcaaccagcagatttgaaaaaaggaactgatagaaaatcatcttcatctctttacttcggaaaatgaaacatgttcttgcaaacctgtagtatgagttaaatggggcttgagaaatgctgtagatagtttaaaagccttacataattagaaggtaggtcttaggctttagaattagacctgcctagaattcttgcttctctacttatttgttgtatgaccttggacaaattatgaaacctatttgagcctcaggttcctttgcctaagaggaataatagcacctctgagggttaataagagactttttttttttttccctttgggatggagtctcactctgtctcccaggtgccatcttggttcactgcaacctctgcctcccgggttcaaatgattctcctgcatcagccttctaagtagctgggattacaggaacgtgccaccatgcctggctaattttttgtatttttagtagagatggagtttcactatgttggccaggctggtcttgaaatcctgccatcaggtgatccaaccacctcggcctcccaaagtgtcgagattaaaggcgtgagcccccatgcccagccgaaagagaattaaaaagaccttagcatagtgcttctaactcattgataagtgttttttcattattaaataaatgatcaactgaataattgtagttaatggcattatttcctgtcccaaagtataatatctttaatagctattctatgttttataataagaacatgttactagaacctcataaaattgtccttcattctgtgttttggcattacctcataatgaggcatttaacattcattcaataaattacataataagaacattgctttttaccagacatcaggaatacaactgtaaacaagatgtggttactgcccttatagatttgagagtctaatgggggatttagacaaggtaagtgaatagacaattacagtactgtaaaatcagcataagcacagagtactatgggaatacagaggcatgacacctaattcaatcttggggtgtctgagctgagaaggaatgtgtctgagtgtagttctaatgtaaaaagttgtaaaacactccacccaaatgtatctgttgtatgttaaatatatagtctactcatcttttaagagctgactcaagttcagcctcctctgtgagaccttcttcactttctaaaggcagagttagaggctctactcttggtattcccattttactgtcaacacttttcttgtagcacttaatagattgtcctgtaacttattgttcacatggtagtagatttcccttagatctcaaactccctaaaaactgaaatggaattaaactatcttattcatctccaatgtctggtgtactacttgatgtacaataaatgcttgttggatgattaataagtgaaaatataaattgatttattcattaaataaatatttatcaagtacctactgtatgctaggtgttttaataatgaggattcagaggttaaaacagtctcttgtcttcatcagacttacattctagtggtcgtaaaggccagatatagactgtgaagaatacagaagaatggaaaatgatggaggctttagtttagattggtggtcagaaaaagcttcaccgaagaggtcacagctaaatagatacctgagttaaataaattatcaaactgatttatggatgagcattccagtctgagagatcagccaatttaaaggctcaaaaggaagaacatgtttagaatgctcaagaaacagcaaaggaggtcagcttggttagagcttggtgagcaagaaggaatgtgataggagatgggattggcagatattactagatgggataggccagatcacatttggacatgataaaggttttggatcttattctaagtgtgataggaggccaaatgcagagttcttagcaggagagtaacatgtcatttgtcttctgaagggatcaatctgcctatgtgagtgagactaaaaggggcaaaaatggaaacaataagaacagtcagtaggctattttcatgctccaagtgggagaagatggtggcttggactagaatggatggaataatttatatgggactctgggaatagaaggtggtgatataagcttttaaaaattgtgagcttacatctccaacttaagcatttgagtagagaaaaatttaaacataattcaggtacatgtatatagtagaataatgggctaagaaataaaagaacttgtttcttagtcccagacctacttttaagtaggtgtgtgaccttagggaagtctcttattttctgtggacctcagtgttttcagatataaaatgatggtttgaattagtttctctctaactgtaaaggtccttgattttataattccatgaaaaagtcaatatgtattgaacgtgtcaacctaaatagcaaagactctctaaaagaaagtaacatttattttagaatagggcagtgcgagtaaaggtgctatacaaaacaatgtgcatattcggggggtaaaggaagacaaaggtttttaaaggaaaaatggggagaactgcctaattgttttgaagtgcttatccttgtgcgccagtctgtggttggataggcagttgctgggtagatgtcctcgcagtatttttcatgtaagattgcaatggcctttgtgcaagatagtggttctggcagtcttttgtgatagctttcgctatcaggcatttatgcatgaggaccatctctttatggctttcccttgctccatttgtcagggttggtttttgtttgtttttttgttgttttaaacagaaatgacttcattttgattctgacaactttcacaaacccttactgtgttttgaatactgaatgaagcactttagtggattcagaggtactctaagacattcttgtccatagggtacttacatttataaaagattttgcaaaacaattgcttgcaatatgagatcataaattgaatacagaagtgtctaatgccggttgtaaattctatggaagtttagaaaagagaataattaacaaagactgaattagccatggaagtagtagatacttgatctgaaactaggtatgatttagttaaatggatagaggggaaggaccttctggatagagaataagacgtacacaaaggaagtctttaatgaacatagcatcatatggagttatggcaaagagattcagttaaagtccagcctgcctgtattggaggttatatgaacaatgggaaaataggattggtccatagaagacattgaaatttaggcagaaatgtttagctttaatgaaggcaggaactgggagccattgtagattcttcattagaatgatagaaatagtattcaagaaaggttagtataatgccgtgtactttgaggaaggtgtgaaactaccttgttccaggtagcatgcaggcattttgcttacgtttttatttaatcatcaatctttggagacaaggatcctatgcctcataagtgatttgagccaggatttgaactaatgtctgtctgactctagaaagttagatgggagagtcctcagtcaggaagcattagctgcagtaaaccacctatgatgtagtgaggattatacccagtagcagtgggaatggaaaagaagagatggagctaagagagaattatttaaagaactagttgactgatgcatatatagggaatgaaagagaaaataaatgtaagaagacattgaagttttatgtagcaagtgaagattaccatgctttgtggtggttgttggggatggagacagataggagagactggagagataaatgaaataatatctgatttgggactgtcaaattttagacatctttaagtatttacgtaataagtaaagacataggaagatttcaggatttgagactcctcaacttattagatagttgaaggcatgagaatgaagaggtcttctaaaagagaaaggatcatgaaagaagtgcaaacgactttgagacctaatgcccaagcttagcatgtaggtttaggaagaggaaaggtatcaaacagctgtccaactgttgttatattatacaacccaagttgctgaaactcaacattgatgttctcagatttgcattttgacctctgccagaactagattttgcttatatgtttctactaaaaatggaataaatataaatgaatttccgtgcgtaatcaagtttttctaaatagcagattctttggtcctttctttctttttgaaatggggtcttgctctgtcaccccggctggagagcagtggcaccatcatagctcactgtagcctcaaactcttgagctcaggcagtcttccagcctcagcccatcaagtagctaggactacaggcacaccaccgtgttcagctaatttttaaattttttgtggaggcaaggtcttgctgcattgcctaggctggtctcaaactcctggccttctgccctgacctcccaaagcactgtgattatcagttggtctttcaaacaggatttgttaatttatttttatgaccctattccagtatatctttggtgaatgttctaaagagcacttttaatttgtacttttattactgacttgattcttctgtgaaacatttaaaagctgagatttgtcaacaaaagcaaaaaattgataaatcagacttcatcaaaattaaaaacttacatcaaaagacgctataaatgaagtaaaaagcacacagaatgggagaaaatatttgcaaattatatctctggtaaggaattaatatccagaatttgtaataacaacagaaaaaccaaacaacccattttaaaatgggtaaatggatatttctccaaagaagatatacaaatggctaataagcgtgcgaaaagattgctcaacatcagtagtcattagggagatgcagatcaaactacaatgtgataacacttcatgttcattaggatggctattattttttaaaaatggaaaataacaagtgttgccaaggatgtggagaagttggaatcctgtgcattgctggtgggagtgtaaaatggtatagccactgtggaaaacagtttgggcacttaaaaaattaaatatgaagttaccatgtgatccagcaattgtacttctaggtagatacccaaccaaactgaaaatagggattcaaacagatacttgtaggtcagtgttcacattagcactattcacagtagccaaaggtgtcaacaatccaaatggccatcaacagataaatagggaaacaaaatgtggtgtattcatacaatggaatatcattcagccttaaaaaggaatgaaatttttctaccacaatatgcatgaatcttgaatgcattaggctcagcaaaatatattgtatgattccacttacatgaggtatctagaataggcaaattcataagtataatagtaattatgaattagtactatggtatgaatagtagtactcatgaatttgcctattctagatacctcttgtaagtacaatagaggttgccagggctggggaaagggggaatgaagagttctgtaaacatataatggtggtggttgcacaacattgtaaatatacttagtgctacagagttatacacttaaaaattgctaaaatggtgaattttatatatatgtatttgtatattttgccataatttaaaagaaaaagctaatggctgttttacaaggttatagacatcattatgcccattataatacaaagtgtcaatgtgttctgtcttaaaggtgctctcatatatatttagttgttttgtcaccatattctttgttatgcatttgctgatagtttacctatcttaatccttattttaaaagcaactagcagccttctacttcatcagtttctgttgcttgatctgtaattacctaaagctttaggttattttgaataattttcactcttaaaataacatttgtatgtatgtatttatattaaaatcagtactaatagtatttttaataagtattaaaactataatatattcattctcttgttaagaattaagaaatccagctgtcatagaaaagtcttccctcattgcagtattttgcttgcaggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagtatgtggcttttttacattaaatattagttttctaattcgaaaggatacttttataggaaccaggctagttctgtgttactttttatagccaactgtggaaaattttgtttcttagatttatgtaacagtaaaaaagagtatggcacaagtcacctttttaaaattgtattttaatatagcagaaaacaacacatcttcaacttagagttatggaacttttttctgttgaaggttgctaacccacagcttaatttgcaaagtattttagagagaaaaagatagtgttcctaacatttactttcccaattaaaaaagtgaacctaaaattatcttccagtaaattcaacagactattattttatgttgtccaaattatcagttaaaccacaaagagcagtgcgagctatgggaagaaataaggtgggaaaataagaagcactagaaagaaggattaagagacagggatgctcatacagaagattcagttgcatgaatatttactgctgcttatcatatgtgaggcacagtgctgggggtgctgcagtggctaaaatgatgatcaaacattctctctgacctctgttgcttacaaagtgatgacaataggaatgctttcacagactagcacttctcttttttaaaaacagttttttaagatactgcagttaacatcgtaggtcattgtgatttcacagttataggcaaaaatgaattttctcttagcaccaactgacctttttcttcctgtcatgctcctaccctagtcctgtgtggttagtgtcaaagtctaagcaagcactaggctgctttccactgaagagtattgcctctccatggcagaacagcagaattacatgacttctagcattgtagaacctagaaaattgtaaatattcaagtgatttgctggtactgcaaaatggataccagaattttctctcagatacttccatttcctttttgcccacccttttctttttgctactcccccatgaggtctgacccataacttcaagtcacgtggctcagtactgctgctttcttcacattccctagttctgtgtagcccactatggttgcatatgtactttggatagagaggatcatgaagcacaaaatgtaatagattgctatattgccataatcctgggggtggagtatgaattttctatctcctgccattggtgggtcttctgtgcctttttcctggaaagcagcctacatcttggatttcctgaaattcctagctgggcatctgactagagtaagttttctgcatccataacgtgcctcactccactgcagaggatggtcttatggcctccagaaccagctagtgttggggtacaagtggatcacaaagactctgtggtaaaacagttaacacatttttcatcaacatgtaatatcaattttccataagctgatataatttttaactcaaattttatgattcttaacagatcaattagatcattgagtgcttttttgtgtctttagggagttactgagctccttatgaaactatatgaacaacttttcatgcagtcatatagttgaacatcagcatatatataatagttaagaaaaatgagtctttatagaatctaattcatttagattgcagtgtattatatttcaaggaagagagactaatgatgatgtttccgacatcatactttataccacagatttctgacattttgtatagtgacttttagatttgacatccacaaaaatcaatacatgttataattttgttataactgattgtataggtatgactttttgtcacagagattttagtgaaaaccaattttgaagttgaacagataagtggtttttatagctgcagttgttttatggacctcagcaaattttaaatcccatgagccaactttctgtgttttttgtttttacaagttagacatcattctgtaatgtgagacttcagtgtttccaaaattctaatcaagtgatgttagtataacccctagggattgtcatattgtagtatagcagtagtaaagtatgtgaagaagttattgagggaagacttactttttctgaaaccatataattattgtagttttgtttttctcgtgatctaaatctttaaaacttcttaaattagttggtatgaggtctcagcttatgtcacatcagtcaaagccacatttgctaatgtgtctttagcatttttgttccctaataagatgatagcagtatattatttttggttttctaaaatctctacaatgtgtactgaagatttagaatttcatctctttttccattggagtttcaagtgagttgcctgatttaacatccttgtcagtttaaattatgtttacacttactcttttatacctttaaccatgaagctagaaattatgggcctattttccttacctctagaaaggaaaattacccacagaccctttgaagggaagtggagaaaaatgacaaaaagtattttaaaatttgatctgccttttaaaaaatggacgtggaccctatgggcatgtcccaagaataactttctaaacctgtttttagcaatgatggcattacttttaccctcccgctcccagtcttcctattcagatatccctaaggcctcctcattccccatggaatgtccaggcttcagctgtgtcaccaagatccttcacagtctggcactagccattatttacatgtggatctctacttcttccttatggattatgttttatccatactagtctgtgccagttggaattctgaatgcttgacactgggtaaaagcaggttggttgtcattcaagaaaatcaatttaggatttcttatcctggagtagattaggaccaggtcaagaatctatgtcatcaaactgatggggtaggagagattatttcatcatgggtgactctgggagagtagtagcttcagcaaagaaagactggggctttttagtttgttcagctcagatctactcagttagctctgtttttatggaggaactttctgatcttacagagctgtggctagattggtagcactagttgccctggagggaaactatgtcttatgggtatctgaggaagagccatattttccagccaggtttttatttttcatgtgtgtatctgttgtttctccagataagtcacgaagtttgtcctggtaagaatgctgtataaatctcctctgccacataatagtacatgctcttggaatattggtttcatgaatgaatactaattacagtagagtcagagtcaagctgtgtgtgtgtgtgtgtgtgtgtgtgtgtgtgtgtgtgtgtgttatagtagaattaaagatacatagctctggaagctaagagaactttcaggtaaacctcctgccttggtaagatactttcttttcaagtgttctaccatccctgcttctcatttcacagagcagaccctctgaaaatgtgttccttaagatacccattcagtgaaattctctgataaatatagataaataatatacagtaatcagaattatttgggaaatgcatatttatcctagagataaattattagagaactacagtatatattattaacttattaaatacaaatagtacaggaaggaaacagtttaaaaattacattacccaaactttccttcacttatttgaccatgaaaagcttttaatgaggaacgtatcagtgattaacatcctgtgtaataagtatctgagaaacacattttgggaaatgctatcatgagagccctctagttccctgaccctagttcctagtctgctttctttttattagcacaccctcccttcacttctatatccagcttagaggctatatttcattatttcgttgcttctgccactctcgtatgttctaaactcctcttagaggctatatttcattatttcattgcttctgccactctcttatgttctaaactcctcttagaggctatatttcattgcttctgccactctcttatattctaaactccactgccctaatgtcttgtcttttctgcctctcctggaaaactttgatatggtccagtctcagtgttcatcttctctgcatctttaccctggctattgagtgctgctggagataatcttccatctgcacagatgagggctgccagatcaagaccttctcccccatttgggccctcaactttcctggaggcctgtgtttctctgttcagcaattcctcattctacagagtggctagtttagatcttcactagatctcttcttcctgcctcccatctcagtttcagtagatgacgttgctccctactttacagaaaaaaagtgaaatgttatcatgcaagtacctagagaagctgtataggtgttttaaatgtggtctttggaataaggttgaaaaattgagtcattcttaatttccgtttcttccttcacccttcatggaagtaacatctcatcagttctgccccctaaatatccctattctcttctcatgatctctgcttgcatttctttagtgcaagtcctcatagtttctcacttgtgaggcttctaaactgatcctctgcctccaatcttcattccctccccaccatacagatttcagcacatttctcttctgcttatgccctcccagtgactaccaattgcttataggctaaagctcaacaccagttaagaagcagtatatgctctggttcctacttacctttctattccctcttcatccttcttccagcttctcagctcttacagagcttttttacctttggccattgcaatgcctaaatcctcctgtgggatttatgcttcttttgctaaatcatattcattcactcaggctcagttaagaggttgcttcctctatcaaccccaggttaggaataagtgcccctctaataggctcccatctcaccccaagctttcactcttacagcactgtcatgctttattgtgagcgtgtgcttttgtttatttcccactgtatttttgatacctaatacaatacctagcacttggtaagagttcatgaaatgttttctgaacaaatgatgtggtatagtgaagagcatgggatgtgaagccaaatcatttagtaattgtgttgcttaattctgtctgagtttcagtgataaatatttgtctctctgttgtgtgtatatgtgcaggtgtgtgtattaggtaaattcaaaacatgcctagcagtgttttaaatatagttgataatcaataaaggataatattcatctgtccaccctattaatttatccttccaacaacttgataagagggagcatccgggaagccctgggcattgtcagccctgcttcccatgcggtgataaaaatcatatcttcctgggaccagagatgctgagctatcgagcaactctgttcttcccacggcaaattcttgcctccacctttccctgcctcctccaagaccttgctccatctctcttttttttagtaagctagtcaaaggggcttctatagagaatgatgatctccaaaatgaactgagtagcatcaacatgaataagaggggtttgaatggcaagatgagcaaatgctagagaagtactcagcgcacttggcatctcctgaccgagagtgtgtttgataatatctattgatacgacttgagatgagagaactgttttccactgtttgtgaaatttgacatctctttgagaaaatgaggagagtgtcatggaagtataaaagtacatttacattttattttatttttggaaatggagaaaaaggtgaatttctcaggttatagctgttactaattgagctcctactacaggccaaacactgtgcttaggattttgtatatgttatcttatttactcctcacaaggatcctataaaatagcatttcactaccatttagcactaaggaaactgagacttgggaatgctgttcaagatttcctagcaagtaagtgatggaaccagtatatagacacagggttgacactagaatcacatcactactctggggccagtgagctcaatgtccctcttgggcaggattctagaacatttaagagtcctttaggaaagatcaggatcgttataagtcagcatagattactgagaagaaatcgtatcagaataatataatttccttttttgacagcattgctaaacttcaaggtcagagaaaatgcagagtttgaatattgtatcttaggatattaggaaagtatttgacaaggtctttcatgatacccttgtagacactatgtagtgtgacctagctggtggtcctgttatgagagtgcaacagttatactcaaatgtgcttatatcagtgagagtttattggaggaaacagaatctactccaggtattccacacacaaagcaatttaagtcagagattgtattaatgtgttctcatattgctataaagaactatgtgagactgggtaatatataaagaaaaggggtataatttgcttatggttctgcaggctgtacaggaagcatggctagggaggcctcaggaaacctgcaatcatggtggaaggggacggggaagctggcacgtcctacatggctgaacgggagaaagagcaaagggggtggggctatacacttttaaacaaccagatcctgtgagaactcagccacgagacagcactagggggatggtgctaaaccgttagaaactacccccgtgatccaatcatctcccaccagtcccccctccagcactgggaattaaaattcaacgtgagatttaggtgggggcatagagccaagccatattaaagatgtagaagttaagaaaatcaatggaaagcctagaggagaaggctgtgtagcataggcttcaagagtgactcccacaacaccacaaaagtgagcatataaggaacaactactactgccacaacgaggaatagcaatccagaggctgccgctggcgccgctgagttcagtaatacagattgaaatcaaccctcactgctatttagggattagaaagctactaaatattactgcaaccactcctcagtacctgtgaaactggtgactagatgctagaatgctgctgtaaataatcaagcctctatgacagggcttgtaagaaggaaataactaaactagcaggcatatagcttctgtttgcttccccccaccgcccccaccaccccagttgcgaaagagtgcacttacccagaactctagttgcaaggaattctgagaaatgtggtgttcagctctctagcctctatgatacaaaggctcaccaggggcacacggcagtggttgctaaatttcagtcgactacaatgttaaataataaattgtttaccggaagatttctcattttgtgatacaggacctcggcctccagccctggctagctcaaaatttttcatagaaacttggatgaagctataaggtgaaggtccatcagaattgcaaataacatgaagtggaacaaaataaaaatatgttataggatagaacgaggatcctaaaagatcaccacaggctggagcagtgggcttgatttacaagataaaccctgcttttgggtccaaataaccagcctcacaagtatgtattgtaacagtcgctcttcagagatgctggtctgaagactagagcagggcttgggcatctctgcttttaaaatacgttttttaaaatttaaaaactctacaagtgcttctgaggtgcagctaggacagataaccactttttagaacaaggaaataaacagcttccctctgctctcaggagccagaactcacctggagtattgtgtttagaacttacctggagtatttaagaaggctggagatacactggagcacattgaacagagaggcagctggatggcgatgtaggtggagaccatgttgtattaagaatgggtggagaggccgggcgcagtggctcacgcctgtaatcccagcactttgggaagccaaggcagggggatcacctaaggtcaggagttcgagaccagcctggccaacacggtgaaaccccgtctctactaaaaatacaaaaattagctgggcatggtggcatgcacctgtaatcccagctacccaggaggctgaggcaggagaatcgctggaacccaggaggcagaggctgcagtgagctgagatcacgcaacagcactccagcctgggcgacagagcaagactctatctcagaaaaacaaaaaagaatgggtggagaaataaccggttatgtttaggttgtatattatttacttatattaacctttcataaatgtttatcatttcttaaatactgggttaaataatatttactaaatatacattttaaaaatgtcttacctgtatatgcatatagtatttgttgattttgaaaatttcagagtttattttggacagcacatatatgcagttttacttaattagtaagagaaagcaaatgaagttctgctttagctttttaggagttactctggaaacgatactagatattagtgtcagttgaggagagataccaagaagagaagactgactctactccctggttcatccattgttcctagacaaaatcgtgaagtatgaggcaatttgttttgttctgagcatctacttccatgccgtattctttgcttagtaatatctttctctcggttctcatatcctttccttcctcccttttttcccccaaaatctgttttggaaagagaccagatacacaggaataaaatgcctaataatgtttaatgctcatgaaatacattttctcccagaatcgtacagccttgagccaaaggagtaaatcactaaggatggaatttgagatgccaagaaataattggcaagggtaggagaatgtgtaggggaactactttctcacttaccattcttttatgaaaaactgttccattcctctttaacttaggaggttaatgttgcccgggatatgacaataaaggtgacagcagtaaactacaggtccctcttgcagctgggtgcaaatacccatcatatttctgggcaattagaaatcattcattttcctttacaaaagtacgaggaatccaggtaaggtgtggctgcagtggtttggagttccctgtgggcactgagtatagtctactattctgtgtgctcttggtccgtgggacgtttaacgaagtataacccagctcagacctgctggtgtatgcattttggttgtaggatacctcttttattagcacaaaacacacacaaggatgtaaatattagtcttccctgtaaaaatgaaaatatctttcctgtacaggccttggaagaaagcattttcatagatacagtgaccattacaatattcattactcgcacaggaactccttccttttatttaactaaaatctttgggcttcaatttttgtttccttctattctgacttcattggagattgaaaacagctggtcactattttctgtgcaaagaacccttcataaatacttggatacttattaagttctttctcagacttgacttttcttggctgaataatttcagtctctttaacctttgtgcaggtattattttctaagctttttaatcttttatgaatagtctgtggaccttctccatgttatgtttatccttctttgttttaaaatacagtatggtgaagttcaggaaaaaactgatgtcagtagcttctgtgttaacatcctggtttttatatgtattcactatactcttggcagcaaattaaaggacacatttcgaaggccattaatgaggtggaaccacccacatcttaaaatatttttagaagaacaaattaggtaatcttcataaatctttttgatgttgacacatactttactaaagttatgattgttattttattctctaaacttgaatatctttgtcataatcatgctaagaagttaaaaattaaattattttgttaaagtatttttaaaaattactttatatatttaaatttttatgaggactttttacttgtttagaagatgtgcaaattaggaaacttaatgaataattgtgggtggactgacgtattttctacggtattatatttctcacaatttagtttacttgtaaatgttttggggatgcatgaaggagatgaaaagcaacctttttctttaaaatttcttatccacaaagagaatgaatgatagttactttattctttattgctaataggtttttagttccatgagcaactagttgaaggaattagggccaaaattgaggaactaggtaattctgaacgttaaaattattgttaaaataaaatgtttttgtaagctggggtcagaattcggctgcagctggagaaattgatgtcaattttatatgattattctttttgtgcttaaaaaaagtatttgccatagcaaccacatcacatatgacagtggttactatcttgagatttcctgctttattttctcattgaagagcctagtattttttttaataaattgtaagtcagaaacatcatcctctctgtcccacttctgtgaacatgtatctccctggagactcagctgcgcattgtggcatgtgtttcatattgtgtagttaaacattactgggcaattgcagctgccccctcccattaacttttaaaacaaacctaacctgttttcctctttaaaattttttaaaaattgttttttaatctttttttgtgtgtatgacaaagagatactctaaatgttaatactaggttttaaattaagcaatggaaaatatttagaagtataagcacatacattatacatttgaataaaaaattaagtgtaaacatatcttggttaatagtatcttgttattaaatcatccaaaaagaaaaatctgacagaatagactccttcttttatttaagttgcttttaaaacttttgttaactctgtaagaatgtttatttttatcttaggagtgggttatttttaaaatttttgagtatggaagccaaaaggcattttgccataggttttttaggtcagcctgtaaaaaaacctttaaaactataatgtatctgagacgtagtgatatttaaactactctgtataatagtggacttcaagtttgaaattggggatgtttctgcagtgaaactgcagattgctgctccttctgcttctccctacatcctccatttgggaatagaaatgtatcagttaaggactgaatttgactgtatgtaccaataaacccaaataacagtgatttaaacaaaataagattaatttcttttctcatttgatgagaaatccaaaagcagagtatccggcactggcggagtgagttcatgatgtcattagaaatcatttctgtgacaccatcttttagggtattatgcttgttctcctgcctgcagagtaaatgtaggatctctagccatcaagtctgtattccaggcagtagaaaagagcaaaaaacagaaaggattgtgcctatatcaagaaaacagaactttcctagaaaaccttacttgatttttttttaagagaagggtctcactctgtcatctagactggaatatggtgtttgtgatcatagcccatagcttattgcagcttcaaactcctggcctcaagcaatcctcctgcctcaacctcccaaaatgctgggattagaggtatgagccaccatacctggcccaaacccttatttttatgtgtcattagccagaattgtattacatggccactttttccaatgagatagatactttctcacccctagtcaggaagctagggattatagatattagggaggcaaatttttcactttgagacactacaacattggtggtggcttatgtgacttcagttagaagctcctgattgggatgttgtcaggagcacgcacaaggctgttggggttggaagagtagattcctggaatgaaatttcctagtaatttcctttctttatttagtcaacaccaaggagtagtctgcttctcccctttctgttgctaccacttctctctaatcaaactgtttcttctctgactcattgcagaaaagaacattgtctttccttcagcctttttcttactctcctcatttctaaaggaaatgcctgctcagcccatctttctgttttgaaggtttttatagaagattaaaatttcccccactctgttctttgtagtgaaaagagcaacttctgagattttatttttctccttctccttcccagtgtatgctgctactcttaatatgtaggtcatattagaataggtgctctataaatgttagtttctggtaggaaaagattagtttttaatttactccaataatggtttgggtgaattttctcagatagaggtccaaagtaagagtcagtggtatatcaagagaaccctgactgtttattacagcactggggagtttgtaaagattctgggatgaagagtttcttatctcccagttgaggagaaaacaagaccataacgagagcctcagcagtgaagccagtgctggatgaaaaaaaaaaaaaaaaattaatgaaagcaatgtggtcctggcttggtgtggagagaggaagatgatctggggaggaacataggtcacagagtgctgttgtcttcactggattagtagtgccacaatgcatgctttttgtagtttctgttgtttttgttttgttcttaccaaagcacctacaaatactaaatttactttttaaagaatgctatctagaaatacgcttcagtgaaacctttcttttcattatcaaatgcagttgataatggtggtttaggagtttcttacttttccagcagttagtttctaaagaaaccattttttctctcctccctgattctgactttccttgacaaacttgataacccttattatataatactgaatgttaaagttttcagatgtatttatgtgtgtgacacattttaagacttcttgatgaaaacagaacttacaactaaatatataattctattacagaattaatcttccctttaaaaagaaaaagaaacaaaaagaatattgagcaaagaatttctttaagggattatcccccttctcccagctttatggtttgatttactcaattggtttataaaaaatatgtgtaagttgagctacacttgtaatttttttaaacttacaaaatggggcagaaatggagaataacaggttaaattcctagactctattttagtataagaggttaccatgggaaccgagtttcaattctgaatatagagaaatacgtcttgtaatgatgaagcctagagacaaatcaaaggtactaaaaatctgctgaaaatgttaatggaatgtatgtgtcctgtctaaatgtcagtaatgtaacccatcaaattaaccaatttctatttttgttgttgatttcagggaacaaagttgaagatgaacaccatagacaccatatctttatttttagcatatttattgatcgttgaaatattacaccttctcttctatatattttgttcatttttaacatacttgtaaagtctgttacgacaggaaatctaaaggcagctttggctgttttcatgctgaactgtccctaaggagtttctttttcatgagctttgaatgtgagatatgagagtgttctaagttctaaaggtttaccacaaatattggtgttttatactatcttaaatttcatagaatgtctcaatatctttacagtgggtaccatttgggtcccagatgtcttgtcacattttctagccatctaaagctggaacagctgtaattagaggattggtccttagataaacagttgtgttgagagtctttttctatttttccactaatacatgtatattctgaaaatcaggttctttctgactctactgggatagatcattctgttattacttgcaccagcctaataataattgtagtagtcacaatactttctcaaatacattatcagcagtgcaccaatgctagtaatgaaatacatatagcatctactaattcaaaagtaatgatgaaaaaccatggctcctgctgttgttcataggtattcaacatctgggtagacagtcaaaaacacaaattaatagagttatctgtgaaattatttaggtaaaggatttggaattctacattagggaacttacggtttaatgaaaagtaaagatggaaacacatttaaaagacataactcagcgaggtatggtggcccacacctgtgatgccagcactttgggaggccaaaatgggaggattgcttgagtccaggagtttgaaaccagcctgggcaacatagtaagacctcatctctacaaaaagtaaacaaaaattaaccgagtgtggcggtgcatgcctgtagtcctagctactcaggaggctgagatgggaaaatcgcttgagcccagaaggtcaagccttcagtgggcggagatcatgccactgcactccagcatgggagacagaaggagagaccctgtcaggcaatcaaatcagtcagtccacccacccatccatacatacatacatacatacaacatactcatagggtaaaaataaaaattacttttaccaataattatattattcacatgtttacattgtattgtaatcattcatttaatcagagattaggctcaaccatcaaaacacccgttagaaagcaaaaaaggcctctggatagatattaaaaaataagattacttgcaactaaagatctgcacatagagaaaaacttatttaaaaaagaataaataacacaaagccacataattagcaggatctctaagatgtatttctatactcatgttcataggagcattattcaacaatattcataggagcattattcaacaaaagtagaaaaacccaagtgttcattgacagacaaatggataagcaaaatgtagtatatacatagagttgaatgttatttattcttgaaaaggaaggaaatgctgacacatgccacaacatgaatgaaccttgaggtcattatgttaaatgaaataagccagtcataagaaaaacaaagaaaaacaaaaaaataccactttaatggattatacttatatgacatatccagagtagtaagattcataaaaacaggaagtaaaatggtggttgctagaggtaggggaaaatggcaagttgttcattgggtacaagagtctccattttgcaaggtgaagattggtcacacaatacttcatgctactgaatggcacatttttgatggtaattaaaaaaattttttttattgtggtaaaatacatataacctaaaattcaccatcttaaccatttttaaacataagcatacctcattattgcaatttgcttttttgtgcttcacagacattctgtgttttacagattgaaggtttgtggcaaccttgtgtcaagcaagtctattggcactgtttttccaatgttatgtgctcactttgtgtttctgtgtcatagtttggtacttttcacaatatttcaaaccttttcatcattattatgtctgttacactgatctgtgatcagtggtctttggtgctactattgtaattgttttggggtacaacaaactgcgcctatataagatggcgaatttaattgataaatgtagtatgtgttctgactgccccaccagcaggccattaccttgtctctgtctctctcctcaggcctcccttttctctgagacatcacaatattgaaattaggcccattgataaccctgcaatggcctctatgtgctaaagtgaaaggaagagtcacacatctctcactttaaatcaaaagctagaaatgattaaacttagtgaggaaggcatattgaaagctgagactgggtgaaagctaggcctcttgcaccaaacagccaagttgtgaatgcaaagaaaaacttcttaaaggaaattaaaagttctactccagtgaacacatgaatgataagaaagtgaaacagcctttctctttctgatatggagaaagtttgagtggtgtggatagaagattaaaccagtcacaacatttccttaagccaaagtctaacccagagcaaggctctaactctgtttaattctggaaggctgaaagaggtaaggaagctgcagaagaaaagtttgaagctagcataggttggttcatgacgtttaaggaaagaagctatctccagaccatacaagtacaaagtgaagcagcaagtactgatggagaagctgcagcaagttatccagaagatgtagctaagataattgatgaaggtggctaccctaaacaacagaatttcaatatagaataaacaagtcttctattggaagatgtcatctaagactttcctagctacagaggagaagtcaatgcctggcttcagagcttcaaaggacaggctggtggtggtgactaagttgaagccaatgttcatttactgttttgaaaatcctagggcccttaaaaattatgctcattctgctctgcctgtgctctataaatggaataatgaagcctggatggcagcacatttgtttgcactatggtttgctgaatattttaagcccactgttgagacctactgctgagaaaaaaagattatctttggactgttactgctcagtgagaatgcacctggtcacccaaggggtctgatggaaatatgcaaggaaattaatgttgttttcatgcctgctaacacaacatccattttgtagcccatagatccaggagtattttagactttcaagtcttattattaagaaatacattttataaggcaatatctgccgtaaataatgattgctttgatggatctggatcaagtaagttgaaaaccttctggaaaggattcatcattcttcatgttattaagaacatttgtgattcataggaggaagtaaaaagatcagcattaacaggaggttggaagaagtccattccaaccctcatggatgactttaaggggttaaagacttcagtggaggaagtaactgcaagtgtgatggtaatagcgaaagaactagacttggaagtacagcctgaagatgtgcctgcattgctgcaatctcatgattaaacttgaacagatgaagagttgcttcttatggatgagcaaagaaagtggtttcttgcgatggaatctactccttgtgaagatgctgtgaacattgttgaaatgacaacaaaggacttagaattttccataaactcagttgataaagcagtggtagagtttgagaggattgactacaattttgagagacactgtgctgtgggtaaaatgttacgaaactgcatctcatgctacagagaaacattttgtgaaaggaagagttaactgatacagcaaacttcactgcggtattatttaagaaacactacagccaccccaaactggacttctaagcagcacaggtgcctctgcactctctcgttattctccagggttctcccactgacactccagtcaaatcttagctatttatctgttgcctcggtctttttttgttgagagtggactagcaccaggcctctcttgtcagccatctttctgatgtcactcctaaacataacttttagaaaaccaaataccgcatgttctcacttacaagtggaagctaaatgatgagaatacatggccacatctggggaacaacacacactgggacttttcagagagtggaggctgggaggagggagaggatcagaaaaaacaaatgggtactaggcttaatacgtgggtgatgaaataatctgtaaaacaaacccccatgacacaagtttacctatgtaacaaatctgcacatgtacccctgaccttaaaagttaaaaagaaatttttaagaaaattgacgttgtgaaggcaaacaaacaaacataacttttatgtgcactgggaaaccaaaaaatttatgtgacttacattattgcgatattctcattattgcagtggtctggaaccaaacctgcaataactgcgaaatatgcctgtatctagttcaatagtattaatcttaagcacttccataaagttgtgcagccatcaccaccatcaatttccataactcttttcatcttgtaaaactcaactgctgtacctgttaaacgccgactccccatttcccactcctcttagtccctagcaaccaccattctgttttctgtctctatgatgttgactactctaaatacctgacataagtggaatcatacagtattttgttcttttgttactagcttatttcacatagcataatgtcctcaaggttcatccatgttgtagcatgtgtcagaatttccttcctcacattttgctaatgggcacttggcttgcttccatgttttagctgttatgaataatgctgcaatagacatggggttacagttatctcttcaagacctggctttcagttccggatatatacccagaagtaagatggtaaattttatcttataaaaatttttttaaaacacataaggtgaagtcaataaaacctctgttttgatatggcaaaccattttattttaaggcaatgagacagaatttttttaatgaataaatatcaccattaccactctctcttataacctcacctaagccgcctcacctaggcttccaatctgtcaaataacacacatagagatccaaaagtagggagaaaggaaagaggagataggacgtttacctgtcagttcaatctccgtcccccccgcttttgttttttgaagtttgattaagaattccggactctctgatttgccacataaagtaggcatcgatttaggcttccctcatatttttaaagactaaaaataagtcttaacatgctttcttttgaccaaaatgaccttaaagctcttcccaactaacattgttacttagttgtcatagtagtaactgtagttttcaactgtgctaggactattacaaatgcaatctaggttggtcagataactgttatgaatattatgtttctttttagaggaacagtgagactagaatgtctccataggcaagtaaacaagttgatgatgaatctgaaacatatatcctatgaaaggaactggggatgttttatattaaaaatagacagccaagacaggagccattacctctgtcttcagatatttgagggacaattatacgaaagagtaatttatttggaacatgagtgtaaattacggaaggaaagatttcaattttacgttttaaaaatactttttgtaacttgcagttgcccatcagggtcccttgtggggaggtgtactccccacaaaaaattcttaagaaagtagcttactgcctgaccaacatggagaaaccccatctctactaaaaatacaaaattagccgggcatggtggcgcatgcctgtaatcccagctacttgggaggctgaggcaggagaattgcttgaactcaggaggcggaggttgcaatgagctgagttcgtgccattgcactccagcctgcacaacaagagcgaaactccatctcaaaaaaaaagaaaagaaaaaggaaagtagcttactttctatttggagaattatatgggaaatgccttcttggtggtctctgggacatttatttggagccctggggctttaaggatccaatttgaaaaccactgatcaagaccaatatagccagattaaaaatctagttattccaaatatttatttcctatttagtcattcagtataaaaaatgaagagccattgaaagattctgagcagaatgacatcttttggtttgtatttagaaaggtcaccactttgacaatatggaaattaaaatcaaaactgtgatattggaagcaaggagactagtttggaggctgctacaatggcctaagcaagaagtgattagaagctaaactaagacagttgcaatgataagtagagaaaaggggttatagttaactgtactgagaagtagaattaaaagacctaataatcagtttgctatggtgggaagggaggagtctgaattaattctcaactttattattttggggattgagtaaataaggttgactttagtggagatagaatatgtcgggggagctgtaggtttgaagggaaagatcttgaatttagttttagaactggtaaattaattggcaactcacctcagattaagttgtctaatagctagcaaagttagttatggaacttaggcgcaaagtctgggctagagaagtagtgttgggagacatggatgtaagtgtggcaggcgaagccatggaagtccagggacagagggaatcagaaagactgaggaagcagtttgataaatataagaggaaactgagtaagttcttatgattttttttaatttttttaaagtttatgtatttcatatatatatattttttaatttgaacagggtcttgctctgttgcccaggctggagtgcagtggcacaatcatagctcactgcagccttgacctcccaggctcaagtgatcctcccgcctctgtccccaaagtagctgggactacagataggtgccaccacacctggctaattttttgtattttttatagagacagagtttcactatgttgcttaggctggtcttgaactcctgggctcaagcatcccttccaccttagcctcccaaagttctgaggttacaggccaccatgcctagccaagtcctcataatttcttacagctgaaaatgtacaataacaatagcaatgcaggcttaaatgcaaagaaaaaaagcccaccaaaaacacctgagtttttaaaatttactttctttgagaaatttgaaataaagctgaaatgatttttaataaaattctgataatgattttactaaacttctgaaatgtttctacaatctaaacattccagacctttgcctaatcatcagcttaatttttatttggtctgggtattttttaattcttattttatttcactttgttctttatgaaattaattatgttggccttgaatctgaccagtgcaaatttattatatggcttcataaaaaaatcatacttcaaagaaaatacttccttaaatgtaagaacttataccttccttatgttctttgtttacctaaggaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttgtaagtacattttaattcttcaatttatgttttctccttctatattttatcatcaaattgagaagcatagttcatatgtatatgaactgtgtgtatgtatatacaattatagaccatatgttaatattcattatacagccatatacatggttagagaaattgtgaaactgtagcttgcttatagaaatgtacttgcagagaaatacttttttatagttaaataaatcatagctcaaatttaaataaatattcaggactccttaaaactaaaaatgacaactattttaaaagatgttttcaataatgcaaatatgagatacttctgacattcagtaaactcagttgccaaaattaatgaagcaaaggtatttatgacatagagtttgagaatttgcttcaatttttaaagtatatgagttggtttctatttgagtaagtgttaattccacttggtttctcagaaataatagtcctattctgtacctaggagcatataaacttcagtataaaactgccttatcacctattttgttacattttctcattatttcttctaccctggttcttcttacttcttttaaagaatacataaaatacagatgaactattttaaagtaactgtttccagaacttgagagagtaaattctcaaaatgagttatttaatggagtgaaaattttatggagtaaatttttacttaaccacattttaaataataatgttacttttgcatattgttctggaagattttttttcccaaacaaaataactttataatcctttatagttttatttattaataaacgtatggataagtaaatacaattttagataaatataaatatgtacattttttaaatttaagaatttttaagtaataataaaccattttgcttagacaacatgactctaaatgctttgcaattataaatattttaagtacttttttcctcaatattgtgattgagtttttaaataatcagataataaagtttcaaaatctatccccaataaatttagtactaattgctagcaaatattagcagtataattcacaggttagcttgcaaacatcattgcaatgtctacttaatattttttcaatattgtagtaagcagttagaaaaataaaatcaatacatctttagtcctaataagatttcattttaacctatctacttttttaaaattataaattatttagaatgctgacatttaagctttaaattattcatgaatataatgaataatgtagagtatttagcctcaaagagttgtcttgtgtcagttggaataaatcttttttttttttttggcataaatttaagggtacgattgctgttttttaaatttacatggatatattgcatcatggtgaagtctggacttttagtataaccattacccaaataatgtgcattgtaccctttaggtaatttctcatccctgactcccttcttcccctctcacccttccaagtttccatagtctattattccgcactctgtgtccgtgtgtacacattgtttagctcctacttatacgtgagaacatgcagtatttgactttgctgtttctgagttgtttcacttaagataatagctaccagttccatccatgttgcttcaaaagataagattttattcttttttatggctgagtagtatggaatacatcttaatgggctctgagaaacactttgaaatgagctacaaagtaatgaataaattatcatggttaagaaatggcaaataaaatgatttaactttgcttcagttaatctttctaccaccccaaaatttaatggcttaaaataacaactattttactttcatcaaaaccacaattttgtaggttaatagtttgtctaggtttatctaagtgtttcttctgctgggcttacctggggtttcttaagtgactgcagtcatctgctgacttgaatggggctgaacactctctctaaaattacttcccaaatgtgttggcaattgtgctaactattggctaggtcatatgatctcatcaggcaagcctggagtttgtatgtggcagtagtagccttccaagaaggtgaaaacaaggttgtaaggcctcttgacatcagcgtaggatctgcacagtgtccattgataatagcatcaaaaagaatgagatacttaggaataatcttaaccaagtaggtaaaagacttgtacactgaaaactgcaaaaatatgggtgaaagaaattagatatcaatacatgaaaagacatattcatagattataagctttaatattgttaggatgttaatattgcctaaagcaatctacagagtcattgtcatctctgtcaaaatcctaatgatattttttacaaaactagaaaaaaactcatcctaaaattcatatggattctcaagggaccctaattagtcaaaacaatcttgaaaaagaaaaacaaaattgaagatctcatgtttcctgatttcaaaacttactaccaagctactgaaatcaaaacagtgtggtactgtcagaaagacagacatgtagaccaatggaatagagagctgagaagtaaacttttcacatctatggtcaaatgattttcggcaaggatgccaagaccattcagtgggggcaaagaagaggcatttcagcaaatcgtgctgggaaaactggatatccacatgcaaaagaatgaagttggagtcttactttacaccatatacaaaaattaattcaaaatgggccaaagatcttacagtaagaaataaaactaaaaaattagtaggaaatacatatgagaaaaacttcgtgacattggatttagcagtgatttctaggctatgacactaaaaacaagtaacaaaaaatagataaattggactacatcaaaatggaaaacttgtgtgcatcacaagacactatcaacagagtggagggcaaccaatggaatgagagaaaacatttgtaaatcatatatctgataagaggttaatattcataatgtataatgaactcctacaactcaacagcaacaaaaaaaaaacccaaacagtccatttcagaaatgggcaaaggggctgggcatggtggctcatgcctgtaatcccagcactttgggaggctgaggcgggtggatcacctgaggtcaggagtttgagaccagcctgaccaacaaggcgaaaccccacctgtactaaaaatacaaaattagctggggtgtggtggtgcatgcttgtaattccagctacttgggaggctgaggcaggagaatcacttgaacccaggagatggaggttgcagtgagccgagatcgtgccattgcactccagcctgggtgacagagcgagactctgtctcaaaaaaaaaaaaaaaaagggcaaaggacttaaatagatattcctccaaagaagataagcatggctaataaacacatgaaaagattcaataattatcattaatcattagagaaatgcatatcaaaactacaataagatactacacacccattcaaatgactattatcaaaacacaaacacataaaataacaagtgtttctgaagacgtagagaaattggaacctttccttgtgcacctgctggtggaagtatgttgtagtcactatgggaagcagtatggtggttcctcaaaaaaactaacatagcattatcatataatccagcaattctacctctgggtatgtaccaaagaagtgaaagcagggtctcaaagaggtagttgtacaccctttttcatggcagcattattcacaatgacaaaaaggtagaagcaacccaagtgtccattgatggatgaatggattaaaaaaatgttgtaatacataaaatggaatattgttcagccttaggaaagaaattgtgcaatatgctacaacatggataagcactgaagacattatgctaagtgaaataagccaggtcacaaaaggacaaatgctatatgattctacttatatgagttacctataatagtcaaattcatcgagatggaaaataaaatgttggttctcacgggtgagaaatagggagttattgtttgatgggtacagagtttccgttttgcaagatgaaaaacgttccagaagtggatggtagtgatgcttgtatgagagtgtgaatgtaaataatgccacttaactgaacacttgaaaatggttaattttgtgttatgcatttttttgcataaaaaatgcataagagaagaggggaaagaatttgcacagtgtcactgttgtcatagtctgttgtcaaaatatgtcagaagtctagtcctaattcataagatatggaaataaatttcacctcatgatggaaggaacagcaaagttacatggcaaagggtgctatgagatggaaggaattattacagtatactttgcagacaatctaatagaaagggtgttaattaaaattcaacagaaattagaatgttgaatttaggaaatcagagttcattaatgattttgataatgaccattgcagtactctactttcagatttttcacatacacacaatttttgacatgtagccttctactgtctgtcttagactcattttagttttgtgaatctatttttccaatggctaactcctgaaagtaacttttggaaacatttttagcccctcatagattttgtagtcattctatctggaaattccaaaatttgttagaaaacattaagctaatttaacaaatattttactttggattgtgctaggcactgtgggtaaaaataaattatactgatttattaagaggacaaggtatgagttaatgaagtggtaaattgtaatccagaacaataactcagacattgccatgtggttttgaataagagggagatttgatgaaggctggagttgtatatgaaattataatgtggaagaggactttgtctaagcattgataaatggatagcagaaagagagaaggcaggaactacaaggaatgatgtgtaataaaaagcttagcagtaggaaagcataatctgtgttgggtggcaatgaaatagagaccttcaagtctgtggtagttaatctggaaaaatacgagagataaaatggaaaagtagatccagatcagagggtgaaagcttgcaaggttacagagtctgaatatttatttaatagacagtggaaagccactgaaggttttaagttggaggatgacatgatgaaaagtatcttaagaatattaatattgaagatagcatgaaggattgataggaagagactcagggtaggggaaatcggttatgtggcacaagcttaaaataatataggaataaaattgaaaagaaaaacaagaatgaggaggaaagattaacagaaatagctgaaatactagattgaagagtactattttgattagttaaggtgaggaaccaaatgataaatggtgacagtaccaaaaaaaaataataaaggaagatgttctcacagttggaaagggatatcaagagatcatatgactggatccaatttttgcagagttatttatttttgacttatatagggcagatagccttaaaaagggaattgcaggagggacggagtgactagaacagttcttcctttctcaacatttattacacctgtcaactggaactgctcaaccctctcatcactttgaggaaagtggaaaatgtttgtaatcgccactgagcggaatggaaatggaaataaataagagatgaataaaggaagcattgccagaagatgaacaaataattgccaagagtagtagtgagtatggcaaaagacaaggaaaagggtgtaagaggggcaaagagagaatggttaaaagaagaagcataggtggagcacagcgtaagtgatttggtggactgctttgctcacaaaatggggaagtggactaaaagcaaagataccagctgttaatgagggaaatctggtcttattcattccctcatctattagttacagaatgttaaaaaatatgactcattaaagtataaagcatactaaggtttatgtgtttatcttccctcttcatgatgcatctcgaggccgccttctagaagagaactgtattttatataattcctaagtctatttgatagaagttgcttaaaataagccaaagttgttttgaccatattttcaggacagagaaggcttcatccttctgccttgaggaaaatgggttctaagaaaaaaaaatgaaagagaacactttattgtcttttgaggtactcagagcagattcctaaaggacaaaacttattcggaaaggcacctgctagacagatgtgcagggtaggaagcattccttgtcttaaagcctgtatgcaatagaatttgtgtacttccttttaaatcgttagcatttgtctttgggattttctatggattttcttatgttatgttcctgaatgtaaggagatgataaaagaatttatgatgtcaccaaattggggattatcataaaaagataggagataaaatatatttgggctaattgaattatttttaaccctaccggaaaaaagttatgtttaggatgtgcttatgaagatttctaaaacaaatgtaaaaggcaagtctgtttattatagcactagtctaatgtttcagtttttgttagaattatttccaaacagccttaacatccagattgtttagtgttaaatagagagcatgtagataatgttttgcagaaattacagtatcatatttaaatagatatattttgggtaatgtaaagattttggaataagaacaaaaacttcaaaagccatctgttaacccactacattggttccaaattttaaaaaagaaagaaattggattgacagtaattactagtataagagaaattaggtaaatcaaccatttttggttgtgactcatactgaatagtaagttaacatttcttaattactctgattcttaaatatttattcagttggtggtgttcttttgagctaagggacacaagaatcctccagggccacactgaagaaaaagtcccaaaaattgtggcagagaagggaaaaaaactaactttgctccccaagtataaagttgcctggggctttcctagtttttccgcagtcctacctttgttgcctgcattagcaagtgagtatgattacagggaaacaaaacaaaagtcactgttgcaaaatgcagaaaacagtaaagggttggcagagaaagtaccaaccctgctgctggagctgcccatggacattttaggaatcttgttctggagaaatgtttctttctcagggtcttttcaccctcctctatagccagcaactgtgaaggagtgataaagaaactagagtagccccgaaaaagaggagcagggccacccctttagtaagccctcagcaacacagaccctgtagacagcttaaggtaaaaacttaagccagcagcatctaccagttttttgtttgtttgtttgtttgtttgttttaccagtatagcagcatgttatctgctttgtttaaatgcaggtaatgtttctggttttaaaagagatattggctatagttttccttgtagtgtactccttagtcaaagaactgcttgttctctacagtccttagttctgtggactgaggaaaccacttcagttgagtgaagtatttaagcatattgtcatcgattacctttgcattaattaaatgattattgtcaagtatttccagatgtttgcaagagtattaacaaagtatgaaaagacaactatagatatttcagatttatttcttctagggtaaagaagaaataaacacacaaaatcccaaatgttccagtggatagctttggataagagtttatgattacaggtgtacatgtggcatgaactcaagtgtatgtggcatattgtgctttcactactcagtcattccttgtagagccaacaggaaattaaaattaatgagaagcctgcactttgaaatagttgcagaattcttgactatttcagtcctttgccagctcacgaaatctgtgctggcagtcatatccaacagatggtgtggcgtgtgcacagttgtgtcatgtgattgtctaggtccatgtagaatttttatgaggttttgaccatccgtctgctgaggcatttaagatagtcataacctttgttttgaaaggaaagtgacctgcttcaaagaaaagtgtttatgtacaagtagaaaataataatttagtcactgggcagctaaactagatttaattgattcttcggtaaaagcaacaaagattttagtgtctctgaactgctgcactggtttttaaaatttttttctttagtagaatttaatccacttggctatctgaggtagaatgagcgtttcactttcttattcctaatggtgctgtttaaggcttccataatttctgaaatttttatttggtggttgtgtctaggcaaagtctactgaaacattaagctaattctgcttatttaggtaattaataccttaagttaaaactcattatatcatcatttcccttacaaatttaagtgagcaggcctgtacttattggattaattaagatagaaagcacaggtgcagtatgtggtttcttgtcaacatgttataatttattaagatgtttaaagcacatggcaaaagaaaaatgacttacaaaaagagctccaagaagcacaaactctcctcatagtagtttgctctttttaaaatgtcatttatttagaagattacattgaaaaattgactactctacattttaaaacaagatattgtactccaagcatatgttgtggctaatgttgatgtctaaggaagttattttgactatgtgggctttctattcataacccaattttggatgtttagtcagtaagcactggggactattggggtgattacatcaaaagagatgttaaccaatagtggaatttaggatcaaagagtggacaatgtaatttatgatcttctaatttaagactgatagcccaacagtgtttaccttttgaaataaataaagcattcgatttcaaaaaagttttaaaaattgattgaggaaactagtaatgcatatatcaggttgtgttttgatgatggaatagttttgtacttgaactgtcatgaaatttctttaaatctaaaattatttttgtaattttatacttaattcaggttttctgagtatgcatagtagttcactatcagaaatctttctataactgacttccatcatacttctcatgtctatcttccacagttagaagtatgcacatcattgtttgggggcctatcatatttgttggcctacttgaattaatgctgacaccttttcctccttcctgccattaggttggtagccttttccatagtacctctcattcataaaaatagaaagccctcattaggttggtttcttcatgttggaagacttttcagtaaataatagactttttttaaaaatccagaatctagttgtcttgattcaaaaccaaagtagtcttgttttgtaattgtgttcatcagttgttgaaacacctttccagaacgatagacagaccttaaggagataaatgagtgataggggcattcaaactaatgttgtttctcatagcagatgaaagtattttggaaaaaagataccttactgatttattttgaagacacatttacatggttctcaacagacctttttttcttcatgaattcagtaatggtgcatgttgaaatttgatatgcagtatagtattattaattattaaggcatcttataaaaggctcagtaacctgggttagagtatcaagtttcattctcacagaccttcagtttagtttttaactctctatcttaatttgagaatgcaaatgaaactacctaatagccaaggctacaaatatataaatatataaaaagttaattatcggccatattcttgtactaactagtccagtggaacgactagcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccatgaatttgggactatttggcatggaaaaaagtatatgagatcaaccagagagacccttgaagagagatgattaccaaaaatggatttctagggtatcccaaatgtaaggtgagtggggcaggaacagtgagcagaggctggctctatctacccatggatatattgaaccaagcttaaatgtaggccgattacagctgtcacctgagaatttaccatgagtaggatttcactgttttttttttttgtggggaggtagggggagtgtgggggcaggtatcagtctatgcttgaacttaaagaatagttttagctatcaagttttttgttagcagttttttgagcattcatcctaccacagggtgtaaataacttttaaacagttacaactcattggcaatatatctgaaattactttttttaaaaaacatactttgaagcatgctctttctaatctcccttttctgactcttaactatgcctttggacaaatgctacaactttttggtcactttcatttagtaaaagtctgggtagtttaagattttaatctcaaatttgatttaagtctcacttgatccttccccaccctacatcttagagaagaccacctaagtggcctaagactgttggcatgctttctcccctcctaggtctaattcttggagagagaggggaaggaggcagcatggaggaaggacaagagaggcagaggtcatcatctgagtgaacgtggttatctgaagatagtgggtctcactctggcataatctggttctaagtgctgcaaaatgtctctgacaatatgatgttcatgtggttggaatatgtggttttcttgggatgatagctttatcttggcttcctttatcactgagctcttcctcagagatgggtagctatatctcctttctgtttcataagttcaaactcctcccctctctctagatggggcattgatgtgtttgaccagcagcccttgcttcttccccagtcctggttctctcatatgagccatgggagtcagtggtgttctttttctagggtctcagagaattagtgggtagataggggaaatgtgagaggtactctccacttctcccccgccccacccaggtatactatttctgtggccctattaggtctgctgctgcaggctgctctacccaagcctcccatcttcagaaatctctagataagaagtagacaagtttctaggccaatatattttccccaacttctagggacatatgccaggtcatctatgaacacttcagcaggctaaattctactccactggcagcaccagggcaagtttgcaggttctttattcagtattcagtccagctggaaagtgagacgccagtctcctcttcttgcaggaaaccacaacgtgtctttgatgtaatatcttggtgctgtgcaacttggcttgagtgaggaagctcctatgacaaaaactgcaccccagtgctcctgatgtacccttgccctcttatgtaggctgggtgatgatttgggagtggtggggctcattcaacctctgagtaaactcaaggttggcgatttggccccatttggttggtggctgtcttcaagataggtggtgcttgtacattatttttgtctttgttgtgagccttagtctcacaattcaggggacagttaaacactttcagtcagcattcttctgtaaaaataaacattactgacatgactgacattttagagcatttcatgtttctttctctacagaaatattttagtttattttttccttcattcatcatttattcagtaaacatttttttgtgacagccttgttgcatgccaagcggtaggcactgccaacttaagcaaattgctgctctggaggagcatttgggtatagacatatgaacacttaattattttacccatagataaattgaccagacaccactgatctggaaaatcaggttgtagtgaaaataaccagacttggaaataaaaccatgaaagtgaaaatacgaaattttaatacaagttattttttattgaacagcaatgtctaacattcagaattcatgctatctaagcttacagaatttccagtggccctgggtacataggaccatgtaatcacatggaccagactaagaattcttatagatcatttacttaaagatttagttttaggttttttcaaggaaggaataataataatgtctatttttactaactttttggtaagaaatttttagcttcatacaaatattttattaagtgcatactgctcacatgtggcacatattgtttatgtattaattctttatgtcatctaaaattctaaactgagacttcttcaaaaattatacttatcttgtatctccaaagtaatattttatactttgtctatttgccttaaacaagttgagtctaaggcttaactgtgaaacagaattcatactaaggaacttagaacaattcagaccaatcaattactatagtctctatttattgttttattgttctgaaagttaaaaacaaattacatctagattacaagctaaaggttgttttaaaacattatgcaatgttctcactcataggtgggaattgaacaatgagaacacatggacacaggagggggaacatcacaatccggagcctgttgtgtggtggggggaggagggagggatagcattaggagatatacctaatgttaaatgacgagttaatgggtgcagcacaccaacatgacacatgtatacatatgtaacaaacctgcacattgtgcacatgtaccctaaaacttaaagtgtaataataattaaaaaatttaaaaaaaaaattatgcaagtgggatttttttcacttcagtttctgtttcgtaactaaaacattaaaacagtatcactggcaacaatttaatacataacctctaacttaaatgaatatttctttaaagttacctttattttgtaatttaaggaaaacctgttttatattaatatttaaaacaagcatggaaaaatcagctgctgaggagaggcgaaatatttttaaaacacttgagcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagagaaggcattcaggaaacatacccagttcatactccatttcatattgatgtacttaatatatttagcttcttgtatttagggtagcatcaattagctctcctttaagcgaaaatgttctaaaatacttaggtatgactatatttaaaatatagtctttttttgaattttagaataaaaagaaatttaatatttttaatccttaatagatgcaaattataggtgtgcaaaacatgtagtagctacttgtatgtttaagattcagtatcttacattgttatatttttaaagttatgggatatgtaaatactgaattattagatattccatttgaagtgattcaaattcaaaaaatatgaataagcatttgtctcaatagattttattcatttatttaataagaaccacttttgttttaattaattttccagaacatgagaaaatattaataaggtatacacattgaggttagaatatgttattattcatattttttgagaccgatttaggattacttggtttaagtataaattaatatttaatgttctaattttatatttttttctagaataacacactaacaaaactcctttttagtttttaatgttcgtttgttcaacaaaagtattttcagtgacttctatgtgcctttcacctccctttagaaagtaatgcagtcaagggagccacttgcaaaatatctctgtattatcaattacttcacccaccttactcacagggtatcctattttacctattttatgtcaccgttaggctttaaggtctaacacagtcaagctgattttgccatccaatcaaatcaaatgcttgcaaaattgaagcaaacagcatttttcctgttcccagctgtgctagctactttattaaacttaaaacatacttatttataagagaaatttttaaattgatgtatttaccttcagtatgacattttcttgtttgttcaaatgagaattctagttgtaaaaaaaaactgcatttaaatattttatagaaattattaatagtggaaaaggatactagttcataatatcattgagagcagctgtgaataaatcataattagtcaggatttatttacagttttaaaaaaaaaaccctctgatgttacaggggctgaaaatgaaggcaaatatatgggtgagggtagggagcagggggctgtttggcctggtaaaaattttgtaactatttgcaaaactgattaggaaattggaaggagaaaaagaacacacataaccgtcttcagacatagacaaaaataggacttgcatatttgtggcatgcctctggattaggcattaaactaaatgtgactgttcaataatacttaatagcagcataacaaaaggggcatctattgtctctagtaattcttctttacagaaatccattacgtattagaataatgtatgtcaacatcattcttttattttgccagtttctgctttgatttatagttgtgtgtaacccggacaccaatattgataggatcatttaaaagcttagaacttttcttttttaaacctttcttttgaatttattctaagttaccatttaacaaaatacctgatattgagtcctacaaaatttcaaaatagagaacttgtttttatttaaaaagaagtgatttgaataaatgtcaataagcattagatattatactttaaataaaatgttagtaagttttagaaaagtattagattttcacatctttgttattgaggtaacttatgagtagaaaaatagaatttttaatagaatatggtaggtgaatcctttaatattggtaaaataaggtttatttacagtcttgttaaaaagctgttggccatagtacttctctttctgtatatgtcttattcctcagtgtatactttaatttatgattagtttaaagtttaaaagttttaatctgtgatgaactctaggcttaagtttatggtatagtttattttatacactgttcttaaaaagctattcgattactaggtaggattctttcaagtaaaaatttaaatgtcaaagtaattctccttaataaaataattccattaggatgttttcattaaacttaccagtctcttaataatctgcacaatagtcatctaagtaaaacttgtatttttgtttgtagtttatataaaacagcctaagtattttaatgctgtgaatctagatttttaaatgagtacactgtacattttacatagacacatctatttataattatgagcataaattataagtgtaatttctgagatgcttaaagatataataaaatttatattgttataccaatcttaagagtgcctaggaaaactttaaagaaccacccaagaaactgccatttaattctgtctaaatatattttgtccaagttaagaaaaggaaagatattttgttcgtataattattttgccttctgcaagctccctttcatcatatgctgaatctctagcaggttagatcattaaacttttcagatgaaaaaaaaagatggttggggaaagactagttagtacctgattgggcaaatgtgggtcgagttttgaaaacctttttatttttttagatgagtttccctgagtttttgtttactcaatttataaggtatgtaagaatacatcattagttcttaccttgacctttcctaaatcttttgtgtcattaaatagaacaaggctatgcagttaaaatatttatttgaaagtttttagaatcctaataattttgcttactttaattaattactgtcaaattgtgatagtaattgttagtcctaaattgttaagaactttattttaaatttgttttcccataattttccccaaaattgttttatttcttaagcaatccaaaacataaccagccacagccacataaaaatttttaataaaaactttattgagatataattcacacaccatataactcacccatttaaagtatgtaattcaatggttgtttagtacatatacagttttgtagctggcactataatccatttcagaatattttcatcattatcccaaaaagaaaccctgtacccactagtagtcacttcccatttcctcccaacacccttttctttttctagtcctaggcagccactggtctacttcttgtctctgtggatttgcctgtcttgacattttgtgtaagtagaatcatacaatatgagccacaactattccttctacctttctagtagataggtgattattacagcagggtgactgtaatattgctgtaacttaggaatttgccacctatgataatagttaacataaagtgtttcctgaagcagtatagataaaaacttgaagtctgaaataaaatatttgtaatggattcatcaggaccttaaatactagggtagtgcagtctacttcctatatactagaaatcagttatatgtaatacatgcctggcactgttctagatattcatgatatagcaacaaataaaccagacaaaaatctctaccttcacaaagcatatactgtaatggagaaaacagtcaataaccataataaattagtaaagtatacagtttgctaaaagacgataagtactttggagagaaaaaagaaccacgtaaggtaatgaggccggtgttggggtaaagggcttgcaatattgagtagaatggttggagaaggcttcattgagaaagtgacaattgaataaagacttgaaggaggtaaaggaccaagcagggagtgagccatccggatatctgaaggaagaacattccaagtagagggaccagcaaagactctgaagtggaagcttcctttggtgtgttgggggaacactaaagtgatacattgattttgggcagctgaatgagtgagggccagaacataagaagatgaagttggagagcaggatagggaagtggtagggtgcaccagatggtaggcttctgaaggtattgtaaagatttgggcatttgttctaaaagaaatatgtagccatagagaaataacttgatctctaactgactgactttaaaaagtttactctgaccacatttcagaattgattgagtggggcaagggtagaagcagtcatccgggcaaagagcaccagagacagtaagaactggtcaggttcctgataactttttaatatataggcaacaaaattgtataactgactgaatatgagaatgaaagatccgggataattccaaggttttttgtttgaacagccaggatggtgttgcctataactgaactggggaagactgtgggtggaacttgttggctgggaagttcttctgcatccaggtgggcataccaaatatacgattgtgtgtccaaattgggagttcaagggagagttctaggctggaatttgtggtaatcagtatatagatggtatttaaaaccatgagactgaatgggatcttcaaaggactctccaaagaaatgagtatatatagagaagaaaaggggtctgtattcatttcccatggctgctgtaacaaagaaatgagtatatgtagagaagggaaggggtctgtattcatttcccatggctgctgtaacaaattaccacaaattgagtggcttaaaacagtagaaatgtgttgttttacagttctggagccaggaatccaaactaaatcttaacggggctaaacctgagttgtagcagggccacaccttctctggggaaatttgaactaagtgttatgaggctaaatcatgctatcagcagggctacaatccctccaaatactctagcagagaatctcttttacttttcagtatctggagctgcattcgttgagtctttggttctttctccattttctttcttttttttttcttttgatggagtcttgctctgtcgcctaggctggagtgcagtgtggtgcaatctcagctcactgcaacctctgcctcctgggttcaagcagttctcttgcctcagcctcccaagtagctgggattatgggcatctgccacttcacctggctaattttattattagtagagacatggattccattccaagatggccaaataggaacagctccggtctgcagctcccagtgtgattgacgcagaagacggtgatttctgcatttccaattgaggtacctggttcatctcactgggactggttggacagtgggtgcagcccacggagggcaagctgaagcagggcagggcatcacctcacccaggaagcacaaggggtcaggggatttccctttcctagccaagggaagccgtgacagactgtacctggaaaaacgggatgcctccacctaaatactgtgattttccagtggtcttagcagaaggcacaccaggagattatatcccatgcctggcttggcgggtctcatgcccacggagccttgctcactgctagtgcagcagtctgagatcaacctgcaaggcagcaacctggcagggggaggggcatccgccattgctgaggcttgagtaggtaaacaaagcagcctgggaagctcaaactgggtggagcccactgcagctctgcaaggcctgctgactctatagaccccacctctgggggcagggcatagctgaacaaaaggcagcagaaacttctgcagacttaaacgtccttgtctgacagctctgaagagagtagtggttctcccagcatggtgttcgagctctgagaacagacagactgcctcctcaagtgggtccctgacccctgtgtagcctaactgggagacacctcccagtaggggccaactgacacctcacacagccagatgcccctctgggatgaagcttctagaggaaggatcaggcagcaatatttgctgttctgcagcctccactggtgatacccaggcaaacagagtctggagtggtcctccagcagactccaacagacctgcagctgagggacctgattcttagaaggaaaactaacaaacagaaaggaatagcatcaacatcaacataaaggtcatctacaccaaaaccccatcggtaggtcaccagcatcaaagacaaaaggtagataaaaaccacaaagataaggagaaaccagagcagaaagctgaaaatcctaaaaacaagagcacctcttctccccaaaaggatggcagctcctcaccagcaatggaacaaaactggacagagaatgactttgatgagctgacagaagtaggcttcagaaggttggtaataacaaacttctctgagctaaaggaggatgttcgaacccattgcaaggaagctaaaagcgttgaaaaaagattagactaatggctaactagaataaacatgtagagaagaccttaaatgacctgatggaactgaaaaccatggcaggagaactacgtgacacatgcacaagcttcaatagcctattcgatcaagtggaagaaagggtatcagtgactgaagatcaaattaatgaaataaagtgagaggacaaggttagagaaaaaagagtaaaaataaatgaacaaaacctccaagaaacatgggactatgtgaaaagaccaaatctacatttgattggtgtgcctgaaagtgatggggagaatggaaccaaattggaaaacacttttcaggatattatccaggagaacttccccaacctagcaaggtggaccaacattcaaattcaggaaatatagagaacaccacaaagatattcctcaagaggagcaaccccaagacacataattgtcagattcaccaaggttgaaatgaaggaaaaaatattcagggcagccagagagaaagatcgagttacccacaaagggaagcccatcagaccaacagtggaactctgggcagaaactctacaagccagtagacagtgggggccagtattcaacattcttaaagaaatgaattttcaacccagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaaggagaattacaaaccactgctcaacgaaataaaagaggacacaaacaaatggaagaacattccttgctcatggataggaggcatcaatattgtgaaaatggccatactgctcaaagtaatttatagattcaatgccatcgccgtcaagctaccaatgcctttcttcacagaattggaaaaaactaccttaaggttcatatggaaccaaaaaaaagcctgcataggcaatacaatcctaagcaaaaagaacaaagctggaggcatcacgctacctgacttcaaactatactacaaggctacagtaactgaaacagcatggtaccagtaccaaaacagagaaatagaccaatggaacagaacagaggcctcagaaataacaacacacatctacaaccatctgatctttggcaaacctgatgaaaacaagaaatcgggaaaggattccctatttaataaatggtgctaggaaaactggctagccatatgtagaaagctgaaactggatcccttccttacaccttatacaaaagttaattcaagatggattaaagacttaaatgttagacctaaaaccataaaaaccctagaagaaaacctaggcaataccattcaggacataggcatgggcaagaactttatgactaaaacaccaaaagcaatggcaacaaaaaccaaaatagacaaatgggatctaattaaattaaagagcttctgcacagcaaaagaaaatactatcagagtgaacaggcaatctacagagtggaagaaaatttttacaatctacccatctgacaaagggctgatacccagaatctgcaaagaacttaaacaaattgacaagaaaaaaaaaaccatcaaaaagtgggcaaaggatatgaacagacacttctcaaaagaagacatttatgcagccagcagacacatgaaaaaatactcatcattgctggtcattagagaaacgcaaatcaaagccacaatgagataccatctcatgccggttagaatggcgatcattaaaaagtcaggaaacaacagatgctggagaggatgtagagaaataggaacgcttttacactgttgctgggagtgtaaactagttcaaccattgtggaagacagtgtggcgattcctcaaggatctagaactagaaataccatttgacccagagatcccattactggatatatacccaaaggattataaatcatgctactataaagacacatgtacacgtatgtttattgtggcactattcacaatagcaaaagcttggaaccaacccaaacgtccatcactgatagactggattacaaagatgtggcacgtatacaccatggaatactatgcagccataaaaaagggatgagttcatgtcctttgtagggacatggatgaagctggaaaccatcattctgagcaaactgtcacaaggacggaaaatcaaacaccacatgttctcactcataggttatgactaaagcaccaaaagcagtggcaacaaaaaccaccataggttggaattgaacagtgagaacacttggacacagggcggggaacatcacacatgggggcctgtcatggggtagggggcaggggtagagatagcattaggagaaatacctaatgtaaatgacaagttaatgggagcagcaaaccaacatggcacatgtatacctatgtaacaaacctgcacgttgtgcacatgtaccctagaacttaaagtataaaaaaaatagtagagatggggtttcaccaagttggccaggctggtctcaaacccctgacctcggatgatccacctgcctcggcctcccaaagtgctgggattacaggtaaaagccaccacaccagccttctttttccattttcaaagccagtgatatagcatcttttctctcttatctgtttctttttgttttcttttttttggtcacatgacctttttcttttgtgtaaaacctctctgcctcccctcttctaaggacacttgtgactgtattgagggcccactgagataatccaagataatctccatatctcaagatgcttaagttaatcacacttgcaaagtctttgccatatgaggtagcattttcaggttccaggcatcagggcatgaatatcttgaggagcttaccacagtctgccctcttgtctccaaggatttacatctatctcacatgcaaaatattcaccccatcccagtatctccagaagcctcaacccatttcagtttcaacccaaaatctcacctaaatataatcagctcaaaagtccaagatctcatccaaatcatctaaatctaagttcatcattgtatataattgtaggacacacatcagctaagctttctgccactatatgacaaatctcctttcctacagtttctaataaaatgttgctcatctccttctgagccctcaccagtaccatctttactgtgtttatatttctaccaacattctgcttatgatgatatatgtgttctccaagatgaattaggatttctctaccatgctcctcactttcttctgagctgttaccagcagtgcctttaatgttcaaatttctaccaaaaatctgttttaggcaatctgagtattttctatcatgcacctcccactccttctagcctctgcctactgtcaagtccaaagccactttcatagttttaggtttttgtttttgtaccaccccacttccaggctccaaaatctgtattagtttcctatggctgctataacaaattatgacagacttacttggtggcttaaaacaacagaaatttattcttttatagttatgtggaccagaaatccaaactaagtcttatggggctaaatcagggtttcagcagggccacacttgctctggagactgttaagggagaatctagagtttcttgccctttttagtatctagatctgtattccttgcattccttggttcatagcccttttctccattttcaaagccagcagtgtagcatcttttccctctgattctgcttccaaggttgtctttttctgtttgaattcctatcctgccctcttaaaagaacatttatgattgcatttagggcccatccaagttattcagaattatctccccattcttaggatcataagagacttaatttaatcacatttgcaaagtctttgccatatgaggtaacattcagagattctagggattaggacatggtatctcaagggaccattattcagctcactgcatggtttaaggactgatccccagggcactctaacattgagagattggggagaagacgaggaatcagcaaaggggacagataaggaacaaatcagcgaagtaggaaaataactagtagagtgtgatattctggaagccaagagaagaaagtgttctaaaaagagggatcagctggttcagattttgttaatgcccaagaaagatgaggacttataatttactattggatatttagcaacaaggaggtcattggtgatcttgacaagagcaatttaggttcataaactcttttggtgcaaaagatcctcctttttgctccagataatgacaaaaattattacagtaacatgaaatagtgacttatcttatggacaaaatttcttggagggcagggccatgtcatgctttgcttaggatctaccacagtgggagtgttcacccattctcctattgtatcannnnnnnnnnnnnnnnnnnntcctctcctcttcctgcctcagcaccatccgacacccaccccatctaggccatagacatagggaagaacttgatgataggcattttctctacccctctacccctgcctcagtccagatcttcatgtcaggatttaaagacagaaaagtttgcagcattattcataatagcttttaaaaaaaaaaaggtagaaacaacccagatatccatcaattgatgaacagataaacaaaatgtggtgtgttcatacataatatggaatactatgaggccgtgtaaggatgaagtgcagataacactttattcctttcactattatgaataatgctgttgtgaacaattttgtacaagtttttgtgtggacatcgttttcctttttcttgagtatacctaggagaagaattgctgaataatatggaaatgctctgttgaggaactgtcaggttgtttttcaaagtgactgcaccattttacattcctgtcagcagtgtatgagggttccaatttctctacatcctcgcaacacttgctattgtctatcttcttgattatagtcatcctagtgagtatgaagtggtatctcgttctggttttgatttgcatttacctaatagccgatgatgttgagcatctttttgtgtgcttattgtccatttgcacattgtctttggagaaatgtctattcagaccctttgctcatttttaaattggttattagtctttttattattgagttgtaagagctctgtatatactctacatacaagttccttatcagatattttatttgcaactattttctcccattctgtgggctgtattttcactgtcttgatggtgtcctttgaagcacatttttaaattttgataaagtccagtttccttttttctttttttttactagtgcttttggtatcatagctaagaaaattattgtgtagctcaaggtcacaaagctttacacttacatgttcgtccaagagtcttatagttttagctgttacatataggtctttgatctattttgagttaatatttgtatatggtgttagatagaagtaactttgttctgttgcatgtcaatattcagttgttccaacaccatttgttgaagattattctttccctcattgagttatcttggtaccctgctagaaaatcaattgactctaaatatgaagatttatttttggaccctcaattgtgttccactgatctatatgtctatcttcatgccactaccacactgtcttgattgctgtagctccgtagtaagttttgaagttgaaaagtgtgtgtccaccaactttgttctttttcaagactgttttggctttaaaaattttttttattttggttaaaaaaaaacataaaatttgccattttcatcatttttaagtgtacagttaaatagtaagtatattcacattgttatgagacagatctccagaactttttcatcttacaaatctgaaactttaaacccactaaataacagctcccctttcccatcagcccctggcaaccaccattatactttctgtttctatgaatttaaccattttagatacctcatataaatggagtaatacagtattatcttttgtgactggtttattctacttagcataatatcctcaaggttcatcaatattgtagtgtgacaaattttgttccttttttaaggccgaataggattccattatatgcttttactattttgaattcctttaatttccatatgaattttaggtttagcttgtcaatttctgcaaagaagtcagctgggattccatagggattgcattggatctctagattctgtagatcaatttgaggattatggttttcagagtataggttgtatatttcttttgttaaatttattacaaaatattttaacggttttgattgtaaatggaattggttttcttaatttcatttttgtttgctcattgctgctgcatagaaatacaattgatatttatatattgatcttgtatcctgcaaccttttggaacttgtttattagttctaataattttttggtgaattccttatgattttctacatataagatcatattcataaattgagatagttttacaacattgtattttaatacattaattcagcaaatatatattgaggacctgctctgtgctaggcactgtgctccatgttggcaagatagagataaaaggcataaactctgctttcatgaagtttgcaatctagttgggggtcagatctttaaaccaataactattcagcattataaatactgtgattgaaaatatataaggtgctatgataacacagagaagggctactaatttacactgtgaagaattaaggaaaattctgaacatgagtttttacaaagttctggaccattttgtaaataagtagccatggttatgataacttgtcatttcaaggccaaaatgactatggatatttaaaaattattgtgtagtatgaacttcagctttaagatttttaagtctatcaaaacttaagcatatttgcattaatagtgagacaaaagtatatacagatgtttgattatgtagtaaatctgttgctataaaagcatatgatcacatttggaaaattgctattgcatgtcttggcagtttgttaagaactaaaaactttaaaaactaactggtgttttgatagattaagttcaaggccaccttttgtttaaatgatgttttgttttatgtaattagaccatgctaggtgaattaagtatgtaattaaaaacagaaggtttggctaattcagagtaaatgagtacaaaatacaaggtcattatccatctctagtgagactccagatgaacagtgcacatggaactatttataaaacatttttcatggtcagagctcctctaggttgctgtccatggcctttgaattaagtattcacagactttcaggaaaaaaaaaagtacctgtaatatagaaatatgatcccacttaaggtgctcatctgagtggaaaaccaaaaaagattagaatctaatcttctatcccagatagaaaaggtaaaatgtattcctcctgtttgaaacgtgaacatttactatgttgcttggcacattgcgttgatggttagaactgtgaaacttttgagagtcctgactctcatttgttttcatttcatgcagcctggagatgtacgggcaaaatatccctaatttaatctgtttcctccgtgcttagtcacaatgggtgacatgggatggattttttcttctggaaagcctggaaagtattttatttgaaatatattttcttttatagtatgagaatgtgcagcttttagaaagctggtgtttaatttagtggttggattcatgaagaaagtttgaatcagtgactggaagcacaaagctgaaccttctcttagcagtcccttcacagttgggctcctggtgtctctccagttttttcctgctgttctctcttccacagtagctgtgcttcagtttgcctgggcttttccagcatcaccaccactgtcttcatccactgtctttggcttgcctttcttggcactgtttaagattggtttcctgaagcaaaaaatgggttaggtctcccagtaaatgttttcataatctctctctctctttttttttttttttttttttttttttgagacagggtctcactctgtcacctagactagtgtgcagtggcaccattatagctcactgcagccttgaactcctggtcttaagtgatccacccaccttagcctcccaaagtgctgggattacaggtgtgagccactgtgcccagccaatgtctattttaattccctaatctaagccagttaagaagttaagatgcccatgcaaacaattataatgcaataagatcattgtttaatggaagagtcttcaaaactacagttaggaatatataaggaacaccaaagttcacctgagagaaaagggatgctgttagagaagttagcatttaaacagatacctaagaatgagtaagaatgtaccagatagacaagtggaaaaaatggtgctgcagtatttacagaaggactagccataagaaagcatgttcagtgttgctagagcatgaaattgagttggaaagtggtagaaatgaggctggagagtaggcagcagcgtttataccttacaaggaggttgggagttgggcttatggataactgaaagccattgaaaaattacagcaagctgacctcttgaaacagaattgcaaaaaattgagattggaagtagagaaatcattaaggggattgttgcaatatgacatagtccaaatgagaaatgaacaaaagcaatgaaattgatattaggggacagttttgagagaatctctagtccttagtgattagatctgggaagtaagagaaaaggaagatctcagataagtcccagattacctgaataactaggtgaaggagagaagaggggttggtggatccattcaatttaaggaatagtgactttttaaggtggaatatgatgaattcattttggttatataagtaccatcagacattcagaaagagatgcttcttagacataaccagaattggagttccacagagatctgggctagagatttctggattgtgagtcatcttttaattggtatagttcaagtcatcagtatagagggagaataatattagactgagatgggtccctgtggagcaacaacagagaaaggaatgtgacatcttagatactgagggaggagaacatttcaagaaagaggaaatgaatgtgtaaaaagcttcagcaagatcgaatcataggagagctaaaacccgaagattggataaggtgttaaggagatcaatgttgcttttaagtgaagcagcctccatgagatggtgacgcctaaagccagactgcttcagagcgggaagtgaatcaaggagggaagaagtagacttcttcctagaagttgcttgtgaaaagaagagatataatagttaaaggagaacataagattaaagaaactttttattttattttatattgcttttagatatgaaacgcttgatgattttttttttttttttgagacagggtcttgctctattgcccaggatggaaatgcagtggcacagacacagttcactgcagcttcgacctcctgggctcaagcaattctcctgcctcatcctcccaagtagctgggactacaggtgcacactaccatgcctggcaaattaaaaaaaaaaaaatgtagagttgggtctcactatgttacccaggccggtctcaaactcctgggctcaggcaatcctcccgccttggcctcccaaagtgctgggattacaggtgtgagccaccatgcctggcatacttgatgatttttatatgctgaaagagctaatggcaggaattggaggattgactgaagatagtcaatggaatgaagttcctaaggaaagaggaggggatgggacctagagcactagtagagaaaccacatctggacaggaagagggagaagtgttactctgggtcaaaggaattagaggataagagtgggtgcagccttcagggtgtgggtgacacctgataattactcccctctctttttatcagttctcttgccaaatatctagcaatttcaaatcttaactgccattgtaggtcttcttgatttatctaaccataaaatccattccattcctgccaaaaaaaaatacaaaacactatttttaataccacttctttaccacactgaatgttgttccctttctttaaactatttcctttttaaaattattactatcttcagcatatttgcatttgatttttaggcctttctccaatttcacacctcttctagattaacttagttctcccccatgttctctttcctattccaacttcacagaattaaatatacttctaacacactcctgacaggcagaaagacatcatttcttaaaactctttaaatcctgcctgcccagaaagatccttttggagtaaatcagaaattgcaacttaatttaagatatcatattactgcttgctttgtttttacttctctctctcattgttctctgcaactcccacactgtctgctaatttacagtactggagaatttagaagtattcatttgcattatttaacaattattagtgtgtgtcattgagctttttggagatgctttatgaaaatttaataataacaaacgaatgatgtactgatttcaccaaaatcatggcttagtcttctaaaatatgatgtttctgtcttagccagtaatttacattccttttattagtagttctattttagaatttttatttctggtgtacatttgagtgctgccttttatgttttgttaaagcatgtaagtggagatcagttgtgccttagttttgcttttgtattaaaaatatcttttatctaaaaaatgagtaatagctaagcataagtaacataaaaggatttctttttgtagcttttaattactttattataagtatagaaaagaaggctttatatgccatttttagccttcctgtattaatactgtcctcctggtttttaagatgctgtttgacctatgaacccatatcctttagtatattaactgatagttttagaatttcctaggtgatgaggttgggcgttcaagaccagcctggccaacatggtgaaaccccatctctactataaaaattagccgggtgcagtggcacacgcctgtaattccagctactcaggaggctgaggcaggagaattgcttgaacccgggaggtggaggttgcagtgagctgagatcgtgccactgcactctaacttgggctacagagtgagacttcgtccctgccccacccccgcaaaaaaaaaaaaaatttcctaggtgaatcttcccaaattgttcctatacctgctaaagaattaaaaatgaaatgaaaatgtttttatactcatcgctaaatttaaatctatatagacaagagaacagatattggtttcatcatcatttatttgaaataacatttttttaaatactaccaaattacaaaataagtgtctgattgttttaataaaaacagaaagagtacttctctctctctctctgtctctctctctctctctctctctctctctctctcgtgtttattttgtgtaagcaagaaaagagggatggaaggatgccactacacagtaataaatggctacttttagaagatagaggtaggagagattggccttttctttatatatcttgctatcttttccacttttgtatgtgaaaaatatacagacaacataaaggaaaaaaataaaactctgatcccttctttgaattactgtctaacccagtagtttccaaacctgcttctatctgaatcatctcaggaagatttactaaaaatcaggcccctgactctgaaacagaatctccgggagtgataaaaatactagactagtggttctcaaacctgtgggccgtcagaaatcatctaagaagcttttgacacgtctagattcgcacccccacgaacagggaatttctgacttgtaaatggtttgtgaaacttgcagttggtttttttcaaaggctcccatgtaattccagtgactcaccagttttgagaaccatccgtttaatgatttattttctctgtgccagacactgtgctggatgctacagtgatttaaaaaattagcaaaacacagtttttgccttcaaggaacttacagtatagttagggattgggggttgggaccagtgtaaaaacagatgaaagactgatacgatgcagctgttttatgggttaaaataggaaaatgtcctaagaagtaaagtcaggggtggaaaaaagagtgtcagctattacctctattatttaatattgttttgaaagttttgtctaatgcaataagacaagaaaatgaagtttaaatattgcaaaggaagtgagaagtgtcatcattatttgaaattgaaaatacagttatctaactagaaaacccaagataatcaactaacacttatgagcattattaaaaacataccagtaagatgatggtcaattacaaaataaattcagaaattagtgtttcctctataccagcacagacaagtatgtgtttaaagatcctacttataatagcacaaatataaataaaagatctgtaactaaggaaacttgcctcaagtttaagcaagtaaactctacgactaactataagaaataaactatagaacataagggacataaaaacagtttaagaaatggggaaacatctcatatttgtgggaataatggggagagttaatgttttaaagttatgcattccctaccccaattgctctctattgatcattaatacaattccagttaaaatttcaggtgtttttttctttttgccaaacctgacaatgtgtttctaaagttcacttagaggtgtaaaccaaacacacttttgtaaaaaaaagaaataatgtgaattaattgcataagtgagtataaaatttttttctaaagccacaataattaaaacagtctaataatactaattcaagatatcagaataaataaaagtggaattttcagttattaggaatagttatattcaatagcatctattattgaatgtgtggaatcttggtgttggtacaatcggctaaatgtgtggaaaaataaatttcatgtggattaaaggttaagtgaaagcaaaaaggtaatagaaaaaatataggtggatatgtacataatcttgatacgtgggaagactttttactatataatagtaagggcagaaaccactttttaaaaaggtttattacataaagattttaagttactgcacaacaacaaaaatagtaactaaattgaaaggtaaattaattgggaagaggtatttataacatggtattcacacccttaatataagagagctcttaccaattaatgataaaattaactcctgacattgggctgggaaggcatgtagagaacatgtaaatttaaactttcagaagaacaatttcaccatatgtattgggagctttagaatgttttcatattctttttttttttaactctagttccatgacagattatgttttcatatcctctcactcacttctaggaatgtaatctaaggaaatagatatgtgcaaaagatagtttttagggcctttttgacagcattgtttaacaaaaatggaaaaatcagtttctgcatcgagagccccactccttccagctcaccactcaccatgcctagggtgaggctctcagtttcatggtcaaaggtggaggcatctccacttcaggcagctggttggagaaaggggtgaaatgggcatgccccagccatcttttgagaaaggtgcccagaaacgtccatataatgcgggtcagtacttggtcatagggctacatgtagttgcaatagagaccgaaagtgttgcttttattccgaatgactgtatgcctggctaaaacgatatttctatggaagaaaggtagaatagatattaggggatagctaccaatgtaccataccacttctctgcattttcatcttagttttgctgttatttttaggactgtgtctcctctttctcataccctgcagctacatatctacctttagtatcagtcactaaatttctgtcagtagttcattctttgagacatgatgcatttttttctacccaaatacgggaaattagttgcagtgcctagcagacgaggttgtgactactaaacattagcattggcttataacattagaagcaggaaaagaataaactctagattttctcttcttcctttcatttcctccctaccctaccctagtaactaggaaacagttttgttaccactagggagaatagtccttgtaccattgtctatcttttaatgcatttaaggcaccgtacaagttataaaactgcatctgaatcccaccctcaaggacatttttttctaattaaagcatctgtgccttattttatgaaaattattttcaatgttttatctcaataaaatgactgcacttttgccagcagctctattagcacaggtcatttgatgaagccatgcttcaccattcttcacaggttatctggaaaagccatgtcgcccagtctttagtatttcacagctgtcactcacagactagttatgccagagaggaagagaagtgggagagaaagacaggtgctgccatctttttcagttttgcaacttttcctcttatgattcagtgccagcttaatgtgtatagagaaactctagtgttctgacagttacaccaaaagttgtgccaattcttgatcatagttattggccattacattgaatggaaggcatgaaggacataaacattcccattgtctaaataaacacacagattatctaaattaagtaacttggctcatgatcacacaccaagtgaatgttgaagctgagattcacatccaggcccatctaattccggagcttattccccaactatagtgattactgagtgcctactagagtgggggacgtgaggattgtcttcatatatgtgaaggatgatcacatggccacaggattctatttgttctgtgtaactacagggggagccactagagccacttcatttttagttaaaaatgaaggcaacttttaactaaatgttagaaaacacattttataacaaattaatttataagtggaatggaatgccttttgaaataatgattgtacctgacaaaaaatttagactgagttttggaggtgacagggtaagtagtagaaattattggacttgcagactggagatatcaattcaaattgtatcttggccttgaattagctatttaggtttccgagttttcattttctagtgaattaagtgaaggaattggactaaatcacctcaaagtctcattgcatttaggtaagtgcatgcacattgtatgtgctcagtaaatgtttgttgcatgagtaacacaacatagtcccctctgtcctagtgccagtgccaaatccttatcctcccagctcaaagtaatctccttcctttatactgtgtggcactttatctgtatacttctcattgaatttattaccttctactttatagtgaacttatgagactcagaccttcttggtgataaaatctatatcatattatattctctcatattccccactgggccttatgcacagtaactattcaataaatatttgttgaataaattagataaaattacttgattcatgaaaagattaaaaaataaacatttttgcaatcatagttttatctcactttctcgagaaagaggttattttgcctcttagcagcagtagacaaatatatgcaaacagtctaaacaaaagcctatgtattgcttgaagttaaattaaaacttgttcagacagggcattgacactgacagtagccacctcaactcaacttcacctactgaaaaaaatctactaaacgacacctggaactcattacattctttcatttgagttttgctgccttaatattgtatcacactgagaatctaagtattatctggctttctttcaagtattgtttcctgagaagttatttgcctaaaattcattcatactcctctaatctttcttcctctcccctcacctccccttttttcctccaccatttcctttggactttcacactccagaattcaaatgataccactgggtcctagggggttgtgtactataatttatgtggtgaaggacctggtgatttgatgtgaaaataagaaacattaaaagttgtgagtagcctggttcacacatcacctctgtggaacttcattgaaccttttcagcacttttacacggtctttagtggctttacacacaccttatcctctgtgtttctgttggatcttactcctaatataggtccagttacatcagatcattgtcactttagttgtttgtatgtctgtttccccaaccagattggggctacattttattctttttatcattatatgatgttgaataaataagtgtgttgacatgaattatctagacaactttctgtatttttctcacagttttttttcccccacacacaggcaagtgcattattcctgttttatagataaggaaactatatgttaaaggagctaagaaacatgcccaacgccaaaaggcaaatagttggaggagccagaattcaaatctttagcctggggcctaagatcttttccttatgtcaacttgccttcagaatgtgtctttcggtctgtttcctttatccagttttcattgctactgtccttaatctacgcaacattacctcttctttggagctttgtcatgggtcgtactctgcctaactgttcttttccattttaactcatgcatcattattctgatcatgtcattcactttgagactttcatggccccctacttctgtaatataaatgctaaattttttggtttatagctaataggctccaaaatctgcccccatctacttctccaggctcatcttctattcctgccttctctgtgcccccgaactctagtcttgccctgccacttcattatccttcacatgtacatggcagcctcctacttctttgtctttacttgtacaattgtctgtactatttccttgtgcctttctgtgctgttttcaagcacccttcattcctgtgttgctagttgaaatcttacccagcttaaacctatctgttctgttaaacggtctccagccccaccagtggtaattaatttctttatctgtgtgctactttcaaattgtaattgcttgtgactgtgtatgttcttgataatgtgttggaaagcctttgagaagaaggactgtcttctgctgactattttctagagcttcatacaatgctttgtttataaaacacactccataaaatttagctgactaaagtgaatctggctttcagggcaacagtaatggttctagataaaattcaaattgaccacttgtatgtgggttgtctcctggtctgccactaaagcattagatttataaatacattttttttttttgagacgcagtttccctcattttgcccaggctggagtgcaatggcacaatctcggctcactgcaacctctgcctcctgggttcaagtgattctcctgcctcagcctcccaagtggctgggattataggtgtgtgccaccacgcctggctaattttttgtatttttagtagagatggggtttcaccatgttggctaggctgatcttgaactcctgatctcaggtgatcggcccacctcagcctcccaaagtgctgagattacaggggtgagccacctgattatgcttggcccagaatcagaaaatttcttatttgacctgcagctgacctcagaaacatgggggagcccagccaagaccagaagaaccaccccagctgaacccagcccaactggccaacccacagactcctgtgctaaataaatggtggttgttttaagacaattacattttggggtggtttactatgtagcagtaactaagtcaatacatggttgaagaaagaagtacccctgacaaagaaaagatagagtgtccctgcagttgggagtatgagcaaatagcattttagaacactatgacctccttgcacactacttcctgtgcagaagttctgatgggctggacagagtatggctggaggctcttccctaaaaaacaaaccttaggaagagcaacaaaggactcttgtagctgannnnnnnnnnnnnnnnnnnntcaggtgatcggcccacctcagcctcccaagtgctgagattacaggcgtgagccaccgtacccggccaataaaattcttctagataaatcaaatgatgaagtttacttttttcaagaatatccaaaaagatcatattcattgtgttactcagtattttgtatgctgtaatatgtagtttgtgtatatgtatgtatacacatgtacatatgtgtattatgcatatagatattatttgtcataacaagaagatcttaaaattttaaatcttatattttctattatatatagtattttctaatccttattaactgcaccattgaaaatctagttccagtgttttctttatatttactttttttcttttcttttttcttccccaaaggtacctgtctttatagttactttgaaaaagaaaaagcatagtaaatggtgaaatcgtttagtcacattgaaagtacatatattgatgtaaaaagtccataaacttgtactgttatattctaatttaatgtggactcttcgctcccttcacttcaacaaatcacagtagttttccctggtgagtttggtagctgggggttcagagtcaaaagtgaacttacactatttagtacatttttatattggtattgtttgaattttttcatttaatgtagactacttttataacttctaagtgaacaataaaataaaatatgttggtgtccctgctcaaagtgttaataaggatactttggtatcaaactaaaactattttgaatgacaaaggttagtatttcccctgatttttgtaggaaagaaattattttctttgtttaaatggcctcctggtctttctgaaaaattgtgggacttagactaaagtggactttagtctaagtctacttagtggacttagtattaagtctttaatacttaaagacttagtattaagtctttaatacttaaagacttagtattaagtctttaagtcatggtggcacatgtgttgggaaactaaatcttctcattcagtctatgttcaaggccaaatcagtggaggcagctcttaaagggtagtaaaaaactgacttaattttcactgaacagaggtggcactcttagctttttggagactgtcctacccgtctgtgttcaaacacactcctgtgttctgttgtataatttaaatctatgacacctagcagctggtcttaatcaccatggtaaaccatttcttctgagcccagaccaaattaagtaccaatttaagatacccaagataattcaccacaccctaagttaaattggttatcccaccttttacttccttatcttttttatggaccaggaaaattgtcttactaaaacaaagtttgttgagccttcagaatcttggttattttaaggtctttttaaaattttttcacatggtccaactgccagacagattgtacatcaatttcctgcagcatttggcaggactatgtatttactgccttaaaaacaatttgaatttattgattttgaaatttgtgattgctttctaaagttttccctcctcacccccatctaaatttactttggggaaaaaggcaaaacagagcacattggcccatttttatgccaagactttcagggaaacattttatatgattaatattgtgtggctaatctggtgtaaaaaatcaattttctccattttaacttatgagagcatgaccatcctgtatgaactatttaaagatcctgtgacatcactaatccaaaattaagtgtttgttactgcctttatttatgtgtgttatattaatcatgtaagttaatattgggccccatttctttataagaattgaattacatttcttcagcagttccatatcttttctatcacggcagcatcctagccttgacttgagcaagctgaaattagtggactctggacttggccccagctcaatgaaatacataggtcatggtacctggtcgccattttaataggtctggattcagttagagagcttctcccttatctgtctattcctttaaacccatttgtcctaaaagattgttctctctcactaataatcagaaaagaaacaacattataaaatccgtatgctttcattccatcaaattcaaactgttttataaaatattagactatttgttactaggtgagtatattattctgaaagatttaatgtcaacactttgaggaatcgagaaatacctatttgtaatgcttgtacaatactctgttatccttagaaatacggcacctcacaaataacataacttctacccagggaataattgactcaccatggaggtctggctccctgcctcattaaatcttctagaattgctgggaggtagctagcaattattcttccctctgtttgacatatgtggagagttaggcaccaagcagtcagaggtcatgcgtagagtctctaagggagtgctgtttgaatattggtcattgaatcaaatcactgctgagcaaacgtcgagacaacttctgagggtcatctcataggggacaaagttacctaaatgcgagaaaacatgtctttatccatcctggcattgctaatcccggccctcatttacaaattgtattttatacttacatgtattttttatctttacgtagtttattcagaagatccataaaaacatttgactgtctcttatttgtcattcttatttaaaagttggtaaagaacatttagaatgagctatgtaaaattgttttgagaacatttagctttaacttcagttgttcttaggaatcacagcctttggattcatttttattcagggagaaataatgcttttaaagcatataactgatctggaagaatgctatattgttttatcttcaagacttgcatgtcaaaaattcacctgcaggttattttctttttagagctccttgggaagggaatgctgtaatgaagtgacatcaggatgtgtttatatttatttcaaagtgtcaagatgggcatgctggaaatttgaattccttgaatttgaattccttcatgaccttttaagttaatctttgatgccagctcaaggggagtgtgagaaacgtgagaattcaactagcttcagttgaatacatgttacacttcaatgactaaatttttttagtatagaaggttactaagtgacaagtaaaggagaagtctgattatcaaaacatcattctatccttgaaaaaataccaaacaaacgtattccagtcaacagtttttccagataatgttcagaatttatgttaaaaagtcgtgtcttgagattataaagtctaggaggcttactaagttttttttttttttttcaatagctttagggatactagtggtttttggttgcatgggcaagttgtataatagtgaagctgggctgctagtgtacccatcacccgaatagtgtacccagtaggtgattttttcagtcccacatccccattctgagtctccaatgtccattataccactctgcatgcctttgcatatccgtagcttagctcccacttataagtaaaaacatgcagtatttggttttcctttcctgagttacttcacttaggataatggcctccagttccatccaagttgctacaaaagatgttactttttatggctgagtagtattccatgatatagatataacacattttctttatccactcatctgtagatgagcacttaggttaattccatatctttgcgactgtgaattgtgccacagtaaacatacaagtgcagatgtcttttttattaaacatctagggtagctatttttcatttattcattgaacattttttccttgaaaatatactagatgcagtaatggacaaactagaaaaagtcctagccctcattctagcatttatccatgtggattttctagcagtggttgaaatataccagaatcatgtgactttttttcgtatcaaaagatacagttaatatcctgatacacctccccaacaagaatatatcaaaatgtgaaggaaagagaggggaaggtattttgaataaagctcttctggctaatttttctcttttttcagtataaaaaattttaatatattcaaaaagctgaaaaatagtacaataaacacttaacatttactacttagattcaacaattttgaacattttgctgtatttgctttgtgtgtatgtatatgtctatgtgttttccccaccaattttgaggcaagagcatagcctgaaactttcccccaaatggagtccctctgatgtagtagactattattaattttgtttgatttcactgggagggtgggaggacagtcgtgtacagcataccaaggttggatttcttgtcagtagcctctgtagtaattgtgatatatgctggtcaggattgttatagagagatgttgtcatcgctgttatcagatacaagtttgaattcagttccatggtctatttgaagaggtttttttgtttgttcttggtgaatgttcttgttttttttgaaatcatactgtggcagctaggcaggtgatatgcttccccctccaatattagtacgataatcattcactgtttgcatgctctttttacatccatttactttaacctgtctgtgcctttatatttaaagtgaagtgtgcttctcctatctcagaaagtttaaaatattgttccaggtgtcttctggacttcatattttctaaagagaagtccgatgattccaattgttgccctgtatatgtttttttctctctgtctcctttcacaacttttttatttttggtttctatcaacctaggcatttatttttgtgattgatgttgtttttaatcttctttacagttcatgagcttcttgaatttataaatttatctcttgccaaatttaggactgtttttagctataatttatgctgatgttttttcccaccactttctctcattccccaccttctgggacttcagagggtcctgaaacactttctttttaaatttttttctctctcctcttcagattgggtaattttcactgacctttttccaatcaattttttgtcatcttcattctgctattaagcctatccagtaagctttttatttcagatattgaatttttcaagttttaaagctcctatttgtttttgttgttgttatatttctagtttctctgctgagatttcccattcttttcatccataatgagcatgtcttctcttacctcagcagtaattatagctgctttaaagtcttgttatttctgatatctgggtcgtatcaaggttggcttctgttgattgtcttttccattgggggtggattgcattttccagattcttcatatgtcaagtaattttggattacatcccagacattgtaaatgttttcttgtggagggggaagaatgtgtttttgttcattctttagagacttcagtagttggtttttgtgttttgtccacagtttattatctgcaaaagagttagtctgttaagaactttctctgacctagcaaaagctgaactcctgatatgcttcttcacctttcccgcccgccccccccccgagacggagtgttgctctgtcacccaggctggagtgcagtggcaggatcttggctcacggcaacctccacctcccggactcaagcaattctgctgcctcagcctcccgagtcactgggattacaggcacccactgccacacccagctaatttttgtatttttagtagagacagggtttcaccatgttggccaggctggtctctaactcctgacctcatgatccgccccaccttggcctcccaaagtgctgggattgcaggtgtgagccaccgcacccggccgcttctttgtcttttaactgcctgtcaagtttcctgctaaactacacacctgcactatcacgcagaaagagattttttcatgtcttcatgcaggtggagtgagagctgccaagggtaaaacagtgatgaagtatgtcatcctcactatggcattctttttcctgcatcttctccactgctacctctcacatgaactcttgtcaccagtgatgaaaggacttagatgtatttagcagcaagtaccactgccacctcatcaggaacatagggagagaggaaaatcgcagaacaagataacgacagaagctcgtaaatatagtgtataagagcagatagagaaagctctggtggcacagatgtgggcatgtggtgcatgagcccaaagaaaactaaaaatgaaggagagacagagggtagggagccacctgtgccacctttgtgctaggccctttaacatctgtggtctcatgtaatcttcagaacatctctgtgacatgtgtttatagtatttccactttatttgagaggctccgaaactgaaagaacttcagtgattttctgcaagttaaaaaactttataaatggctaggcagaaaagaaaatgtcttttttctttcctgcagctagttttagtcatctgaagtccctctgcaaatttgagggagtaataaggatttttctaggttctgccagcttcctcagtgagaactccaggcatctggcttggaaaagttggctaaaatgcttcacagcaaccctctcgcatgtttcagttctttgctctgctcgggaggcgaactcgatggatcttaagcccaagcttagtttaggtaggggaaacccttctctacctcccaactccccttcttccaccccacccccaaatctcagtctgcttcctgatggcctttataaaccagcgccttaagaaaaagagtttgagtactcttcagtagatacatagggatcaccttgtgagtgaggggcagagtattttgggttggaattcttccttacagattcctctcatttcctgacttccattcctcttgtccttgtgctcactctcaaatttccgctacattgagtcatgttcacaaagagcagcatgtgaccaagagccacttgcttcttctacacatagcccaggggtctgtctgaattcaggttctttcctctgtttaattttcttcctatacctctctatgctcaagactctagagtagactgctggttctcaaccaggggtgatttatttgggttgtccaaacttggggaaagctactggcatcttgtgaatagacgctggggatgctgctaaacatcctacaaagcacaggacagcccctcacaaccaagaattacccctgaccccaccaaacgttcattagtgccaagactgagatgccctgaaacagactcctgaaggcttttctctgtgttccttttcccttccctctcccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtgggtgagctgagaaggtcataggcagaaaaagcaagaaattctagaggaggaactagcataatttgtttcgcgtctggcaaaagaatggaaaggttatcattgttaaatccgccatttataattctcaaagttttagctcataggggcatggtgacagtgttttgtttcacttctttaaacttgatgctgacttttatcatagcgtagatatcagatgatgctttaaaaaacctccttaagagagttgtctatttttatttttaaatatttcaaatggatggtgtttcaggtcagacctcatttttgtaatagtacatggagtctgttctttaacaaattgtattcaaccttattgtggattaatattctggtaatatggttttactttctaaaaaactagtcttcagaacagtctagcaaaagatctattgtagtcagctctaaaattgttttcctggtgcttgagaattaaaggcttttgaagtaagttaaataggccatctctgttgtcactgcctcttgtataacaatggatgttctacattctctcttctcacccctgttcttggtgcttctgagcaagatcatgcacacacttaagcacaggactttcaggtgcatgaacctgagagtccacaaagcttccggctcctactcagcattaagatgtcaaccatagaaattatggtccctaataaggcttgagaattgtgctagccaatgaattgattgagacattcaagtcattggatatgggtatacagatgagctcagatttcaggaaacttcatcacagtaacgtctttaattattaatattgactcatttttctgaatatgtgtatgtcaccgtgatgacaaacactaacaagttaataaatacaatcttcactagtggttgttgccatgtaagatggctcttattcttaaagcaatattaatgggtgacagattggatgatgttaggcacctgctaaatttggggatctaaagaaggcccagtcctatattcacgtatctcatattgtacagttctaatgtggcagaaatttaaaaaatgattgcagtacggtgataaatgttataacagagacatatgcaaaattatctttaggtatatggagaaaaaagtaactcagtatgcttacagggaaaatttgaccaggaagactttatgaagatgacatttaagatcagtcctaaagatgaatagaacttcatcaggcagagatgagggaaaggacactctcagtagacagaactgtgttaacaaagtcttgaagccaaagtggggagtgtggaacaacattctaagcaaaggaaaggcatgtaatcatttaatcctaacctcttaatttttggacgattttactcccaattcacatgcaaagagcttggtgaagctgagaaactgaaagagaatcagtcatgatggaaacataggagtaatggctagagtagcacaagctgaagctgcagacctaggcaggattagattcaggcaaggccgcatttggatttcatatgcaagaaagagccatttccgtatcttaggggcaggacatgacccagtatacatttttaaacaataattctggctgctgtatggagagtgaattggaggggagcaaagatagaaggaaactagttaggaagctattgaaacagtgtgctcaagataagagggctttgactggggagatgacagcagatgaagaggaggacatcgatttgacatatcttggtaagtagtatgaacaccacaaggcatggcaacatttgaatatggtaggttcttagcatttgcaactagttggatggtggaagagccatttagtgaaataggaaaggttaaaagataaacagtttagaaggtctctgtcagatatgaacttactgagtattgcaatacccaggagacatctaatagaattgctaagttctggaactcagaagacagatctatattagagatactatcagatagatggtatttaaagcccagggcatgtatgagactgcctaggaaatggagtatatagtaaaagcccagagtcctgagtagttctaacatttagtagttgagaagaagccaataaaggagattgagaaatggccataaatttacgagaaaagagagcatggtgttgtaggagccaagagagggaggtttcaagaaggaaaggtgtggacaaagtatcaagtacagctggaggggccaaataagatagaaactaaaaagaattcatttaactttggcgacctaacaagaggaatttggagagcattaggggatcagaagccagtatggagcaagttgaagtttgattgccaatttaaaatatggttattgttttctccatactttgagaagtttgactttctaaaggagaagagggatggaattgtgacaactggaggaatggccgtgagtcaaggcagggttttcttgagataagaaaaaacaataaaagtttaagatgggaaatatcagaaagtatatcatgttgatgctaaagacaaagagagtttgaagatgcacaagagaaagaagctaactgtgtagataggtttctgagaagactactttggggcaatccagcctgtaatcggaggcaggtatgcgaattcattacaacagggggtgtagaagatgggtgcagcaggaatgtttgtaaatggcattgcttatattcagaaagaatttcgggctcttgtgatttagaatcacaagatgttttcttttaaacaaaaataataactgaatttcatagtactttcaaaatgttcttcatctgctgtgtaaaggctattattgtctctcagtgatctcttagggattataaaagagtaacaaatttttgaaggcactttacaaatttaagtaattacaaaaatgctgagtgctttatgtaatcattgatcttaatctcataatttttggaccatttcgctcctaattctggattttatgatccatacttgttctcattctccttactatagcttttcatgttctgatttttattttgttatgtgggttttgctagttcaacaatagtaattactgttgaattataatatttattgtagataaagcagaaataaaataaagtaaaattttattttggtttattgtgagaaatctttttttaaatgttatgtgacagatgataaagcctatgataggctaattcataatgcattcagtcatttggaacatcttagattttgagagaattgtgttatttaaggaaatgacttatcattgtaagcctcattaatcatctataaagttaagaataatgcctgtttacagaattatctgccccatttcacagcattattttgaggttcatgtgatacaatgtatgtaaatatgctttgtaaattgtgaagtactgtaaaatatattatgatttcaaaaatattaggtctcaggctctgtggccaattataaactcccctctccaccataaggtgtatgtgagtaaacattccaggaaataaacactcaactggcatagggttttagtttagtttttaagcatcattgacttgcaagtgtctatactaatctgaatctaatttaaaatttttaagaagccatctcttttttggaaaaatttattatgggcagtaaactacatatatttaactgcattgtatagtgtttaagagtgccagctccaaaattcagttcccttggattcaaatcctggccacatttttttattagctaaatgtcttaaagttcaaactcttggtgcctctgaaaacttaaattctgaaaaatggtgatactaataatactaattcataggattattgcctattaaataacagcatagtgtctgccagtggtaagcgcatgttagctattatgtacatatttatagcaatatgaatctctctatataagaatacttcttgtaaagtaagtacctgcaaagaattaaattttaaatagctaagtactcaccagatttcttcatttaagtagctacacccatgggattttaaacacattcagaggaacattttctcccttaaagccaccataatttacttttttggttgacagatttacacctagtaggtagttgcccacctacccatagcccagcagtgctactggtgattccttccttgtctagaaagattttgaattacagacagtcccaggtatatgatggttccacttaaagttttttggtgatatgaaagtgatacacattcagtagaaacggtacttggagtagtcgtatagccactctttttcacgttcagtacagtattcaataaattacatgaaatattcaacactttattataaaataggctttgcgttagatgattttgcccaactgaaggctaatgttaattgttctgagcatgtttaaggtaggctaggttaagccatgatgtttggtaggttagctgtactaaatgcagatatttttagtttatgatggctttatcaagacgtaacccaatggtaagtctatgcattaaaaaaaaaaaaaaaagaaaaggaaaaaaaccaggcctcttttcttaaaaggcagaaaaatctgcagtgtcaaatctggccaccagagggtactgtatagccagcgacttagccctctcttagaggttgaaatcttgcccttatgagcgggttcagtggatgccactattcatatctgtagagctcagtgacttcatgtttctcagtttccgataccattgatctgatagtggcccagcttcctaacttttcaggagccagtgatcgagctgtaagccactcatcctctacaaacctataaactctctgagccagtcaagctgtaacttcattcacccttacccttttcagaagccacctgcctattcagaaggctttggtacattgcagttgatttaggatcatttaattttattctgttgtactgcttccacttttaccactctccctcaggtgttctatcagttaatttctaagtgggatataaaagattttacgaaattgttaccaaatattcaacacttggtcaccctgcaagattaaaaacccacacctcttaagagtcagtaaacagtgtcttgttttttatacttagagcagagatttaccaagggttggggaagcttatgctgtcaccctagcaaaattgtctaggaaaaatgtcatctttaaaattagttgatataattaaggatgacactcactaaagaccaatgaaagacagtttctggtcattgaaaaattaaaaaatagctagcagaatctgcaatttcctcagtatttaagagttatctctcccttcttttgacagcttggtccagcacagctgactattctgactatagaaacaactgtgagagtgagggtggcctacttaaaaggccttgtactgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatcctggggttggcggtggcagggctagggtggacctgacagagtcacaagatcatgcactgtggttaagagaactgtagcaggaggaggttcattcaaatgggcattcctaactgaaaataggctagaagaacttaggtaaatcatgggtatccagaaatgggcagtgttgtgtggaccagcttgcagtgtttttggcagtttgaaggtaatttctttgcatgtggtatttttcaaaattagttgatcatttctggtattgcaccgctactctgactctaataatggaaagttcactcacggtgttcttgtctaagaatgctttggagaattctaggatctgttagtaccaggtactagcagctcagcactaggtctgctgggtcatttatttcagattgagagttacatatattgtatgtgaatataaaccagtttcagaataattatccagtggataagctcttccttgaataacagtgtatgtcagtcagttactaatattttttggaaagttcctcaagagcacattgaattcagcagccacatagctgtgttattactttttccacaggaggtaaaccaacaatatgtctttcatatggtcaataattaaagatgcatttttccttttatccttattaaaatggactttttaagactgaactgaaatttcatcttgtaaaataaaaatgtgaagatttactagcaaaactactccatattaatgtatattattcaaaccagagctgaaattctgatccccaaatttccactcatgaccacagtctcccggcttcccagtagatgtaaagtaagatcagccattctttgtgctgtcccccaacctcagttctctgcctctgcttccatgtccacattagtagtgaggccactcagaaggcaggtgtctggctcaagggaggataaaaccaaagccttgctgcctttgcaagaggtgcagcttggtccagccccagcgctgaagacttgcaggaacatttgggaacacactcattttgcaaggtattattagagataaaattttgatgccatgttctctattaaattagttgataccgaaaaacagtttctaaaaatctaatttggcgccattctcagaccgcccccccgcccccgcaaagaaaagcctttttggaccattcgtgtattataatcatctaagtgtgaaaattttagtttgtaatcaatgtttactcagccttttgggaagtaatggtggcatattactttctcatctttcttttctttctttttttttttaaagatggagtctcactctgtcaccaggctgaagtgcagtggcacgatcctagctcactgcaacccccgcctcccaggttcaagcgattctgctgcctcagcctcccgagtagctgggactacaggcacccgccacctcgcccagctaatttttgtatttttagtagagacagggtttcaccatgttgtccaggatggtctcgatctcttgacctcgtgatccgcctgcctcagcctcccaaagtgctgggattacaggcgttagccaccatgcccggctctcatctttattttctgtgatttctgcatattagttgcgcagtctaaaatgctgacataacccacaaacactgttgtcctttccccaattcagaaagttgaagatttgaaacatttacatttgaaagttgattcttccccccatgagacacatctaagttaataactagcaggacttatgttcatttattctcattctctaccttcttttaccttaaattcatagcatttgtgagcatattttaaaacaaatattaatgaaaaaacaatagaatctcagtttcattcaggcgacgattttgcttttaagtttgcacaagacagcttatttattattaaggtagacaaaatcaattttgctttttaaacattttcataagagcctcctatccttttttcttgtgtccttacaaatatctgaatctcttcatgggtgttttagtttaatttgtacatttgtctgtcagtagctgggaaaattaaatattgtttcagccacaaaccatgccattctaaaattgagaatgctaaaatgtttcctttttggtacattttatcttctaaggcccatgtggcaagtgagaatgcagaactatgatcgaatttattttttcttttgaagtgttttagaaacattttggcatattttgagttttattgttttaaaaatagttaacagaccacgattcttattctgaactgttttaaatgaactgtggatttagatgcttcgaaactaaaatatgagactcttgtttatttctagatgttgcttcactattaaaaattatctattacaatctaaattgcatgatttgtgggttttagctaacctctttcattttaaaactactttatagattttcaagaaacaaatatttacatttttatgatatgaagatagtataatttaaattgttagactaagtattgtgatgtcagtgaagcagaaaattgtgacattagtaagaatgatgctcttccagcacacttcactccatgcatgtttcctcaaagagtcaactatggtatttattattgttttggagaattttttgagagaagccattattctaagaaaaggatgagccccttattattgaaataaatgtatcatcagacatgcagaataaacatgtagtggagcatgaaactatcctgtagtaatattaattaaacatgctgaaaaaataccctcatcttcacagatactctttttgctttacttcaactgcaaatttaccaacttgatgccacacacacacacacacacacacacacacacattttttaaatagagttaatagatgtgtactatgacatcaaaagggactttctgttaccacaaaattgttagtagagtccacagctgaaaacagcaggtgttaagtacccgatattctaaagcatgccaccaacaactgaagccagccgcctccctccagcgattactaagagacccaccatttttcattcattcaataaatattgattaagcacctactatgtttcaagcagtgttctaggcactagagatgtagctgtttactagacaaaggccctatccaaatggaatttataacctggtgggaggggaagaaaatagttctctccttacctaaagtcaaataaggagccttccagagatccattcacagagaatggtggtgcctgcaggaaagggatacggttacctggtaccccagcaaggtgcttactgagctagctgaatctgtagacccactggtgtgccactaaaggcagagcctttagttcctggaagtttggaaggtatattagcatagacactgatatctgcttctctcccaaagatttttgtaggtaggagacttctgtaggtagagccgaggcctgcgggataactaagggccattggagtagtgacccttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcaaacaaaccagagcaagaccagggaaacatacctcactgacaagtcaccatttacataataacatccggtctccttcctgctcccagcactagaggaaccagaccttagaaagagacggcgagaaggttctagatatagacatcatccttccccactgtaaattggtgcaagctcatgctaagggaagggacaaaatttgcacttaataagagattgaagtttatatttggtctggacttttaataagtaaaagtgaccagaaatcagtgaaatcatcccaagatttactgtgggatatgtcaaggaaatttgactttgcatagccgaaagagtgtaattggagaaaaattaaattactttaagtttatattattgctccacagaggtttgactacccagtaagctagttacagatatactttaaccactgttgtttttgtaatgtttgtgatcttccataacaaatatttctcatataatgtttttcttaaattgaagtataaaaagaaaattaatcacttaatttgttaacctcttatttacggcttcattggtgttttaaactattcaaagtgctaatcagaatcgctgagataagaaatcaaaggtaatacaatttttcatctgcccttaatagatccagaaagatttaattactggttgcttttgagttacttaaattttgttgtcctgggcctagaatgttagagctgcttacaatatatcagaagtgtgcccaaattaagtatttcctgatatttttaataagcaaagctacttaccagaaacggaaaatgcacataagaaatgggtgctcagctgccattgaggaatgcaacgaaaatttcatcattccttttttaaatgggtggccgagatttctctaagacaagataattatagtaatgctcatcagtttgtaactcctgcactagattcaaggtaaacacagcaccaaaccaactgtggaacagtctgaacagacataggcaaagtctcactggaatgtgaaggagacatgttttattggttttgtcagggtatctctgttacatttattgataacattaggaaatctatcccaaagggctatgtagaaatgtgtttctttggctaaagagctggttaaatagaaaaatgcttaattaacacatatgcacttatttcatatggccagtgatggctaaaatacatgaatagcttataagtaaaatgcttcaccaggtacaatctgacaggaaagttgggatttttaagtaattttttctatttttaacctataaacaatttgtgaaaaaactgtttcacatgatcattggattttgtagtgcttttgtagttcatgggaaacccatgaaacagctatcagtagactgcagttcaaatttatgtgggttagatgttgcctttgagggcctacataagcacctctagctgagagacctagggtggatcatttgatctctctaagcatcctcacctgtcaaacggggttggtaatatctgccccctaaggtgattgctaggcttcaatgacttagtgtacaggaccttaggatagtattcagcacattgtaaataatcagtaattggcactttctcctactccttcattgatattcatgagaaaccgtattcttccttttctttgggaatgaaaatctagaatcctaagtttcttctaggtgctctgaagttaaacagccaaaacagaatgattcatggtagtttccaattgtaatcccagaatatttttagttattcagtcagctgaagacctgggcctctcagctcagaacaggataaataatgtctgtttggggaaggggggtctgccagtagatttgatgttaatgcagcttttaagatcacatttttacagtgaggaattcagcttttcttctatagtgttatcaagtgcctgaaattatcactatcttatttttgtaaatgcatattttaaatgtatatgtagggttttctttaaacaggcttcatagtagtttggattgactagaatgctccttttttgtatgcttctcagtgccaggaattaaatcaggaaaatgccttaatatatgaatgttttcttttctttttttttctttctttctttcttttttttttttttttttttttttaactttaagtactacctgttatccctgtggctcagccttatgggcaaaaggccccttgcctgtttatgtatatctaaaccaatcagtggacctgactggatttttactagtgctttgttgtgttttctgttctcattgttagttaaatgtgtggcagcctccatcaacagtgttttctaaaaccaaacaagattctgttcaacacagtaaaaatttcagctaaaatggaatattaagggaaaaaagagtatgttgctccaggccacaagaaactcaaaacagtctgagacatgcactggtaaatcttaaaaatgctataggcaattcagcatcaaaactgccatagaaaattcttgttgttagccattctgttgatagttcatattgttagaattgctagcagatgggaaaatagatgagtcaggatacagtattagcaacccatatttttttaatcaaaggccactaataaggtctgtagcatctgcaagatttatttaaacagttgctaggaagagtttgttttcccagtaaacacagcaaaccttaggattctcttgattgactgtttgactaaatgtgttaacattaacatgtaagaccatttgcttcattgtagtagtgtctcatttattttgacagactgattgttccagcaactcatagaatcattaggtcttgaaatgttattacattgatgtattcaaaaccttcatattcccgtttctgctatttgagatttgacttcttaaaaatcgctcatgtaattacgactatttttgacaaaacaaaattatatagaaatcttagtgtttttccccagagattttaagatgaattattttatgaagtaagttttatcacttgactgtgatattttaggtttttatagtagactagatatgtaaacttaaaggaagttctaattttactgacaactctttctgatcagtaataagcagactttcaatacttcttatagagttcagaaataattctaattattaaaggtttgaaatgtcagaattatcagtgaattgatttaatcttattttccaccctaacttctcatatcactgagttttttatgctcctgttttatacaagagctagtaactgagttattaatttgcgtatcttttacttggttttttttttagaaatactgagaaatgtcatagttttgtatattgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccattcaacaagtctctaggaagttccaaactttccccacatcttcttaacttcttctgagccctccaaactattccaacctctgcccattacccagttccaaagttgcttccacatttcaagttatctttatagcagcgccccactacctcagtgccagttaactgtgttagtccattttcacactactataaagaaatacccaagactgggtaatttacaaaggaaagaggtgtattgattcacagttccatgtgactggggaggcctcaggaaatttacaatcatggtggaaggtgaaggtgaagcaagcctggaccttctcacgtggtgagaggggagagcagagtgagattgaagaaggaagggccccttataaaaccatcagatattgtgagaactcactcactatcactagaacagcatggagggaaactgcccccatgatccaatcacctcccaccaggtctctccctagacacatggggattatgaggattacaattcatgatgagatttgggtggggacacagccaaaccatatcagtaaagtcttaggttacaaaatcagtgtgtacaaatcagtagcactattatataccaacagtgaccaagctgagaatcaaatcaagaactcaaccccttttacaatagctgtaaaataattaataataataatagtaatagcaataaattacctaggaatatacttagccaagaaggtaaaagatccctacagggagaactacaaaacactgttgaaagaaatcatgcatgacacaaatggaaatacatcccatgctcatggattggaagaatcaatattatgaaaaagaccttactgcccaaagcagtctacagattcagtgcatttcctatcaaaataccaacatcatttttcacaaaattagaaaaaaatcctaaaagtcacatagaaccaaaaaagagcatatgtaaatacatgtgtgtgtgcacatgtgtgtgtgtgtgtgtgtatatgtgtgtgtatgtgatattgagacaaagttttatcacttaaagaactaagatttaggtacttcattaatttacttacatgaacacctaattccttaataatgttagataatgtttctctaatatcacagacctgtttttcacaaattttacgcattgataatataaaaatctgttaaaggaagaaaatttttcttctaagtagcttctttttctgagttcagtctattactgcaatacaatatttataaacctattggcagtttgccccagtaaaagtagtacaagatatttacaggaatatcttaattcagaattaaagtaatgataattgtttgctttatataatatgttagttcttctgatcttagagtaacccactcctttgggtcatatattcttattcatatttatctatctacgtttacgtcatgttatttgcagtatagtaggatagtttcttggtgtatgtacagtctctaaagtctaagtattttttggaatatctagggacatgaaactcatgcataaaaatcaattataaaatagtacatgatttagaatcaaatactaaattgtgttgtttaaattatgagtgttacatagaaatttagaaatgggaaagattaacatgggctgaaatagagatgatgttgaagaacacagaagtggaactggatcctacatagacatagttgggcatgtctttcttgggaaatgtggttgtgtggtatacattggcctttcaatgtggccattaccgatgtgtacagttcaaagtttggagtttccctgtttgtcttattctgtatctccacagtgatttgaacagcactgagcatgtaacagatgcaagatcactacttggattaaaaatcaatgaagaaagtgtataatactacatatgatatataaatgtatgttttatggcataatattaaaagctaggttctttcatgacatatgactacaaaataacagggctgattattaatatacataccagaacttcttatgcaccgaagtgagtggcattcaccttcaaagtcatcatcatggaagcctgcatactcttctccataacactgtcatttctcaaaatatttttggaactccttttttgaatttccttcagagagtctatgactcattcttttcagtatcctcagagtctttttcagctaagagtgaatttggtttttggaagcagaagtcacgatagggccagggatggcgagtaaaaggatctgctgagaaatgctactttggatgactataagtaatgagtatttttcctagcttgactcataaaataaccaaaggcaattatcttcttaaaacaaaaagtaagttgcaagttttatcattttaaaaccaagcctgagctgggtgcagtggcacatcccagctactgaggaggtcaaggcaggaggatctcttgagcccagaagtttgagaccttgtgtcaaaaaaaataagaagaagaagaagaagaaaagaaaaccaaatctggattactcttacataactgtcctactccagaattgatcatggcttcctgcttttggggccccaccaggcctattcagccttacttcccgccccctaccacagtcatcttctttattaagcatttagtaaaatggaggatagaatggttaatttaacctttattcagtcttgtcacattcttgagtgatctctgcaagtgttcatgattattgtagcactcagtagctggcaaagatgtaaaaagttagagtgaatatacctggaacatattctgaaaatctgtttgttggcagtggtggatttgtctttgtacctttttacaaattccatcagcgtatttttctcatttgccctttattaaaggcagaggatcggattgcttcattgcagattactggaggttcttgcaagatatgacctctgagttcttcaaggaagaaattcctgttttaattgttgaactatacttcaaagatgatgtaaagaatttgctgaaatatttatgttaaaactcattagacattaaagtctaatttcattgtattgattgtggataatgtggataatttcattgtattggtatctttctttctgtatctagttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccacccagcatatttcgtttctgtatctttgttaaaactcatgacctggactctgcattttccaagcaagggacgtatattagttaggacaggctagattatgcagtgctgacaaccctcacccttcagcggcttcacataatacaggttattcctcactcttgctccaggcccaccccagtttggcagggcgccctgctcctatcatccacacccagggacctgctgacagggcctcaaccatctgagatatctgtggtcaccacaataaggagaaggggagctggagagtttcatactagctccagccagtagtgatacatgtctggttggccacaacccagtattcagaattagtcacatggacactcctaacttcgagggagtcaggaagagtagcatcaccacgtagctggaggggagagaacaggaaaagctgatgagttcactaatgtctgtcacagaaggtatattgtctctggaaagcttccattcctttttaaaaatggtatttgtaccctaggtaatgcctcaaagtgtcatttgtctctaccctgttgagcccttacaaataataataaattgtataattggatacaaattataagattataaaaagaacgataagtatgaaacatacaaagattattaaaaaatgaagaactgaatttacaatatatgcttcagcaaatctatactggagtctgttggggacagttgtgtgagttgatcaactgaaacaccctgcccttttttcttttcctaattatttttctttttactaacctgttcgatatcttgcctgatttgatggaatcaaatgactgatttgctgtcatccaagcaaaaccacctacatgacatggacaagaaacctatgaagatgatttctcttcagtttgctaaattagaaaatgtatgcaaattaactcagcgaggcctgttaaccactcttaattcaatctcgagagtcctccttttaatatgtcaagtgttccactcacattgcaattttctgcagttagactttatatcctattatatctatgtctatttaagtgtatgtacacaaatacacacatatatttaagagaattaagaggaatgggcattgttttattttagagccctaggaaactccaaaacattttaggatgacctacttttaaatttttcctatcttcttactctttgcccctaccagtcaaaggaatttaagatatgttttgaagaatcacaagccatgaaagaaatctgcctgggtgcagtggctcacacctgtaatcccagcactttgggaggccgaggcaggcagatcacaaggtcaggagttcgagaccagcctgactaatatggtgaaaccccatctctactgaaaatacaaaaattagctgggcgtggtggcacatgcccgtaatcccagctactcaggaggctgaggcaggagaatcacttgaacccaggaggcagaaggttgcagtgggccaagatcacaccactgcgctccagcctgggtgacagagcgagactctgtctcgaaaaaaaaaaaaaaaaaaaaaaaccaggaaagaaatcaagtctaggccaggcttggtggctcatgcctgtaatcccagcactttgggaggctgaggccagcagatcacttgaggtcaagagttcaagaccagcctgaccaacatggtgaaaccctgtctctactaaaaatacaaaaattagctgatcgtggtagcaggcgcctgtaatcccagctacttgggaggctaagggaggagaatcgcttgaacctggaaggcggaggttgcagtgagctgagatcacaccactgcaccccagcctgggcaacagagtaaggctttgtctcaaaaaaaaaaaaaaaaaaaatcttcaagtctagttaagccttgattaatcatgatgcttaggaaagacagttttctagttattttaatgagtttaagaagaaacctattttaacctggttgctgggaactttccaaaaat

SEQ ID NO: 12584 - DNA, 69763 bp, Human
aacagttccccaggacacttagtgaacacacagatttccagactctgctggcaatttggatttttttaagaaggctggcggatgattcttgggcatattaaagattgacaacgagttctctactcactgtggctaggaatacaaaaggatgggcatagaggggaatgggaaccgaaagattagagcacgagtcactgatcagccaggcaggggtgacctcaggcaagaaaaccttcagaggtaaaaccaggtgggagttatttacagtagatcatgaaagatggggagtgcgggaactatgtcagtcaccacagggatgcaaaggaatgaaaagataagagaactattcaggaggaagaacaggtcctagtgtatgctagttactgatttgctggggtaatattatttcccagaaacagaaccctgtgtcaaatccaggagcctgggggactgtagaacctgaagttttactgggtaagcataaacctaaaactacaacagttggataagtggtgtgatatatttcacatggacctcctgcctagttcacttctttatagtcgctagaacactcatgacaatttatttctgggaagaagccaggatgaattcgaaagcatcctgacaccccacccctttcttttctctagacttcaggttaactcctgcccttcggttttggtaaaactaccctgccaagccttatcttgtattttgctcctgtttttgttatcaaatgtgtaaaacagtcacgatgaatatacatgccaactgctttcagaggcaacggttagtctcttgcaagtttcaacgtgcacattttggagctgctgtctctgtgggaacctgcaggcacctcatggatgcaccacaactcggaaattacagtaccacctggaacaccttatccaggcaaggagatcattaagcctggtgtttgaggcaatcgattcacttggaagaaggtgctttggtggttttgagaggaacaatccctacatgaaatccctccatgggaaatggagaacatcagctatttcccattgccttcaaacctaaagatgtcgccaggcctcttggcttgttactgaagcagcgaaataagtcagaaatcaaagacttagaagttacgaaaagaaaatctcaaaaaggagaatggggtcaggcgcggtgtcaggcctggaatcctagcattttgggaggcagaggcgggaggatcgcttgtggccaagagttcaagaccagcctgggcaacatatcgagacgcctgtctgtattttaaataaataaatatggagaatgggaaacccatcaggctgtaatctcacagggaatttagtaccctttacctaagacaagacctgggcacttgggaagcctccccgagtgcggtttggggagggggagggcatcttaaattccagtcctcggtcactcttgtggctttgccaagggattttcaaatcccgggaatgccagggatggagatgaacaggctgaaatcccccacgctgccagggttagggaggggaaaacaacagtccacagcggccgcgaaggtttgtatttttttttttttggtaacaaggggcttgtgtgcagtccaatatcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcaggcaagtacacggcgtccccgctgagatgcagacgcgcttgcctccatccatctgcgactccctctgtgtgcgtgtgtgtggtcgccacccgcgaaaccgtcctcacggccgtgccgcgtccctgcccggagccgggtccccgtgtgcgtccgaaagttcaggatcttctgtcctcccgtggggtttctggcccccgtttcgctaggagagttccgcacccaacccagaatctgcagtctctccgcatccccgctggcctcggtcactttctctaagcttcgacccccagcccccgcccctccacactggagcaacgtcactgatctaacccagtgcaacttagggcccccccgtggggaagaagtcgctccccggcccttcccggggccctaccgtgtacccaaaacgcagccgcggtgaagaaggtcgcgtgatgacaggcccctggcagctgctgggaaatggtggtctctgccgggctgtcatccgcgtgattgcggaaggcaggtgacaccattcttagcctcgggcccagggagttccagcaggtagaggcctaccgagcaaagaggaatgcctagcatcggcctaactcgggggtgggaccagtattaattgttaaagcctctgggaaagggctcttgtgacaaaaggagtctgttggaaaagcgcatttttcaggtgtctgagggaaggatgacctcgaaaataaatggtgctggagaaaagctccagggaatggaggagctttcagagagacaggatgccagcctgagaaacccaaggagggcactgctcagagaccgcagttgcctcccgcaggtcagaccctgctgaggaccggttggttgtgaagttagacaaaagtgctggacttttagcctctgtgaatatgtagatttcaaagggtgtcggaaataccgttgaaagtggtaattcctcatttttcctccttggcagctcggattctgaaggtaattttgagactcctgaagctgaaaccccgatccgatcacctttcaaggagtcctgtgatccatcactcggattggcaggacctggggccaaaagccaaggtaaagaaaaacttgcatttttcctgcctgttttgtttcaaaagttttgaaaaatatcaatgaaggaaggaaaaaagtgtaaatttaggaccatttaagagagtttgactaagaaagagctgtttgaaacctcctggcttatgtatttttaggggtgtggtgatcgaggctttctcctctgagtagagtttgtgcatttgcagtataagattatcattatcaaacattcctactaggcctttctcctcagcccctaaaaaaatatgtatagtaatgaagtaggaagatcatgtttatatttgacttcacaaattcctcaggctaagttgctttctactggggtgtggctggagacaaaaattacaggtaagacttgacttaatttttgatagggaggttcttaagaggctttttcggaatcactcacctcgcccacttccatgcagggatgtggtgagagcccttcagtctacttaggaaaacctggcacatggattccctcccagcccctcagagcccagcccttcatctgcaggagcttccgttgtctcacttaattagtagaaaccttttttgtcacacagccagttcagaataaaatttcacctatcccaacagaattcatatgcttatttactaaatagagtgcactgtgattcagcagtgaagtcctgctctctcgagctaacattgtggagggagaacctgtgaagggttaagcaaaatatctatgtcagcttgtgtgaagcactgtggagaaaaataaagcaggggaagagaatagggaatatggagtggggatagggaaggctgaaggggagttagtgggggcattcatgattaggtgacttgaacagagacctgaaggcagattgagggagcaggccttggaggttcctgaggtgggaacccttccagcagaaggagtggcatctgcaaaggtctgacagcaccagcctgctgcagggaggccgtaaggtggagggttcatggtacagtttgaggaccagccaggaggtcagtgtggactgactactcagagagcaggaggagctgaagtcagcgtggtcagaggaggtccagatgctgctgcagtgaggatttggttttcagtaaggtggaaagccactggagggcatatgcatttccaagggctgccataacagagtaacttagcggcttacaataacagaaattattctctcacagtcctggataattgaaatcagaaccagaagtctcaagtcaaggtgttggcagggccttgctcttctgaaggctccaggaagtctgtccttgcctcttctagcctctgctgggtgtctgcaatcctttgtgttctttggcttgtggcagcagaactccagtctctgtctcaacacatggccatcttctccctatgtatctgtcttaccgtgcccttcctgtgaggacaccagtcgttgaagttagggcccaccctaatccagtttgacctcatcttaacttggtaacatcttcagagatactatttctagataaggtcacattcataggtactaggagttgggactttaacatatcattttgagagacataattcagcccacaacagagagctttgaacagagggattgtgattcagcttcttttgtaaaaggctccctgggctgctgtgtggagaagggactctaggatggaagtcctttttatgtggtttctctgttccagtatctggcactgtcaccctgaagtggcagcgccagctttcagttatctagctacctaaactttgtgctgattgtgactttctcctctccctaataagtatttttattgcttagcaacttcttcgtaggttgcctagggaagtcaagttactctggtaatagactgcatgatggagctggaattattggtaaaatgacatcagcaaaaagctgatttggttttgctttaaattgatagctccatgctgtgcttacccagctgagaattcagcaataccctcaacttgccctaggctgcattttgccattgttctaggcagggacaacatgggaataggcaagcttatatactggagaatttgtgtgcgacgcatagctgtgtagcactctcagtgatgaagataacacttattcctcatagcttcccttttcttccgtaaagattggcagatcagaagggagattttgaagcttgaaagaactatttggtggcctttccatcaaatttaaataaagctcataagacacatgttaaggagctgtttgaaagcctttttgaattgccatcagcttgggcggcccttcctcatcgttttgtcagctgctagactgattcatcccgccagattctttgccaattgaatagaggcctggatgacctaggcccccaaaaccacagagacccaattgtttggtccttcctgtaccagtgactctcacatttttttcattctctctaaaaggaaaacttttaaatgtttatggatcatgaaggctctatggggtagttcatgaatgcagactgtaattgtaggggtagaggagtgtccagtccaggaaacaaccctgcatattatgaaggctttcagtttagggtctttaaacaataggatgattgctcatcaacctggtcgtaccctgacttccagggtccttgggtgcaacatccggagctagtccagagtaccgccaatggccttgtcacacatacacagcaaatgtgcaaagacagccagagcacaggtctgcctggagaggatttcagtgggcagaaagcccttcagagtcatttcatattgaagtttaatttctgggactggataagttccctttctcccaaaattattgattgttttgttcctggtaaagatagtctttcatacttttgtggttccaagacatggttggaccgcagttataaattatataagactaaatcattctggaagaatgatttacgaggagttagtcaggagttggagttgaaatatgtaaacattctggcttcctggtacataatggccctcaaacgtgtgggctacatttaccatacccatggctcctgtgctgacttctgtatagttctttgaactcagggaaacatctaagactattttgaaatgacttttcttatactggaactgctttaggaacttgcagtatctaaactctataatgactcttcctaagagttgtatgccaggagttaagtggcggataaggttgtagattttttttgaagccacatatagaagcaggttttaggcttactggtaaaataaaactctagctaaagatatttcctggaaataaccagactggtagctgtaaagcttgggctggtctgtatttgctatctgtctgttttctcccactaaagttgtttaatgctgctgctgttgtggtggtctttctctttgctgggaaatatattggtgaagaaacatcctctaggaatggacttttgaggaggtacaatctcaagttcatcctctgttttgttttgctttgagacaggatctatgtctagactggagtgcagtagtatgatcatagcttactgcagcctccaactcctgggctcagatgatcctcctgcctcagcctcctgagtagctgggactataggcacacactaccatgcctggctaattttttgttttgttttgttttttgagatagagtctcgctctgttgccctggctgaaatgcagtggtgcgatctcggctcactgcaagctccgcctcctgggttcacgccattcttctgcctcagcctcccaagtagctaggaccacaggcgcccaccactacgcccagctaattttttgtatttttagtagagacggggtttcaccgtgttagccaggatggtctcgatctcctgacctcgtgatccgcccgccttggcctcccaaagtgctgggattacaggcgtgagccaccacgcctggccagtttttttattttttgtagagatagggtcttgctatgttgcctaggctgatctcgaactcctggcctaaagggattctcctgcctcaccctcccaaagtcctgggattacaggcgtgagctaccatgcctggcttttgtgtttgcatgtgtgtttatggaggacttaggggttgtggctttgtgtagctgtttcagtcacaaaaactgcagtgggtgccctctgccccttgagtttctccttcaccaacatagccccccttccccaaacacacacacctttatctacagattgttacctctctctgagaaagagaatcttaattagtgtagaagctctcacatcacccttggaacaactcgttaaacctctccagtttgatgtgttaattaaatgcctaggtatttcaaacacaaactgtagttctctggacttttccccagaatagaagaaaagagataaatgggatctgtgcacagatatttactgcctcaggcctgtgagggaatgccaagttgtttgttgacacaattttggtagtctcgatcagaatcagcaaactgtgactcatagaccaagccctgcctgtcctgtttttttgcatggccctgaacagaagaatgagttttacattttttgatggtttaatggtgatgtgtgaaaataatgtgaaatccaaatttcagggcccatcaatggtcacacgattatgtgaatttactaaaaaccattgcatcatatattttaaagggtggactgtatggtttgtgaattatatctcaataaagtagttcttaaaaaaaaacaaaacaaaatttcagggcccatcaagttatatatatatgaaatatatattttggtagatatggggtcttgctatgttgcccaggctgatcttgagctccagggctcaagtaagtgatcctcccacctcagcctcccaaaatgctgggatttcaggtttgaaccaccactgtcatccccataaataaagttattggaatacagccatactcattcattcatgtattgtctatggctgcttttgctctacaatagctgggttgagtacttggaacagagaccaaatgtctggcaaaagtctaacatatttactatcttgtacagaaaaaaaatgtcaacctacatctatacttattacaatttcagtaaaaatacagagtttaagtaatttgggaaaatggctttaagaatgaaaaggtgcaaggttatacctgctgaacaaatgaactgtgggcgtgaggtgccattagtctaggcctgcatgttcagggaaggcccaggggagagcctgatgtggcctggctatttgtcatatttgcaaaggggaagtgatgtaattggtctgcaatgaacttgattttcaattgactcaaagatctaaggaggaataaaaattatttaaaaaggaaattagggaagaatggggagaatattggaatcatttaatagaagtacaaacacatagacttttaacttttgcccattaaattttttttaacattttattttcttaaattttttttaaaaaaatagtgatggggtttcactgtgttgcccaggctggtctcgaactcctgggctcaagtgatcctcccaccttggcctcccaaagtgttggggttacaggcatgagccagcctcacccaacccattaaatgtctttaatgtaacttcgggtgtatgagaatttgtaagttgactgtgcagatctcttaaaaggttgatatggtgtatttttagaatgttttagactgcacgtgtgtgtgtgtttgtttgtgtgtgtgtgtgtgcgtgctatagaaaacacagcatggaaaccttgttaaaatcagaggctttgattttttattctaaagctttgagttatatgtttaatcagatactatgtgaaaaattttcattaggtacatattgaagtgttccattcaagtctacaagtatatcctcctaaggatttagtttaacatcctttccctgctccaacaagggaatgctttattagagtttcctagaaataatgggactaattaggacctttcatattacctagtccagcagtccaacccatgtggctccttcaacagcatcgcagcctaatgcttttaatttaattttaaatttttaatgttttgctgtgattgcctcttccacagtttgatttttttgtactgtataattccatgttaaggtatttaaagcttgaaaatcttagcatgatatagctactttgttttttcatgtatttttagctctgaagttggagattccaaccagctaataaatgagatcagagtcatgtgtttttttgttgttgttgctctatcacaatgtaaatgtgcccctaggaagcacctgcttctatatggtgccttacccaagggagtgtcttcctggggaaaaaagtgtagtttttccagcagaaacttgtgagagtgcagaaccacagaggagcaacagtgtctgaataaaaaattccagggcagggaagcaaagtctacctgcagaaaggaaagattttagtaactatcaaatcacaatttttcttttaagatgagtgacaaaatcaagaccttgcactcccccattttgggcttacccaagcatcgaataaagcagtagaacttactttggtacttgcgggtggcagagacactttctacctgtgtatgtgttttgggagccggcagtccttctaaaattatattgctgccatgtaatgtcccacctacaaaatggatgtggcctaaagccatttaaacatttaaatgaaagagcagttgcagtgtctttttcaggttaccagttatactgcccagaggaaatcttggagggtataaaccattttgtcacactctcctaaatccagagtagcgatgggagataatggtttatccacccaaaacaaccctctcagtggagatttcataaccaaggttgctaaattgcctggtgactattaaatctgggcttagaaaggctttgctacttgtgagttcaagatctcaccctcacctttgcatgtacatgacctaattttatgagttcaaacaaacatgattagatccccagggtttagattgatgatggccagactcacaagggaataataataatggcatggagtattttattaattcacaaatgaaaaatgtatcttgacagtttggcagatgcagatactctcctagccagtcgaggaccctctttcttatatcatagctggaaatatgacaataaatgattgatctccagctttcccattacaatattcccacctagcagatcaccagctatctgtttcagccgtatttatttattagatgtgttgggaacaagtaatctttgtttgcagcatcttgtttgatttttatgaccatgattctgcgagataggacacaagtgatttccatttcacagattgggaaattgaggccagagcctttactgctagtagtggacctgggttttgaattcagcttttaagattgcagatccagagctctttggaacatattatacagcttttctctccaggaaatttgtgaatccctctctgttgttcactatctgaagagaagacatatcagaggaaataaagggtcttaaaatgttgccagagcagggtgtgtgatgggggaaagcatcgtcttaagtatcctgtcatgtgatagtagtttaaaaaatcaaaaaatacatcttccacatgtgtgaacttggcacatattattctgaagtatgaaatgtattttaggaagttgaaacatcagaagtttggaagcttgcagcatgatttagatataaattaatagtcaagcaaaaatcatcactggataagtgcagtgggattgaaaacattttgcttcctcaatgcctagcttcagctcatcagtgaaaaataaagaaggagtagacaaattcagtactagcctttgcattctgtctccacctgagtcatgcatggttgagaagaggcaggtgtgtggaggtgtgtgcggctgccaggggctctgcgcctgttttatggtagatagaggagtttttaagaggcctttgttggtgatctctggctgcataacaaattactccaaaactgaaaacaacgaacatctcacatagtctttgtagttgggaaatttgggagctgggtggtgtggctcaggtcacttttgagaatgctgtcaagatgtcggctgggactgcagttgtttaaagacttgactgaggctcaagaatcctctcctaaggcggcttactcatttgcctgggctgtgagtgctggctgttggtgggaggctgcagtcctcaccatgtggaccactgctgggttgcttgagtatcctcacagcatggcagctggctgccccagagtgagtgatccaagagcaagcaagatagaaactgcagagtcttctgtgacttagcctcaaaagtcacacttatttccacagtatccttttggttacacaggtcagtccaagggcatgtgtaccaggaggtgagacatataggggccgtcttggaggctggctaccacaaagcccttttccactttttaaaaaacttgcatgaaaggatatacaagggtatacattcttagatggcaaagcttttcccattgctttcttcctttggcgtctcttcactatgcccttcctaaccccactccttcttgctgccctctttcttaaacaggagcagaactggctgaagaaattatatagccgcctattggcttgtggtcctgccatggatgtgtctcatgcacccagcatgctggctgagattgctctgtctggaggcccctctcttgctgaacattcctccctcttcttctttatccagcatcagcttctcagctccatgtgggtggttgctactttgtgagagaggcagttggtattttgaattttccagtaattatttctgaagagatgcacattatggttgtttggcagcaacagattgaagttacacaatcccagatctctgcacaggagccccatctgttagcacgtgctctttccccccttgctcttcctgccagaataggttggggatgggggagaagttttgtggggagggccttctatgatttctgtctgtggaaggggatttctactctgtctaaaatataacctcaaacaaatccagatggttccagaacccatgggcatctcatgagtgagaagagaagacacattcattgctggattggcttctctggaggaggctttggcttcctggtgggtggacacttcctgataagcaagtcccatcctcttaccttataatcttggcctttagagatacggtttgggtctctttttatttttcttccttttttttttttagagacagggtcttgctgtgttgcccaggctggagtgtggtggtacaatcatagctcactgcagcctcaactcccagtcttaagggatcctcctgactcagccttccgagtagctgggactacaggcgtgtaccactacacctggcttgggtgtctttttaaataaaatagcataaagtgctgttttggaaatttgaagtgctttcttcatccttagtacaaacttttttcagtttaccaagtggttttccagattattctttacctgtagagtcttaggttttagggggagcctctctcaggagttagaggcttatctcaggagaacagcagtgtagctggtgccctgtctcttaaaaaagcaatgaaatttgccctaccgtgacttctgggtaatgtttttgtttgggggttttttggaggttaggaaggggtttaaacaggtagtttgttgtctgggttctgcgtgtgtgtgtgtgtgtgtgtgtgtgtgtgtgtgtatgtgtatttttctgctttggttggtgagacagcttaaaactatgatgtacctaagaggatggtctgccttgactcacccactcagaatcccgctgacccacccctctcccatgcttccggggatcctgggccccagcagttgttggggaaatgtgagctatgcagcccatacccttagattgtatcccgcattcctggaaaagggcctattgtacggttgttccaaccctggacaataaattgtgtacttctccattttaaggctgatgactaagtgagaacgaacatatataaaatacacttcaactttggaggaatcagagagactgggaacccaaagacatgaaactgggggaaaaaaacactcaaattttggacttttagcattaatgctaatatacatctgattaacagtctcctcagggcagaccacttgagcagaaagggttggtgccagaatcacgcttgtttccctcctgaagcccttgattcagtgtgggggaggagagctgggagggcaagaccaaggcacggaaaggaggagtgggaccttcagggcaaagggccaagggaagagctatgccaagccatcccccagccgttagcctagagctgagctgcggcatcactgaacaattagctaggccttctcagtatgcgacagatgaggtgaggaggagtcctttatgtatcagacacttgccctgcagtgggcactgattgagcatcagctctgtcttggacgctcagtttctgctcccagggatacaaagagtaaggcccctgtggggctccgagtctggagggagctagccctgtcctgtttcccagacctcttggccgccttggcatcccaagaagttttagcagcaaaagatagggaatttgtgagggaagaaattcccccgcaaatctggaggtcaaatgttaaaaggaagaaggcaaatgttaaaagttagaattttaaaaatccccctgcccacaaagtaaaaaaagccttttgggcttgacaattataactctaggatgtttcatataccatacttggctacatctgttgtggaaaagagggatgatgtcatttttttcacctctttctgtaaatagaatttatgtagcacatgtgggcttcctcaagagaaatttaaaaccccaaattgatgggatggtgagacctaccacctctctcaagcatgtgtctctccaagtgacacacataagacactatttaaagcatgtactttggatgtgtgtgctggctcactcctgtaatcccagcactttgggaggccaaagcaggaggattgcttgagaccagcctgggcaacaaaatgagaccccgactctaccaaaaacaaacaaacaaaaaattagcagggcatgatggcttgtgcctttagtcccagctgctcagaaggctaaggtgggaggatcacttgagcttgggaggttgaggctccagtgagccgtaatcgccccactgtactccagcctggacaacagagcaaatctgtgtggtatagttgaacattttactagaaatcacaggacattcctcctgctccatttccctcgggtctgagcctccatgttcttttttaaaaatagttttattgagatatagtttacctgccatacaattcaccatttaaaagctttatgatagtttttaatttatcgacagagttgtacaactattatctcaatttaatttttagaacattttatcacccccaaaggaaaccctatacccattaggtgtcacactccattcctcttccttcccaccaccagtcctaggtaactgatgatctagtttgtgtctcaatagatttgattatctaaacgtttcatgtaagtggagtagtagaatatgtagtcttgtatgactgaatcagttcactaaccatgttttcaaggttcagctatgttgtagcaagtatcgggactttattccttttttattgttgaacaataccccattttattgatatactatattttatttacccgtttattggttgacggacatttgggttatttacacttttggctatgatgaataatgctgctatgaacattcacatcatggatttatgttttcatttctcgggtatataactaggagtagaattgctaggccatatggtaacttcatgtcaaacattttgaggtactgccaaactttttcaaactggctgcactattttacatttctgccagtagtatttgagcgtttcaatttctccatatcctctccaacacttcttattgtctgtctgtttggttatagccatgccagtaggtgtggagtagttttgatttgcatttggttttcatttgcatttccctaatggctgatgatattgagcaacttttcatgtagctattgggtatttgtatatattctttagagaaatgtctattcagattctttccccactttttaattaggttatttatcttttttatcactaagttatatattctagatgcaaattccttattagatatgtgactaaatattttcttccattgtcttttcatttcttgatggtgtcatttgaagtgcaaaagttcttaattttgataacgttcagtttacttgttttgtctcttatgccttgatgtcatgtataagaagattttgcctaacccacaatcacaaagatttacttctttgtcttaacagttttatagtttgagctcttacatttagatttgtgatccattttgagtcagtttctgcatatggtgtaagggagtagtctagcttcattcttttgcatgtggatatccagttgtcccagcaccatttgtcaaaaagactattcttttccctatacaattaactttgcacccttgtcaaaaatcagttggccataggtacaagtattgatttgtaaactcttaattttgtttctctgatctatatgtctctcgttatgctggtaccaccacactgtcttgattactatagctttgtagtaagttttgaaatcaagaagtatgaggcctccaaatttgttcattttttcaagattgttttagctattctgagtccattgcatttctatatgaattttagaatcagtctgttaatttttgcaaagaaggcagctgggattttgatatggattgtattcaatctgtaaataaatttgggaagtattgctgtcttaacaatattaaatcttccaattcatgaacatggggtgtcttccatttatttaggttttctttaattgcttcaagcaatgttttttgttgttgttgtttgtttgttttttgagacatggtcttgctgtgtcacccaagctggattgcagtgatgcaagcatggctcactgcagcctcaacctcccaggcttagacagtcctgcccagcctctctagtagctggaatcacaggcgcatgccaccacgaccgggtaatttttaaattatttgtagagagagggtttccctatggtgcccaggctggtttccaactcctgagcttaagtcatcctcctgtctgctgctcccaaagtgctaagattacaggtgtgagccactgctcctggccttgcagtttttatagtataagttgtctcagtccgttttgtattgctgtaaagcaggggtccccaacccctgggcctattaggaatgggccacacagcaggaggtgagcagcagggtgaacgagcattactgcctgagctccacctcctctcagatcagcgatggcattagattctcataggagtgcgaaccctgttgtgaaaggcacataccggggatctaggttttgcactccttgtgagaatctaatgcctgatgatctgagctggaacagttttatcccaaaaccatacccctacctcccatctccccggtccatggaaaaattgtcttccatgaaaccggtccctggtgccaaaaaggttggggaccactgctgtaaaggaatacctgaggctgggtaattctaaagaaaaaaggtttatttggctcacaattctataggctgtagtagaagcatggcacaggcatctgtttctggtgagggcatcagggagcttccaattatggcagaaggcaaaggtggagcaggtgtgtcacatggtgagagacgagaaggagaaagagagaaagagaaaaggaggcgctgggctctttaataatcagatctgaggagagctaatagaatgagaactcactcattaccttcaggacagcaacaagccgttcatgagggatccacccccgtgacccagacacctcccactaggcctcacctacaacactgggaatcaaattttaacatgagatttgcaggggacaaatatccgaactacatcaacatcttatatttcttttgttaaattatttcctaaatattttattttttgatactgttataaatggaattgttttcttaattttttttggaattttcattgcaagtgtgtagaaatacaattgatttttacacattgatcttgcatcctatagccttgttggtttcatttatagttttttggtggattccgtaggactttctatatgaaagattatgtcatctgcaaatagagatagttttacttcctttccaatagggataccttttatttcttttcttgccagttaccttggttaaaacttctagaacagtgttgagtagaagtcgcaagagctgacatttttgtctcgttcttgaccttagggtgaaaacattcagtcttttatcattaagtatgacgtcagctgtgagtttttcataaatgccctttattgaggaagttctcttctagtcctagtttgcttagtgtttttatcataaaagagtgttggattttgtcaaatgctttttctgtgtgtattgagatgatcatgtgtgttttgtcctctgttctgttgattgttgtgtattatattaattgattttcagatgttaaagcaaccttgcattcctgggatagatcctgtttgtttgtggtgtataatcctttttatgtgttgctggatttggtttactagtattctgttgaggatttttgcatctatattcaataaaagatgctggtctgtagtttttttttcccccttgtgattcctttgtttggttttggcaccagagtaatattggcatgatggagtgagttggaaagtgcttcttccctcggtattttttggaaaagtttacaagcaattggtattaattctttaaatgtttggtagaattcatcagtctggtccaggtcttttctttggaggaagttttaaatttaccagtttaatctctgcctgttttagattcattcagattttctgtttcctcttgagttggtttcagtagtttgtgtctttcttggaattgatctattttatcgaaattgtctaatttgttagcttacagttacttatagtattttttcttattttttaatggcattaataagccctactgtgccttttacacagggttgatttgaggatcaagttaggtaatgtttatggaagtgctttgaaggctatataagtatgaagtattttatttgttctaaatttttaattataggaaaacagttgttctagaacaaattttcattaaatttctttgcatttttcacactcaatgtcaagagtagcccactgttagcactgttgcaatttttttttttctttttgggatggaatttcgctcttgtcacccaggctgagttcagtggcgccatcttggctcactgcaaccctccgcctcccgggttcaagcaattatcctgcctcagcctcccaagtagctgggattacaggcacctgccaccatgcctggctaattttttgtatttttagtagagatggggttttgccatgttggccagcctggtctcaaactcctgacctcaggtgatccaccaacctcggcctcccaaagtgctgggattacaggcgtgagccactgtgcccggcctgttgcaattttttatttttcagatgggttctcactctttttcccagcctggagtgcagtggcactatcacagctcactgcaacctcaacctcctaggcttaagcgatcctcctgcctcagcctcctgagtagctaggactgcaggcaaacaccactgtactcagctaatttttaatttttttgtagaatcagggtctccctgtgttgtccaggctggtctcaaactcctgggcccaagtgatcccccctacttagcctcccaactgtctacagtttatgaagttaacatttgtgatttgctcctcttttgtgagttgcacttgaggggagagattattgcccttgttaccaaaggaatatgaactaagattgagttgaaagggcaattaaagtgatttttggacctatttccctatttcttgagagatagcagaacatagatcctatagtatcaggctcaaagggcatcagtgccccattagaaagtcatctttgggctctgacccatttgttcctggctagcattgagagcagctgtttcctttcctccctgaggaatcactgagcgtggtctattctttggcttcctaacctctctcatagcacataccttagatgaattatctgcattcccacctcttcccagcttacttctaagtcaataataaaggtcctttaaaaacacaaatcagttggctttcaaaaataaagcatcattttttctagagctttcttcttttgctgaatacgaaaacaaatgtaaaaaggaagtaactcattgagaaagggaagctggtgacacaggaaatgactcctttaaaagcagaagtccagctgcagggttttctgtgcaaatgtgttgtgggccttgaggtggcagtcctatgaggcggtggtagggctttcccctgattcagtactcagctggtcccaaggggctttgagtgtggcttttgcctccttaactggatgctgaataggctccttgcacttattttgggactccgttgtgcctgtgcccagcacagggtgtgctgctggtggtaaggacctgtgcttggttggttggttgcttggttggttggttggttggttggtgatctgagaagataactctgtggttcaattttagggcttcaggtcctggcaaaactgccagtttaaatgaattacagagtgccgacattgaacatctggtttggatctttattagaatttcttaatactatggcttacagtcaattgcttttatatgtttgtaaaatttcaccattagtgctgagccttccaaatttgtggcatcctttgtgtgtcttatgtggcccttagtggcagagatgcacacttggggcttggattcagcaatctaggccactgccttggtaaccagggcttctattctctagttgtcagaggcttgcttagtataagacatattgcaacctgggcagttgtgtgaagctgtgaggtcacctccactaatgaggacagagtagaggagcgaggggataattctatctgtttgagatacctggccccagtgtggtcgtgtgggttccctgtctgacttctgggtgctcagaagcatggccccgggggtctgtagagacatgccatctgcttccatcctggctccatgcctgcctgctctcagtggtgtgacagtacagagcaatgaccttgactccgtcatgccatcagcaggaaccctggagcccttccctggtttatggtccacttgggttttctcaggttcatcctgtgaatgaagagaaattggatgaacgaagatagctctagaattaattgagggggggctctctagcatgattgagtcatggtctgcctgtgtgtgtgtgtatgtgtgtgtgtgtgagagagagagaaagagagagagggagagagagagaaaataaattccatccctctgtcttgggaggagaaagagggatggggctggctaggttgaggatggggtcctgtgatgaaatggaagcagaggagaagtgggtagaaggggacttggttttgggtaagaagatatttttgtgcttgctaagaaggattctaggcctgtttcttactgctcagtagactgtgttcatgtatcagtggctaacctgtacttgtggaatatgcggttctcttctataccagttctctgattctccagccccagctgggttttcaaaaactcagttctattctgatacttacttcctcgagttagcctcagactccacaggcttaagggctcaatctcacaaaactgctctcgcttcagatgctaattgcaagtcccagatcccagtcatctgcacttgtgtctgacttggctacaaattttggagttttcataccctcatccaggtttgataattcattagaataactccgagaattcaggaaaatgctaaagtttactggtttgttataaaggatacaactcagaaatagccacatggaagagctgggtgtaaggagtgtgcagagcttccatgccctctctgggaatgccattctccatgcacatctaagcgtttgccagcccacaagctctctgaagctcatacttccgagagtttttataacttggtcttcagcccccttcccttccccagagatggaggtggagagggctgaaaattcccatcttctaatcatgcatttggtctttctggtcgtcagcccccatcctgaagccacttggatatgagatattgtttatgtgttttgaggtcagaaagagagccagcgtgtgtatgtgagaatacaggagacttgtccaaattctggcagctttctcaattatatgtcagctgtctagaaacccgtaaaaagggctgtctatctaaaggagaggaagtggtggacgaatctgaaaggagctcttagacaatgttttgccatacagttaaaatctgggagggaaaagtcaagcatagctgagaataatgccaaatctgaagtgttaatgcacattgttttccaagtggttgctgttttatctcttcttaaatgagattctacatgtaaaagcagctaaccagttgattctcagtatgttagctgaatacatttctctgaagtttcaaaaatattttgtgataacatttcccctcttctaagactttcaagttttttcatagatttgaattttaacccagtatattttcaacataacagggtacaaactagaatattaagctgtttccctcaatccttaaaattttgcattccataccttttcttttaaaaatacagagagggagagaactctttttactgcaaatagtctttatcctgaataagcataaaaagcatctactgtttaagatcacccgtgggcgattcacacaaccttttagatttagggaaggctgactattgaaaggaagagtttcattaacagcaacaaatgggccagaagtggaaattttggtctatttgtggatttcctctgtgtttgcttttaattcatctactgatctaatctctgtctgtattcaccaagccgccaggcaatgctgtgcttgtcagaatcaaactcatcaaactccttctagagagagagcctttcagtgccctggaagaaggtttttagggaacacaggatttctgtaaaaatggaaaggcacatgaaggtaggttagttacataacagtgctttcagatgaaaagcaaggcctgacagctgtggcccaaactcttcattatgggagattgggacctggagcctactgaggatctgggtatgtaacttcttataaaagtgacttgtggtgtgatacttgaagtttaggttctttcctttcctttttcttttcatttcccagggacttgctctgttgtccaggctggagtgcagtggtgtgatcatagattaccgcagcctccaacttctggactcaagtggtcctcccatctcagcctcctgaatagctggaactacaagcatgtgccaccacacttggctaatttacttttattttttgtagagatggggtttcaccatgtttcccaggttgatcttgaactcctgggctcaaggaacaccccctactttggcctcccaaagtgttgggattacaggcgtgagctgctggtcctggcctagtgttttagggcagcactaggtatatggggttagctggtactgagacacttgctgatagtgtaaatgcaaatagaatcttacccaaacataccttttcaagttatgtggttagtttgtttttctctttttttttattctcagggctccccaaactggtttaagtaaatgagcattcttctcccacccaccgcctctgcttgtttggaccttctcttggtgactgaagatgccagactgagatatggggtctgcagtgacttggtatagggctgggcaagtttatttacctggcacctgccccgagctggccaagaaatgactgggccgggggtgtattttcagtggagttccttcagccctctgcccagcctggggactgagcggggtggtgtttgttttccttctgcattccaccatgacagggccatgcgttttacaatgtagcagataaggctccctatcactgatgctaactttgcataaatctcttgattcccagctgcttgactgatgtaggaacacaagtaccagtgagaggagcatgtgggggtgaagccatctcatacagtactacccttcctaggtgtagagtgaggagatgtgccacggctgttgacccttcttaaactgcagagcgtttgatgtccagggacagttgttggggcagggtcagacttagagcttttgtcttgtgctgagatgtgctcctttttctttcctcccccttccctagctcttggacggctttgccccatcactgattggtgcacacccccttttgagaatctcagggactcagtttggtaaaagcagctggtggagatgatggagagaggaggaagactcttaaaggagtgggtatatgtggaagaatgagggaaaggccctgtccttgtgttatggagattagggtagaaatagaaagctaggagagagtttggcaaaaggtgattctcatagactcctttctttgggggctgtgggactgatggtgaaggagtctgggtaacaggaaaaaaaagaaccccaagaggtggatgagtgtgggacctacagaaggaggggaaaagggcttctcagctcctgacagctgagtgttggtagcgctttacttcccttccctttaacccttaggttttctggaagctgtagggaaagaacacatagccctggatattctggctctgggatcctatgaaggagaatggtagtaaatgtttaggagtccatgacaaaaagagtgggagagaaattatgtaactgtaaaaaaactttaaaaaactaggatccgcttccaacactacatacaaaagtagaacttctatttccattgcccagataaaggactatcaagattttgccatacttgcttccaccatcctctttttctttttttcttttttttcattttgttacttaggtatttttaaaagcaaattccagatatcatgtcatgataccacctatgatcatgtcattatacctgtgatgtaattatcaataatattactcttttaatttaaaaatatatttaaaattcaggttttatcttacattagattcatattttttaggtaaacttttttttaaataaacttctggctgggtgcagtggctgacacctgtagtcttagcattttgggaagctaaggcagaaagatcagttgaggccaggagtttgagaccagcgtggacaacataataagaccccatttctacaaattcttttttttaattagctgggcacactggctgtatgcctgttgtctcagtttctcaggagggtgaggcaggaggattgtctgagcataggaggttgaggctgcagtgacctacgagtgctccgttgtactctagcctgggtgacagagcaagaccctgtctccaaaaaataaataaatatttaaaatttaaaattaggatttaaaatatgttaaagctcaaagatgaaagtgtagaatggatatcacttattattatgtagtattcagtgtgaattacgatgatcacatctatatccatggctctggtgatgtcaaatattattcccagcccagatttcttctctgaacatacttctacttattcaacatctctgcttcaaaatcccaaaacaggccaggcatggtggctcacacctgtaatactatccctctgggagactgaagtaggaggatgatgtgggcccaggagtttgagactagcctaggcaacgtagtgcgaccccgccatctgtacatacaaattaaaaactagctgggtgtggtggtgtgcctgtagtcccagctacttgggaggctgaggagggaggaaaagttgagcccaggaggtcgagattggagtgagccgggatcacgctacagtattcaagcctgggtgacagagtgagaccctgtctctaaaataaataaagtataacaatgtatttaagctatgtttaaaatttttttgaaatgaaatatggaatgattaaaaaaaaaaaaacctgaaacagatctcaacatgtccaaggctaaacccatggccccactccaacagtccccaagcattcactagtatttcctgaatctcactgaatggcactagtcttctagtttcaaaggctaaaacttacaaatcatctttgctacctcctcctacttcagtcctgtatccagcttatcacccagccttatcagtctcacctcatttcctctctagagcataacttctcctcctgttgtgggaagtcagggaccctgaacggagggactggaagaacataaatcgtgaagatttcatggatatttatcagttcccaaaattaatacttttataatttcttatgcctgtctttactgcaatctctgaacataaattgtgaagatttcatggacatttatcagttcccaaataatactcttataatttcttatgcctgtcttactttaatctcttaatcctgttatcttcgtaagctgaggatgtatatcacgtcaggaccactattgtacaaattgattgtgaagcatgtgtgtttaaacaatatgaaatcagtgcaccttgaaaaagaacagaataacagcgattttccgggaacaagggaagacaaccataaggtctgactgcctgtggggtcgggcagaatagagccatatttttcttcttgcagagagcctataaacggacatgcaagtaggagagagattgctgaattcttttcccagcaaggaatattaataattaataccctggggaaagaatgcattcctggggggaggtctataaatggccgctctgggagtctctgtcttatgcggttgagataaggactgaaatacgctgtggtctcctgcagtaccctcaggcttactaggattgggaaattccagcctggtaaattttggtcagaccggttctctgctctcgaaccctgttttctgttaagatgtttatcaagacaatatgtgcatagctgaacatagactctcatcagtaattctaattttgccgtttgccttgtgatctttgctttgccccttgccttgtgatctttattggcctcagaagcatgtgatctttgtgacctactccctgttcgtacaccccctccccttttgaaatccttaataaaaacatgctggttttgcagctcaggggacatcatggacctaccgatatgtgatgtcacccccggcggcggcccagctgtaaaattcctctctttatactctttttatatctcagactggccgacacttaggaaaaatagaaagaacctacgttgaaatattgggggtggattcccccaatacttcctattcattagcatcacccttgtcaaagcccctagaataaaatactagcagtttcacatgttccatttttacactctttaatccttttccacattgcaactggggtctgttcaaaatataaacctgagtatattctctgctgcttaaaaactcatggcttcctgttgctcttagaatagaaccagattcttgacaaggcctgcaaggctctgtgagcatggtgcctttctatttcccatcctcatttttccccttcattctttcagtattatttaatcaatatctctctttcctgctagtctctaaactgcatgagaacagagccctcctcttttttgcttgctgttacgtccccagtgccaagcacagagcccagtacataaaaatacttaggtatttgttgaatgactgagtgaacatgtgagtgaaatggaggggtgaaccattcctgatggatagggagctggcttctctttgcactcattgcatgattgtttgttttctcttatattgagttgaaatccactttcctcttaatagttgtgcatatgatccaaattttttccctttacctcaaacgcccttaaaatttttgtagactctatcatgtttcttagttttctagactaaatatcttagactaattgtttacagatacaccaccttgatccacattcctctaaggacgtccatttttgttcacaatttttttaagatgaggagctcagaactgaattcagaatctaactgaattcacaatctcagatgttatgtgatcaaggagactacaagaaactgttatggccatgaagagatgaatttaacatatggtttagcacccaggccttagagtttcgacagatttggtaaaatctgtcattagtggtaaagactgatgtcttggttcaataagatagtcccggtgagctcttagtagcccattgcctagtccatccaaaccctcagtgcattttactcaatcctgttgtcattgatgtttctgtttatctgttaataggatctgagattgcatatgctttgtgctcagttatgccaccatgggttgtattgagttgcaatcacatgttaactccaatcacatgttagaaaatgttgactggttgctcaggtaggtctctcatcctgtacttatatgcaggttttctcttcacctctgggctccttgaagacattgcataggacatggttgtaatgcccatcctttcatatcagaagggtttatgtgtttgtctctcgttaggtgacatcagttgatctcagaatcttgggacttgagttctctgtgcactttagtttgaatacatttggtctcggcagaaatccactcacactagctcaaatatgtatacatcattgagaaaggggcgtttcatagaaattaagctggggcagtgtaggtaggcctttgtgggcattgaaaagtcctcaggtacctccattctctatcacttgtccactgggataggatggtcttctgtctttattttatcctgacctcagcctcctacagatctacttactgtcttaattcagattcttgagagagagaatctgttatttgtgtcacttggataatcaaatagaacttatttaggaaaagactaagtagaacaagggtctactgcagtatatctgatgtgatattaatattctgtaggtccagaggagccattggacatcaacagcttaaatgttagggatgcaaatgggtactgagttcccaggcacagtctgatagtttcagggtcagaattttatgcagtgatcagatttgaatgtttggaagttaaaaatacagtcattcaccatataatgatgttttgatcaacgactgactgcatatatgatgtgatcatgtaagattataataccatatttttactgtaccttttctgtgtttagatacacaaatacttagcattgtgttaccattgcctacagtattcagtacggtaacatgctgttcaggtttgtagcctaggagcaataggctataccataggtatgtagtaaatataccatctaggtttgtgtcaggtacactctataatgatcacacagtgacccgcacaatgatgaaatcacctaatgacagatttctcagaatccgttgttaagcaacacataactgtattccctattccacagaacagggtttaaataatcagactgtttcaaaaataaatggaaaacctctcatgtctggcctagaatcacctctctatagacagaagtactaaaagaaccaaataaaaaatccattggaaaacaaacccacagcaaatgaaaggaggtagttcttgtcctaacatttaatataggctaattagtttatgggtaaatacagtttataaattgtacacaagaaaatacacatgtaataccaatattttagaagtagaatttttatttttagcaaatccatcatgatttacttaggtaacaagttcttccagtatatcagtttgatttatagtaaaatgtagtgtaaaatagttttctagatggagaaacagtggctccggaccatttcttgcttgtcagcatatggaaagggtggctctcccaccatgccacaccatccactcctgctgggcgcaccaggataaagatgttaaaatacaacctcttgtatagggttttcaagatctgttacttagagtgggatcatctgtggtacaactgagagatgctgaagttctccttaaaaggtcacgtgtattaagttcctagaacgcctgttcatctccacttatttccatatcaccatttttagagatgcacttcccactttaaccatagttttcaaaatcttaaggcagtggaaccttttcctcaaaaaacaaaaattatgtggactctaacatataatagattttttgtttgtttgtttttttttgagacagagtttcactcttgttgcccagactggagtgcagtggtgcgatctcggctcactgcaacctctgcctcccaggttcaagcgattctcctgtttcagcctcccaagaaactgagattacaggcatgcgccaccatgcccagctaattttgtatttttagtagagatggggtttcaccatgttggccaggctggtttcgaacccctgaccacaggtgatctgcccgcctcggcctcccaaagtgctgggattacaggtgtgagtcaccgtgcccggcaatgtataatagattttaaggtgatatatattatagttgtaaagattaaaaacattagttttaaaaacagtgggatttgtgagattgaaacatgcaaaataactaaatcagagtctaattaaaaactaagccggatgtggtggcatgcacctgtaatcccagctactcaggaggctgaggcgggaggatgacttgagcccaggagttcaagatcagcctaggcaacgtagtgagaccatgtttaaaaaaaaaaaaaaaaaagaataaaatttatttcagtagtgtttggattacatgttattgaaagaaccttgatttatgcaggtcagtagttgcagataagtttttaaataattcagcttagtacctgagagcgtgccttaattaaactattccaaaagtctgtaagaggagcagaggggaatttgtgtttcagatttgagttattaacaatatctaacaattcatccaatttattaattttatagatgtaaattttagaaatagtacataaagtggttcctcatgagtttaaatctttttggtagaaaatacaaaactaagatatttagaagtatcattttaaaaaaatctcagataatttagtgctgtgtctgttaaatagtcactgttaaaaggcacatttcctgttctggatgttctcagattctccagcaccaactgggtttccaaaaattcagttcatttcttaaactatctgtccttagtgcagaccccacaagttaaggtctcagtcccacgagactgccgccacttcagataccagtcacaagtctcagtgcttctgagcaactggctataaatttggggattctcataactcctcttctcagtttcagtaatttgctagaacaactcacagaactcaggaaaatacttatatttactggcttattgtgaaggatacaactcaggaactgtcaaatgcaagggatacatagggcaaggtatccccatacctgcaggggtgcagagcttccactccctctgggcacaccaccctcccagtaagtcaacatgttcaccaacctggaagctccctgtccctgtcatttaggggtatttatagaggtttcatcatgtaggtgtgattgattaaattattggccttggtgattgagctcattttccaccctttctcccctccctggaaggagtggggacggtgctgaaagttgcaaccctctaatcttggcttggtctttctggtgaccagcccattcccgcagctgtcaagggacccccagcacccagtcattcattaacacacaaaagacactctgaccagtcaggaggttccaggggttgtaggagctctgtgccaggaactgaggacaaagacaaaatacgtatttttattataccacctgtgttgaatctaaaaagctgacaataagcaccaaaacttaaaaggagtgataactatctaaaccttgatataatcaagactcattgttgtacaactggcctgtcttttaactgagccagttgtacatggaaacacatggatatttgcagccttagggtgctgatggcttgtttttagttgtctgcctccgcatcatcagcacaaagaaacaataacacatttataacagttcacatacatggacagagataatagactctgtacacataagtgaaattgtcagtacagtttaaaatgttcttgttaaaattttgtgtgtattgcagttgagtttttaaactttttatttatgaaaagtttcacaactgtatgacagagaaaatagtacaatgaaaactcccatatacctattcctggacaacagttaccaagattttgccatacttactatctcttttttaaaaaatccttttgaaatatgttaaaccaaattctgattatgaagcactgagacgttttaacacattttagtattaataatagttaaacatatatttaaaagaaaaattttaattggacatttgtagaatatctgaagtatgtttgtgaagtataatttgtaaaccagtacccaataataatcatagaagattcatgagaaaggtgtgtgaatgctttaaaaaagctattccaaatcccagctacttgggcagctgagatgggagaattgcttgagccccagagtttgaggctgcagtgagctgtgatcacaccactgcactccagcctgggcaacagagtgagagacccctaaaaaaaaaaaaaaaaaaaaaaaaaaacaggctggacgcagtggcttatacctgtgaccccagtgctttgggagaccaaggcaggcagattgcttgagcccagtgagaccagcctgggcaacttggctgtcctgtctctacataaaaaataaattaaaataaaaattagccaagcttagtggctcatgactgtggtcccggttacttgggaggctgaggtgggaggatcacttgagcctggggaagtcaaggctgcagtgagccatgatcaggccactgcactccagcctgggtaacagagacactgtgtcaagaaaaacaaaaataaaaactatagctatgatattccagtggtacttgactctgatcctggattaggattaggaagtaggattagagggtcatcttttaatttcctttaaaatcatgagatattataaccaattcactgagtttttctgtgctactcttgtttcagatatctacgttaggaaatcactttttgctttaacgaaattacctcattcacaccttcctaatatttgcagcacttatcctagtaagaccacaattaaaaaggatttttatttttcacaagtgatttagagaattcctggtccgacttagagacagaggttctaaagaaaaaataactttattgttttacaatttgtgtcttagtaaaataagggctatttgttttaaagccatttccatatctggtttttcaaattagctttcttatttggttcttttagtttttaggtctacagagagatgattctgagctggtcacagtagattttttaaatttatttttgaaacagtctttttaaattctgttctgtggatacatggctttttttttttcttcttttttttttctttgagacagagtctaggctggaatgcagtggcgcaatctcggctcactgcagcctccatctcccgggttcaagtgattctcctgcctcagcctcctgagtgactgggactacaggcgtgtgccaccatgtctagctaatttttgtatttttagtagagatggggtttcaccatgttggccaggatggtctcaatctcttgacctcatgatgtgcccgtcttggcctcccaagatacttatgtttttaacattcaaagattcagatctgttcactgcataaagttctgaccctgaagctgtcaggctgtgcttaggaactgtctcagcaccaatctgcctccctgcaccatagctgttggtttctaaatactcctccagaccagttttaccctacagaatgttaacatcacataataatacattgcagcagactcttgctctatttatcctttttctaaatagctcttttggtgtacttactattcgtatcacttggataatgcacatacacaacttgggataggaaaattcattttagggtgttgtgccagctcttctctttcaggctgtgctgccatccttcctgaactttagagatgcttaataaaagcaaagagggaagaacttgctatttgtttatatgaattcaggtaagagaggatacttaccagtgacagataattctttaatagatggtttttgtgtttcattttagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgtgagtgacagtgggcgctgggtgtcgtgctctgtgtcttgtctgttgagtttggcagccagctacttttggctttggtgaactgaatttacctttgaggtgcaccgaggttcatacaaagcttataatgttatcctgcagtcttcactgtttggcttaactgttgtgtggaatcagaaataccagaggtttccttttcagattgttgtcttttttctgaatccttagcttaatcagctaagctcttttcccttgaccctagagacttttttatgtttaaaaaaaatagaccagtcacggtggctcacacctgtaatcccagcactttgggaggccgaggcaggtggatcacttgaggtccagagtttgagaccagtctgaccaacatggtgaaacctgtctctactaaaaatgcaaaaattagctgggcgtggtggtgcacacctgtagtcccagccacccgggaggctgagacatgagaattgcttgaacccaggaggcagaggttgcagtgagccgagatcacgccgctgctctccagcctgggtgacagcaagactccatctcaaaaaaaaaaaaagaatggcatgagatagacaggtagagatttgatggttttcagaaatcctggctggactgttaggagtcgtgttatagacaattcaaatgtcactgctggccaccgtcttcatactctatggataaaacagaaattccagtcctgtaacttacctctgtagcgtcaataacgtgggaaatgatccaaaagggtcttgtagaaagaagactttttacataaacagaaagctgtgatttttgtgggaaacaaacctaccactaaaattgatgagaattcttgtctccatgtgtaatttctggctcatcagccaggaggtaaaatttcaataagaatcaagaatattttaaatgatcagttaaaactgagtaaattagttggtttagtcaatcccccatctctcctgggaaattatctgacttttgcaaggtccttggtgttttcagtgtaattacctaaggtcctattccatatcaagtttcagtttaactttgctacaggattactttatcacaaaacttgagtagatgataatacaatcatacatcacttagccacagggtaagccacagggaaatgcatccttaggtgattttgttgtgtgaacatcgtcaagtgaacttactcaaacctaggtggtgaaacctactacacacctaggctatatggtacagcctgttactcctaggctacaaccctgtacagcacattattgtactgaataggtgctaggtgtggtggcttacacctgtaatcccaacactttgggaggccaaggtgggaggatcccttgaggccaggagttcaagaccagcctgggcaacatagtgagacacccccccacacacaccgattccctgtctcttaaaaaaattttttttaattagctgggagtggtggtgcatgcctgtagacccagctactcaggaggttgaggcaggaggattgcttgagcccaggaggttgaggttgctgtgagccatgattatgccattgtactccagcctggctggcagagcaagaccctgtctttaaaaaaaaaaaaaaaaaaaaactactataggcagtgtaacacaatggtaagtatttgtgtatctaaacatatctaagcatagaaaaggtacagtaaaaatatagtataaaagataaaaaataatacacctgtatagggcccttaccatgaatggagcttgcagaactggaagttgctctgagtgagtcagtgagtggtgagtgaatgagaaggccttggacattactgtacactactgtagcttctataaacacggtacacttcagctatgctaaatttatttaagtttttttccttcaataatagattaagtttagcttactgtaacttttactttatcaacttttaaattttttaagaagttttgactcttgtaataaaacttagcttaaaacacaaacacatggtacagctatacaaaaatattttctttatatacctattccataagttttctttgtgtaaaattatttatttgtttactttttaaaatttttgttaaaaactaagacacagacacacacattacctaggcctacccattacctaggcctactcaggatcgtcaggacatcactagacaatagtttttcagttccattataaccctacgggaccaccatcgtatgcatgactgaaatgtcattacatggcacctgactgtatatccttttgtggccctaaaaagggccacattttactaaaaagtttgagtaaaatgtagatataaagaaggaccaatgagatgcaggatgaaatatgggagtatgagaagcactgtgtttgtacttgtcactgtagatcagttggggaaatgcttctcagcattgctatgacttaaagaaaaactccagatatcatggtgacttacagcagaaaggaagacgcccagaggtttaaagagcagaaggatcaacttcagtaccaagaaagtagagagatataggaaccagttcctcagcagccccggaatggctaaggggagtgaaatgtcattagtagctctcgatctgttctttgattatatataagcagttaaatggttgttggaaaatattattgattgggtgccctcttttgtggcttttaaggttggttactcctctctagacagcacttagggtatgtactgggcacgtcactgcctaggtacttcctcccctaaatgtgggatgcttctgcatactgaagttgataaggagtcatttgtgagtctttgagttgcatgcaaccaatgcattaaataagatgaaatctgggccaaagaaagggtaatttattctacactttatattcggcagcaagaagcaccgtctctcgagtcctgccaccctcacccagtagcctttttcccctattctgtttttgttgaatgaacttcttgatctaatacacttaatagggctttttttaaggccttatgcaatcaaaaatcttgtcgtcttgttctttttagaagaaaggagtgctagacctcttggaagtttatttttcatctgtaaatttgaatttgtggcatttctgagtgtttctaccagtctcctttgtagttgaggtctgttcatcattcactcactggtgataacattcatgaatacgacatttttaatttgtatctcacctcatagaaagaattgtgcagcttttacatctgccagactagagttgaatattccagtctttacatgatttttttctccatctgtctgtctctttcctgtctctaattttgttggtgcatcaggactactgaacaagtgaaatttctctgttttctgttgtaagtactcctgctgtttctttagtccctgggaccgttggcagtttcctctctcccctcccccagccatctctccatagcatgtttgcttctaattctgagtttgatcttctgatgatttttttgcatttcatcagtcacttcatgagtcagcttagccttgcagttgtccatacctaagggagtggggcttggcctttacaccttaggtgctagagcttgcactccctggcttggcaggtgtcacgtggcgctttgacaataccaaaagctggcttggccccaagatcatcacagcagtggtttgagggactgttctgctatttaatattggaaatcattggcttttttggtagcataaagctactggcttggaacagttaataaattttactgagtcagctcaacttgagtttggtggcagagggtagcactcagtaagaagattagggaaagaagatcatgaactagtgattatgcacattccggtaacttatgtgcttgtctttgtattttttctcacaaaagaaaaaaagttgcaaataattttttctctttttttggtcacagtggtgtttttcctggaaattctaagtttattagaacagaatctgaattagtcctgtgatcacaagttgtgtgctaatctacaaataacagatggttcaagcttccccagtttcaggctttgtgcagcgtgtgacattcatcttccatcttactacttaataggaatggtaacagtttactcacatatttttacttttatactttttattgatgacagttcttctctgtgagcacacaagtctaactggaactgttttatgagacgtctatggcttttagtgcaataaagaatttttaaagaatttggtccagcgtgatgatttttctaatgaatgtcaaagccaagcgagtgaggctcagaggaactgaatgtctccagctgctaaggctctactgtctgcaaagcttttggtggcgtgtaattaaaaaccatagacatcagagtgctactgtttgacaactcatagaagcaagctgagggggtcttttcagagaatgagccccgcttgtaggtctttgcttaccccgtctctctggagaaaactcagaggcataaaaggtgtccctgcctctctcctgcggcgatgtatgatttgtgtggtgctgtatgctttggcttctatccgcacacactgctgtctgctccatttcataccttgacaattgtcagtgtgattgcaaactggcttgtttgtgtttcttctctttccaggagtggctgtaaggtgaagaagcatgaaactcagtctctcgccctggatgcatgttctcgggtgagtctgtgcccatctccagaatgtctctgagaccaggggtcctccagtgggagtttgcatccccctggcgggtggttcaaaaggactttccaatgggtacctgagtactcagctttaagaagccaatttccagatccttactgtccctgaagagaaggcccctgaagacaagggaaccctttcacaatgactcttttttttttttggtaaaattcccactttaaatgctacaaagatgcatcaccacagggtgtgaaagtctccagggcaccgaagggaagatctgaaatactggtgtaggttctaataagataattgactctaataactggatggtatttttcttaagtcagatggttttctaattcattgctttcaacaatagaggaaaacctgagttgtcagctgataggtctaaaaataatgtttgatggtagatttttttgggcacataacttggaaaggggttcaaagaattgaaaggcacttatgttacagaactactttctgtttcatctattgtttatataaataaggtttcttaatgattatattgataaaaatagaaaccaggaataaaattgatgttgacctttgttacattctagcaataaataatatccatccatgaccgtataaactaattgcaaaacaaagcgaagcccaggcccatctgattgcaatgagatccttttgttctttttaaaactttctcagtatacttattacagaaatacattcattggttaatagagttcaatttaacataacttttcctctacaatttggatcagaaacttggtatatggtgtaagatgtaaaaaaggggtgtgatgggggaaatttgcaatctgagttatttttcatctgttaacaaatgtgtaacattctccctcagattttgctaaagtaggcagcaagaactatgagaaatttatctttggttttctttaaaaaacaaaaacaaaaacccaaaacccatatatttagtgcactgtaaaagtttttaagaattagtgcaataaaacattttgtaattgatataacaacttacttttgtgtctgataatacttatcaaaacttgcaatattttgaaaataagttgtgcattaataaatgtgataagtctccagcagaaaaaattttaagacttaaagaaaaaagtttcacagagacattggatagagacttttaaaaagactttcaaccatgcagatgtttttcatttggatagtttcttgatggaagtgggatggaaatacagatttagagaggaaaaggaataacataaatttctgacttattcaggaacttgttcatttaaatttacatatggtatcaaatcactaaggtaactagatagcattaagtaaattcaatatttagaatattccagatattacattctttgcaattatttaaacttatgccaaaaagtttttagatgtcacttgaaaatgcaatgggggacatagattttcaaaaaaaaattaggtatatgagcaaaaaaattgaaaaccattgtcttaaaccactgaaactgcttgcttataaacttaacctagagaagatcattttttaaaacctcagactcaagttacagaaactaggttctataaaacagcatctcacaattgaaagactccaacttcctccttgctttgtacccaggtctgtggttaacctctcacatatctgtatggagttgtgtctactttgttccattcatgggatgtcacttttccccattgcttgccctcctaaagggtagcatcttctctgttgtgtttctcaggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcccgtgtctaccataaatcatgcgttttcatcctcagaagcaggtatggaagcatatcttcatctttctaatgtacataagcatggaaatgcctgaaagcctaataaagcaggaggagccttacagagattaaagaattgggtcacttgaaggatagatttaggatgctgacctatgctttgcttctttacctggaaaagggacacaaagtgcttattgaagtactaggaacgtagagatacttgtgacaagttgtataggagatgctgatgtatgtgagactgcttgaatttctttataattttatgtgaatatggccatatcttaaagtatagtggtgtgttagttcatttgcgttgctgtaaaggaatacctgagaatggctaatttataggaaaaagaggtttatttggttcatggttctgcagactgtagaataagcatggcaccagtgcctgcttctggtgagggactcaggaagcttccaatcatggtggaaggcaagggggagcaagtgtgtcacatggcgagaggtgggaggaagagggggcggggaggatgccaggctatttttaacaaagatttcacagaaactaacagcaagaagtcgctcattaccacaaggagggcaccaagctattcatgagggatccgctcctatgacccagccacctcccattaggcctcacttccaactgttgatcaggtttcaacatgagatttagggggcaaatatttaaactatatcaaatggcctataaatatgtcatatgtttgacttttttgtgattgttatactcattgtttaacttagagaaataacaactgacatgtatggtgccttaccatgtacaggcattgttttaagtgctttgcatatactcattcatagcaaggtgttacccttttctcacttcttcagagaaacaaagtaagtcaaagaagttaagtgacttgattaaagtcacttggctagggtaggacagaaaagtggtatctttttcctcaccacaaggttcatggctgagacatctctaacaaaagatcaacaagagaaaagtgtacaaatatatttaatataagttttacatgacattagagcctccagaaatgaagacccaaaggaacagggaaaactgtacttttatagatagttgtgcagaagtataattggaggacagaagggtgtgatctatggtaataaaccaggggaacttagcaagtcctgtttgttccaattcctcttggtgtctgtgtctttcaggataaggacattgtttttctctgtgtacagggaggacccctcttgtaatgaggtcttatgaactattttcaggggaaggtctgaggggttgctttatggcctgcttcaggaaagggggcaggagaggggccgagagacctccctgcttctgctgtgtcctcaaatgcgaaggcaccatattttggtgaagtgtgttctgaacctcatcattagtaaatggtagaactacatttgactctaagcagtctggttccatggtcttttcgccacaatgccaaagtatgaagagattattttcatgatactaggctactgtaaattttcctggtacagatgtggtaagttgagattgaccagtgcactgtaaaatctttcttaacatgccaatgaggaacctgggctaaccagggtggaagcctcttattgatggactcatcagatcattctagagctaagcccctctttcttgggaccccagttacatccttggccttaaactttacttatgaaaagtttagaaccatgttcctgactacattaaacattattaaaaactcagatcttcttaacataattttattcatgggcttttatgtatagaattttaaaagtcatgatctgccattaagccagggaagcagatggaaagtcaggacttggagcaatttattccccctggcctccttctcatcccaggcctcagtctctcatctataaaataatatgccaggcattgttcctgatttcttccaatactgtcttctgccctgacatctttcccaaagatattgttcaccattcccccagtttcttggggttaatcctgagtattcttaacacctgccttggtttttttccatctgaagtgtcttcctttgctgcctcttacacagatctgcacatcccttcaggtctctccagcatgcttttgctcccacatttcctttcccccttcctgttccacagtacctagcgcagtgtgttaattacaggaaggtaatattataaacttactgaggttagagactaccactcatctttgagtcacctttgacacagtacatggtaaacatttattgaattatattcttcctcactagaggaaattccttcaacaaaaatttatgtagagagctggggccctgtacatacagtgctgtcttcaaagttagcaaacagcaaggggaacatatttaaacaagtggttacattgtaactgatcagccgcatcacaagcaagtggaggctgcggtcctgggtgtgggaatggctacaggccctgttaggtgaatcctgactgtgtcctggtgagtgtccccttgaagctgggtcctgatggatacttactagatgttctccaggaaatgagattttcacacagccatgggaagaaagctgccacgttggtaaaaggcctggttgctttctgtaagtatctggccaagtgggaaacaaggtcataccgtggaatctgggcttgatcctataggtagggagggggaggttgaaggtttttgaataagggagtgatggtcacatttgtgttttaaataattagctattgacaacaatagtagttagtgattgccatgtggaggattgtaactttaaacttttgtatgcttttctgtatttttatgtttactttaatgagtgcatcttctggttattttattttttatttttcttatttttgagactgagtttcgctcttgttgcccaggctggagtgtggtggcgctatctcaactcactgcaacctccagctcccgggttcaagcgattctcctgcttcagcctcccaagtagctgagattataggcatgcgccaccacgcccagctaatttttgtatttttagtagatgaggcttcgccatgttggctaggctggtctcctgacctcagatgatccacccaccttggcctcccaaagtgctgggattacaggcatgagccactgtgcccagccatcttctggttattttaaatgtcatcctctaccctagtagagtagaggatagacctgagacaaggaagcccatttgaaggggtggaggggagaatgagtttagtttcgctgccttgaattttaaagcttattatcttatctgctgcattaattagatcaaggccacccttctgggctggaatttaaattcactccgacttgatgattaaaaaaaagcattcagtgttacacagtgtcccctttctgaaataatgccacagttagtacgacacatttttccaaacttttaatggacacaagggggcagccttgctgttctttcagcctgaaggctgacgacctgtttgtggctgactaaccatgtgctcctcttctgaatgtcatggacttataacagcactcaacaaaatgccagcgctccttttaaataaaatcttaaaatgcttttcatgtgttcataagtcattctcgcctgcactggggtttccaagagcctttcactagggaggaaaggaaccgacttcttgggataactataaaaatgactttctgtcttaggcatagagaaggagacgtgccagaagatggaagaagacgggtccactgtgcttgtaagttcctgaatgtggagggccgggtggactcaggtttctttcagtatttgttttgaagcccatgtgaatttgttaaattctggtcagtgttaggtgatgaggataaaatgtaaatgagatagtttcttcacttgaggaacacatagtctctgcattgtaaccctagccgcaggtagctgtggagcacttgaactgtagctactcagaaaaagaagaagcataaatgtctcaactttttatattaactacatgttgagatgataatattttggatgtcttgggttaactaaggtttattattatcattattattgttgttattattattattatttgagacagtctcactctgttccccaggctggagtacagtggtgcaatcttggctaactgcaaccttcacctcctgggctcaagtgatccttctaccacagcctcccaagtagctggaactagaggcacgtgccaccgcacccagctagtttttgtattttttgcagaaatggggtcttgccatgttacctaggctggtctcaaactcctgggctcaagcaatctgcccacctccgcctcccaaagtgctgggattacaggcatgagcccctgcacctggctggtttactcagttcttttttttttttttgagacagagtttcactcttgtcacccaggttggagtacagtgacgcaatctcggctcactacaacctccacctactgggttcaagcagttctcctccctcagcctcctcagtagctgggattacaggcatgcgccaccacgcccagctaatttttgtattattagtagagatggggtttcaccatgttggccaagctggtctcaaactcctgacctcaggtgatccacctgccttggcctcctgaagtgctgggattacaggcatgagccactgcgcccagcccatttactcagttcttaaactttaaacttcctaattcccaactgattcatccataaaatgagtagcacccatctgccttatcaaagtggttgtaaggataagatgaaatgacaacgtgaaagatttaagctgtaaagtgctagaatacactagtgtgctagaatacactgttgtgttagaatacactggtgtggtgttgataggaaacacgtggaaaagagagtggaaaggaagagagtgaaaaagaaaaatggcaaacactgtctctgaagccagctggtgaggaacatatcatatgctgtgaccttttaaaagcaactccttttgaacttcccaacataaattaatttctgcttccttagaacattgaataaacattgtataaagaaatttcaccatgcaaaacattgaatgaaaaaatcatctatttaatccatcattcactttttaagtttatctgtgttgctctgaagtccattcttatgtggtcttgtgcccagcagtaggtggtggctggactaaggccagagtacaatcagtggtaggagtcagtctctccttgcttttcagctgttgttccacagcatttttcacgtaagaagttaacttttctttttaagttttaaatgttttaaaaggtgagttcatttggcttttttgggcacgtctctgttagagtacggcaggggctgatactgctctcttgtgattgaggacaaatgagcacagtcagcacactgccacagattagtgatgcgaattctccacagccacgggaatcagtggcatctgtgctcactgtaaatttgcaaccgggagtccattgagttctgttgtctatagactggtctttgttggtcctcaattgtgaatgttttgagggactgggagaagcactggcaaacatgaaataaagcccttttggaaggatatgattgattgatttagcgtcttcattaaagacatattagatggcccaggcctaaaacagatcttctggccaattctctgtgatggtagattctataacaagcttgtccaacttgcttaattttgttgttgttgttctgattggttttgttttaggcttttagcagcctgaagccatagtttttagtttctgtctctagtgataagcggaaaagagggatgaggaaggggctttactgccccaaccagaaacagaaactaagaacccatgactgcattctctcccttggacacccctgtgaaatgttctgcactttttgataagcaacttaaaggactaaggaatgtaaaaagttaaatcctaggagactggaaaagatggctaaagtaggcaagggcatacattcctgccctgacacctgtaagagttgttgcattttgagtagtgaggtttgtaaatgtggccaggcagagaggagagtggctggggagagtcggcaggctgaagagcccactcacctggagacattaaacaccatctaaggtttgatctcctaccgcctgctcaggatgctgcctcttccagaccccacatgtgttagcattgagttgttaagcaggcagactgaattcatttaccctctcaacaaatgaatgagatgctgaactctgtaatggatgttgatgttttcctggctatgaagatttttagggggcgtatttcccatattctcacgaacttggtagccatggaaagcactgagagtctgtttcctaaagttgacttaacctggggactctggcttaaactaagaactcagaagagactgacccatgaaatgttgttaatttagaatcagaagtttaacagtgaggtgaatcaagtctcaacttgacctcctgtattacctccctttaggcaagtaaaagtttcttgataagaaacaaggcacaggaagttagtgagatgattcaaatgtccaggggtgtatcagctatctgctgctgtgtaacacattactccaacacttaaagcaagtgtttattatctcattgtttctgtgcgtcaggaatcttgggcagctttgctgggtgcctctgactcagaatctgttacaggctgtgcaatccaggtgttgatcagggctgcagtcatatccaggcttgacttggggaggatctgcttccaagctcactcatgtggttgttggcaagtctcgggtccccactggctattggcagagacatcggctccttgccacgtgggcctttccctgtagcttctcaaaacatggaagtcagagtttgttcagaacctaacctcagaagtgacatccatgacgtttgccatattctaatgagtcactaggtccagcctacactcaaagggaagagattacagagggaggggattagtactggaggtaggggttactggggggcattttagaggctgcccactgcaagtgccttctggttctagtggtagatttttcccaagagagaaaagagaggttttgtgggtaccttggacttctgttggcatggtgggctgccctcccccaaatgctgctggaacatgggcactgccagcttgtggcttttgtattttgcttttctgtggcctgagacaggtttctattttgggcccatggctgaggtctgtgaagctgcatgctaaaattctgtttctgagcattttctagagagagggtaaaactataatgactctgaaaaatttaaaagccactcatctacgttcaccttggactttctgtttagtgttgattcacacaagatgtaactgattgattataatcagtaactaattgattagttatcccacatttaagattaagattattccaggtcactttggcattttggatgttcccaaagtattagatgactcatttatataaaaagtttacttctggccaggcgcggtggctcacgcctgtaatcccagcactttgggaggccgaggcaggcagattgcaaggtcaggagattgagaccatcctggctaacacggtgaaaccccgtctctactaaaaatacagaaaaattagccgggcgtggtggcgggcacctgtagtcccagctactcgggaggctgaggcaggagaatggcgtgaacccgggaggcggagcttgcagcgagccgagattgcgccactgcactctagcctgggccacagagtgagaccccgtctcaaaaaaaaaaaaaaaagtttacttccgtaggtaggaggaatagccagcaaaaacgtcttttaggaaggaaaatagtacaaagtccatgttctcatgaaaagaaaagtttgccagtgttttgctctggaacctgagcttatgaaagaagctcctcagagcttctgagccagcacctcagagggcgaagtgctgccagaagggagtggaaaacttagtagcaaggaagaaccaacacacaggcatggtccttgacttatgtatggccattttgcatatgggcaacaatggcacacacccagcaggctgggttacagcaggaggtcgctgcggagcagcggaagttcaggatgatcctgaatcatccgggtgaaagggtgggggtgagagttcagagttcaaatatatttgctatttctgccttcttaggcctgaaagttagtattttagaaacatttccatctgcagtggctaaagatacatacaaagcatcaatatgtaacaggagcagctgtcacttgtttttgtttttgcttttttaaaaaagaaattcccatttacatggagcttatccccagaaacttaatcatgggtgtgtttctcttttatccatgtggttctttggtgactgaccgctattataagtacactttctcccttttagatcagaataaaattctctaggttatctgctcaacagaagctaagaccactctgatagtcattataacagtttttctttagttacttccataattagatttgttttttaaaaagcttccccccgctgacttttctttaaacatggttttaaaggatgtgatcaatttagtaatgaggaagttgttgaaggatgtctggggttaagaagctgaaagctgacagattcagtgtaatccctttccccacaggggctgctggagtcctctgcagagaaggcccctgtgtcggtgtcctgtggaggtgagagccccctggatgggatctgcctcagcgaatcagacaagacagccgtgctcaccttaataagagaagaggtaaaagctctcctgtttagtctgcttatcactccatttctttgtaaggcccatgtaccagcaggtagattgcatctctgctggctcaagttatcacaggctggaagttcttattacctgcagcttgtttaggtcgtaaaagggccccctgtggcagtggtgctggagtcctgacattctggtctccagggtaaaatgttgacaatctgaaatattcttaagaattttgtacccttctttatctttcagccctgacatttaaaatacctaattttgccagctttgctcccatgtgtaactaaatcagtgcttttattttacagaggatatatgctaatgcctaaaaacatttgtaatttttttgcagtaatacacagttgtttcctactttcatccattctttaaaccgttcaactctccgattcctgtattgtgtttcttgaacagcctttgttcaaaatagatcactgctaggcctttcctggttatctgaaaaatacgaaagacactgttgtgtaccattaataagttgcccaccctctcctgtcatatatctatgctgtattttgtgtgtttggtttgtgtgtttcttgacaattccacctgttcttaaaggaaggtgtggcaattttatttttatagtttttagttttatagttttttttagttttaatttttatagtatgctgaaagtggttaagcacctcagctgtaggtcttttacagctttctaaaatagcatcaagttggtaatgagggatgtcagctagtcctgttttcaaaacttgggagcagtggtaataaggcccaccaaaatctttttttttttttttttttgagataaaatcttggcgcagtagctcatgcctgtaatcccagtgctttgggaggccaaggcgggcggatcacctgagttcaggaattcgagaccagactgaccaacgtggagaaaccccatctctactaaaaaaaaaaaaaatacaaaattagctgggcgtggtggtgcatgcctgtaatcccagctacttgggaggctgaggtgggagaatcgcttgaacctgggagacgaaggttgtggtgagccgagatcgcaccattgcactccaacctgggcaacaagagcgaaactccatctcagaaaaataaaaataaaataaaagacaagatctcactctgtcacccaggctgagtgcagtggcacaattatagctcattgcagcctcgaactcctagggtcaagcgatcctcttgcctcagctgcctgagtagctgggactgcaagcacgcaccactgtccctggccaaaatcttgtaaatgagaaaaatgacttgatgtttttcctgggagttaaactatgagatcaccacctaatggatcaaagtaaagaggtgcctgattacctgaagcacacaggatacatccttctatgttcttgagatcctaataaatataatgaaactaccaattaggaagagagcggcacggccagggaagtacagtaagaggctgcccatgcaagcccagcccagggcaaatagagtttgaggcaatgaatttagagtatttccttccagttagcaagagcatcccaaatatgagcctaggttccaggctaactagcaagactctacccataagtgacggatgctatagctagatgtagccagctcatctgagccccctccttctgactccatttctatgaagctgtcagaaatctctatagaaagagaatgtgttgctcatgccaacttccagtggtctgactttgtggcagtttcactctggtggcctggcatcagccgtgattacatggccttagttaagagtgaatacctgccaatcagatggctctgttcttggtgtctgtcccagtcagggcctggccctgcagagctgagagctagaccctggaccaaggtaaagttcacagaggctgtaaatactacttgggatttctgagagatgttctactcatctttattcccgtgtctgcatcccagcattcagtgtggcttagaatacacttttccaaatggttacaaacatttaatattgaagtttatatttctaatatagattgaacatcttgggttagacctggttgtgtgctatttcagttcccagtcttaaatgcaaattgtaatagattgggtaaaactaagctttattgtactctagataattactaaagagattgaagcaaatgaatggaagaagaaatacgaagagacccggcaagaagttttggagatgaggttagactggaggttttggggaggggctggatacttttatgcactgttagatttgatacagatgaagtgatgacagtgtttgcttgccacagaaccaagtgttgagagcttgagggctttgctgtttgcaccttgctttgtgattgagaatgttatttcaggagttattgctaaccagttattatattcaaatactgtagtttatcttgggttgttcagaacatataacatgtaaacagaacccacataattcttatcttcttagaactgacagaaatttgtatcaaaatatccatttggaatacagaaaaataagatttatccaatgatagagacactgaaattcataatactacttttttttttttgaggcagggtctcactctgtcatccaggctggagtgcagtggtgtgatcatggctcactgcagcctcaacctcctgggatcaactgatcctctcccctctgcctcccaagtagctgggaccacaggcatgtgccaccatgcctgcataattttttttagagatgaggtctcgctctgttgcccaggctggtttgtaactcctgagctcaagcaatgcacctgcctcagcctcccaaagtgctgggattgcaggcatgagccacagcgcctggtccataatactttttaaaaattaattatgcatgagagtttcaaattacataaccaccaaatagatgatagaaagcttgttaacaagaaacaaaattgattgacttgaaatcgaaatctttttatttttcctcacttttagaaaggagagttatgagccatgaaatgactaaagatgaaatcaaagtagagaagaaaaaaaggcataaataattcacacacagtgtggtcaacacttgaatgattaaaaaacattttaagtatatccctctaatttgttgctcttttattatttgtcttttaagcatttcctaggtgtaaggccctttgctgggcttgatggaaaggaagggacattcctgctcttagagagcggtagccatccataataaccaacttggatatgacgtcaaaagtgatgggggcaccaccattgagggcaggggaggacgtgatgcgactcacagagcacccagcaccggactgggtcagaaggacattgtcattcttcactagaagaaaggttaacccaagaggttgatctttaaagtctttgaataagtgaaatacttttggaattaggacacaaaataaaacttgtcactgaatcagaggtagagtgtctgaaagggtggattgactcaggaaagtctaaagtcagatcgcatctgttaggaagagcccagaagaatatctttaacttagtttgtaaaagattgactcatctaagcagaatgaatctatttccttgcagtattcaaataggtgcaaagagaaagggaaggcagttggttctataagtaaaatataagtttgactaaagataaaatcttaacaaaaacctttttagaaccttaagaaaccttatataatgtaaaaaaaaaaaaaaaaaaaagataacgagagccccaaagcagataaatggattacatacattgtcagtgtacgttaatgtgtttaattgtttgggacagcatttctccaactttcattgtctgaaaatcctcctctggtaataagttctttttttctcatttaggaaaattgtagctgaatatgaaaagactattgctcaaatgattggtaaggagaacattttgttttttgagggtatgagccataggatctgtcttagtctgttcagcctggtataacaaaatatgtaagctaggtagcttataaacaacaaacatttttcatagctctggagacaggagagttcaaggtgcccacagatgagatgtctggggagggcccattcctcatagaaggggctggctagctctctggggtctcttttataaggacactaatcctgacataatcacctcccaaattcccttccatgcccactttcaccctgaacatactcacacactggggattaggtttcaatacacaaatttggggttggggggtggcataaactataagaccatagccggatccatttatgattttcagaccatgtcacaaacttgtatttgtgctgtcacttagatacagtcgtctcattattcgtgggaggtatgttctgtaaagttgctgcaaacactgagttagtgaatactaaacactgctcctggcctggcatggtgtctcacgcctgtaatcccagcactttgggaggcttgggtaggtggatcacctgaggttgagagttcgaaaacagcctgaccaacatggagaaaccccgtctctactaataatacaaaattagctgggcgtggtggtgcatgcctgtaatcccagctactcgggaggctgaggcaggagaatcgcttgaacctgggaggcggaagttatggtgagccgagatcgtgccactgcactccagcctgggcaatgagcaaaattccatctcaaaaaataaataagtaaataaacactgctcctagggaaaagacagagttagagtcttgcatctggccacaacattttcattgattgatcagtatataaccttgttttacgtgtgttcctgtttaaagacaccttatttaatatatatagttgattcattaacattgagctcacagtcagcggcactttggctcacgtctgaacagagcttctgtaatgtatgtattttaaggaaccttactgccttcttgtgcttggtatcactagacagcactgtggcactgcccttggaggccacttaaaacagtgaagtctccggcaaaaagaacacaagtgcaacaaacatggcctgaatagaccaaaagaagaacacttgtttatagaatgaatcaagaaggcagagtattgctttgttcactgtcagctgagagcgtgcatatcaggtgactaaagcatttttgcactctgcacacatccacaaatgactgtcaaagtccaggaggatagattttaggattacaaataaattttagcaagtaggtgaattgggaggtatggacttggtgaataatgagggtcaactgtagttaggttcattttagaagatggcaggccttgaattctgtgactgttggtggcctggtcacatcactaacacccactgggagcatcctgtgttttggtgcagggttcttactctagtgcagattgtaatttctctgcatcagacccagcggtgcctttacaaaacaacagggattgatcctcctgcatggaatttagagtctcttctcatctatatcataaggattgactccctaaaccagagtctgtcctttctccactaaattgccgaaatgatactttctatcatccacatcacctaatgccttcccagctcagggccttaccacagctgttcttctctatggaatattctcccaggtagctgtatggctcacatcctcatttctgtccggtctatgctcagatctctccctgagagcaggtactctctgtacagtaacagccccctccccgcccccattcctccttaccctgccttgttctttccccatcacttgttaccacgcgtctcccccaactagagtataagccataagagcgggaatttggtcacatccccggctgtgtccctaccacgagaacactgcttgtcttctaaggagtgtctattttttgaataaatatgtcattccttttgacttgtgattcccagaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaaggtagagtgttttttccctctgtctcctggtgtatttccagtagtgtatttccttggtaactggtcatcaaatacatatgccagaggttgtgggtatccttttaaataggagctcagggcctactggccttgtatcctctattccagtgaagctggatttttttccacatttttccttctttggttgttcaggcatctggcccactgggtgccatgtcttggccattcctctcctgtgtcaagccaataagccccaggctgtggcgtagactgcaagaactgttaattgaaccctcagacctcaggtgaattctagaaatgttctttctggtaattcaccttttcagttttagtaaaagggattagaaggaattccatgtctctgaaaaattcaagctgcatattctagaagacattagtataatgtttcaaatttagatgtaaatgggcctgttgatttaatttaactttaccatatcaaccagacacaattatagcaatgaaatggctttattttcatattaaaataaaaatgaaactggccagtttatcaaatatggaaatcgaattgccattcagttttgaataactgccttcctaaagtaggcatattggtataactgacccttactgtatgatattgaaaattaacacatgaagacattatgtagaatttcctcagtgagaattacatgtggctatttcaaattactgcagagtatgaataaaagccatctgaattaattagatttttccattctttaaaaaatgaaaactctgatatgtggtagattagaagaaacaaaatgacctgtttattttcaatttttgctttggaacagaatgaagaagccttgaagaaatgtgctcaggattacttagccagagttaaacaagaggagcagcgataccaggccctgaaaatccacgcagaagagaaactggacaagtaagagcttgtaaatgttgaatttcactcttcatgatgttgtgggaagattgagagaggaaaacaaaatcactgtttcgcaactccaggttgtatttttatgtgtgtgtttatttcactttttaaacccttttcccattgttaaaacattaaaaagtaaaaaaaggtatatctgctcctgcctccttccactgggttcccatctttctctatgccaggtaatcaccattgttggtttctgttttttcttcctattacaatttttttcttttttatatgattatagcatacttcgctatttttgcttagcaatataattttgagaatctttccatgtcagtgcaagaagagcttcctcttttttttctaatagccacatggtattccattgttggaatgtatcatttatttaacagtcccctcctgttagacattaaagttaattcaaatgtcttgctgccacagacagtgctgtaataagtgacctggtaggtgatcgttttgcatgcctgtgagttatctttatgatctgtatgttagaaaaggaattgctagaccaaagcatatatgaatttataattataagtgttgtcagattggccccattagacttttatcatttgatagccctagataatatatgagagcatctcttttttctacaactgtgccaataggtcaacgtttttattttctgcaaatcaaataggtgaaaatggtatttcaacataggtatttgtttttggcaagcaacagagcatttatttatttattttattattattattattttttgagacggagtttctctctgtcacccaggctggagtggagcggtgcaatctaggctcactgcaacctcagtctcccgggttcaagtgattctcctgcctcagcctcccaagtagcttggattacaggcacacgccaccacacccggctaattttttgtatttttagtagagacagggtttcaccatgttggccaggctggtctggaactcctgacctcaggtgatccgcccgcctcagcttcccaaagtgctgggattacaggtgtgagccaccgcgcccagccccagagcatttattttaatcaatgtaattttgatttgcatctatcttatgaatgaaattgaatatatttcaccattcatttattaatatatttgctttactatgaattactctattctttgcccattttcctattgtcattttatagattttatatattagggacaccagccctttgtgataagaattttgaataatttttcaagtttatcatttgtcttttgcgtccacctatagtgttttttgatattcagaaatttacttttatgtgctgaaatgtattagtcatttcttttacagcttctggattctttgtcatagtaacaaagatcttccccatgctggatagaaaatattctcccatgttttacttacactttatggcttagtttttttaatccttaaatctaatacatttggagtttatcctggggagtgttatccaacttgattttttgttggttttttttgagacagagtctcactctgtcacccatgctgtagtgcagtggcacagtgtcagctcactgcaacctctgcctcctgggttcaagtgactctcctgcttcagccttccgagcagctgggattacaggcacccgccaccatgcccagctaatttttgtatttttagtagagacggggtttcgccatgttgggcaggctggtctcgaacttctgacctcaagtgatccgcccgcctcggtctcccaaagtgcaggattacaggcatgaaccactgagcctggcctcccaacttgactttttaactaaaaggtaatacatgcttgtacattttgctgcctaaatttctatctgtagaagcagaagttcccctgtccccttcccactcccatagtactgtattagatttcttatgcattcttctccataggttttacagatgcctctatatattatacgtaggtttattgtatatccctctagtcgtttctttgtgtctttataaatactatgattttgaactataaaaaatatttacaatattggaatcacattagacaaatttcctttttcccttaatagcatatcctgaccattttttcatgtcagaacatatagctgaatctaattctttttattaggtcgtggaactatagcatttctttattgatgggcacttagttacaaacttttttacattgaaggtaacactacagcgaacatcctgtgcactcactgttatgccaggtgggagtatttctgtgaatacataactgaaagtggcattgctgcgttggagggcatgtacactttaaattgccctggtgactaccacattgcccgccacaaggcagcgccagttttcagccgcccattggcacatgagcctgcctgtctccttgtatctcggcccacacaggactgtccttgttaatttttgccaattcaatcaattttcaaagcttatcattttaatttacatgcctctgattgctaatgaggctttagcatcctttcatcagtttaatggctgttcatcaactgacatttatggtttttaagaatgcctttcaggccgggcgcggtggctcacgcttgtaatcccagcactttgggaggccgaggcgggtggatcacgaggtcaggagatcgagaccacggtgaaaccccgtctctactaaaaataaaaaaaaaaattagccgggcgtggtggcgggcgcctgtagtcccagctactcggagaggctgaggcaggagaatggcgtgaacccgggaggcggagcttgcagtgagccgagactgcgccactgtactccagcctgggtgacagagcgagactccatctcaaaaaaaaaaaaaaaaaaaaaaaaaaggagtgcctttcacatctcattaataaactcattccctgtaggcccgtgtctcacagatgtcagtggttagtatcccaactctagctgtgatcgtctccaaaattatgcagtctgcttttgtactggtctaaaaaaaaaaaaaaaatctaagactgttatagaaaccatttgctagtgagatacaaattttgaagttgtctgtaaattgaatttttataaattaaaatggaattatttaggtcaccgatttttgttttttttctctcatgcagtcaattctttgaggcctgtgcctcacagatgtcagtggttagtatcctgactggctttgactagtggctaatcatgtgctttttgtctctttattacacccaaacaccataaacagagccaatgaagagattgctcaggttcgaacaaaagcaaaggctgagagtgcagctctccatgctggactccgcaaagagcagatgaaggtggagtccctggaaagggccctgcagcagaaggtacagaaagggacctgatctgggtggccacagagacgtttggttttcctcctcagcagtgactcacttaatgacagatctgggtgaaagaggccttggctttctactcagacatttcagtccagctcctttctgaactgatccaggtggaaacaaacaagtcaaaccattaaattttcaagcacatcatgtggaaatcatccacaggcagggtgcagagaggaagttgcattttaactgaagttcagaacagcttcctagttggggtcatgagactgcctttctttctttctttgttttttatgcaatatattaatatgaagccatcttcccccttcattgctttagatcagtggtttgcagttgggggcagttttgccctccaggggatgttaggtgttaggtaatgtctggagatatatttgtttggttgtcaccactgggagatgctgctggtatctagtgcaggaagccagggatgctgttaaacatcctacaatgcacaggacagcctctgacaacacatttacccatcctaaaacatcagcagggctgctttgagaaactgctatagataaatgaaaaccaggactagcaacaatccctgtttctcactaagcaatttttagctttccgtttttatatgtctccggtgtattttctttactgcatttccaattatgtactcatacctgtgccatccattcatcaagagcaggagtttttatcacagggtctgttagcccctagaacggtgctccctgggagattcagactccagcatccctagatatgctaatggattgagtgagacccagatacttatgtttttgacaagtaccccagataattcctctgataacaagaaaattggggaactaagagattcatggacaagtttcagagggctggtgactgtcctcaccctttactcaatttaagcatgattttatgagtacattttttgaggtgtgtagcctttttttctttaaagcatctctgatgtagaaaagttaaaaatcactgaattaggatgtctagggtagggtagatccagacttgggactagttaactctatttgcctttatttcagaatacaaagtggcctgcataattatgtcatttgtctttcagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaatggcaatatgggactccctccaagctagggtttggcaagtctgccctagagtcatttactctcctctgcctccatttgttaatacagaatcaacatttagtcttcattatcttttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgttagatttgggggtgtgtgtggtgttggtacttttcctggttataaattgtatccctgaatgtgaaaatttatggcagccctgcttttatgagccccatatttcaacctaaaaataggaaagatcacattttctctacactcattttgtgcatgtggttgggtgtgtaactaaaaacaaactttggaattcagatactgccatgtagatgtcgtgcctttgcatctgtgcaaacaaagtttttagctgggtgcttcttggttttgcttagagacttgttgtctgccctggcatttttcaagtcaccccaagctttctgactcgaaggacctggggtaaggcagaactatgtaaatagtgcagagcaaagagttgctgtgttttgtttcttctaggttcaatgcggtaccaggaataactttttaaatactggctaagccaactctccactttaaagggataggagattgggcaggaaattttgtgggttgtattacaggaaaagacaaattaagaggatagttaaggcttcattttacaactagctggagatccacttaggaaaatcagagaactatcacttttcttgctgtttgccacatcttaagacagtgcagcctctgtctgcaaatatgccaaaaggcatatttctcacccctgcgcgcctgaatcaccaggagagaatcttctaaaagtctctgatggagactgccatttgcagaatgtgaaacacagtagaaatatgtttctaagaattattgggaagaataagatggaaattaaccttgctactctcttacagaattgtattcttagataatttaggaccaccaatgtttttcatacttttacaaataggggatcatggggccattttagtgaatagcaattaagcgtaagtatttcttcatggaatctattacagatataaatgaatatatgtgaacttggtcatgacaaaaaatgactttcttgctgtggctaatggtcaaagcatgaaaaaccctgatctagccaactgaagtccttttacaatggaaacaggcccagtgggagaagcaatgaagtgaagatcacatggcttgtatgtcagtaagcattgttgccctcactcaaaatgagggaaaaaaaattaattgcaacttagttcttttcaagctcttgaaatccaagtcctaggtttaggtagtatttatatcattttccaagtttgtaggcacttaaggaccgatgaaaaccaaatacctttttctcaacacttactcattcattcactcatttatttgcagagtttaaagtgaaacatgaaaagtttgagggacagttagccaaagaaattgtttttacattttattgaaacagcatttaaatataaataatagggtaatgaaaatgattcttcccgagaagaaagccatccctaggttacatttcttgaaagaaaaaatgtagttgtgagttgttggttagttattatctgagttatttcctgagagtggatagatagtggtgcttatgatctatgagataaatctaacccggacaggcctgtattttccaccttttttcttttttggagacagattctcgctctgctgcccaggctgaagtgcagtggcatgatttcagctcactacaaccttcacatcccaggttcaagtgattctcctgcctcagcctcccaagtagctaggattacaggcgcatgccgctacgccatgctaatttttgtattttagtagagaggaggtttcacaatgttggtcaggctggtctcgaactcctaacttcagatgatccacccgcctcggcctcccaaattgctgagattacaggcgtgagccaccgcgcctagccctattttctgcatttctgagaattaacaaaatgtgccaagttaagatgtgcaaactcctaatcagaaaacattcaactgtgagacatcatatagaccaagaagacatttttgttttagacatcaaaaatgacagcacaattagcta

SEQ ID NO: 12585 - DNA, 19854 bp, Human
gatcttcttctgccagctcaactgaaacccaggaggtttcctgaaggtgaaaccaagacccttctacctctgaagccgcattctgtctaaggtccgtgtttggctgttttgagaggctgggagacaggacaccaaaagagtacctgtctcacaggatctttcctgagaggaatggtctagtaagactggtcattatgggctttggagtaacacaggcttaatgccactggcgactctgccccttttggttgtggaaactgggcaaatgcctcaagcttcttaaccttcatataaaaagcatatataagcatatagcaagtacttgataaatgtcattttagaccctgtcatttctgctagccctggactccagcaaggtccatttacaatggatagctgactatccattgtttgaatgttgatagcacatttgtgaacaagaagagaggacaaataacaagaggtttggaactggaagaaattccagccatcggttttaaaagacgaggaccagtcttcagagaggccactagtgacactctgctccaaacttctttttgccaaaaaagtgccaccctccatccagcccccacccccatctctgcaagtccttactggcgagaggaggatacttttctaattaaaaacctgtgatatatggcctgacaagtattcttaaatgtaattaaggggaccatagtacagaatatttccatccggttctagtttagccaatctagtaaatgatccaaagggtcccgtgcttagagggcagtaagacagtaaaaacgccctaagactcctccctgcacagcacctgcacccccactgcccagggggctgcatccatctccacatgactcaccctccctgtgcaacgcatgggggtagggagggaagcgccagtattatcagccatcagcaccctggggtgaactgattatcaggacaactaaaaacacacctaataaagccttggagacacatggcaagcaccgtgatggactagaagcgatttctaagctgaaatgctgctttgaatgcaatgtcagctggatgcttggtgagcagaaatagacaaggggaaatggagcaagcgcggcataggggtgagtgttgttctgattcctaagtttacctaagactggggccacggggtcgggtgtcccctgggacctacgtctcatgcagcctggggtccagagctggcaggaacaatggagatggggaccaaaggctgtcaccgctgctttttctcgaaatgcccgcccgggtcctgtctggggctcccgcctacgcgctcatcacgtgcacagcccaaacttttcagagccggcccgaggcctgcgggcccgggcgccagggtggtttttagggttttctttctttcttatttcccttcttcttctccacagttgatgattttctgcagaaaaacaactgcgaaaaagaacctatttcatttccagttcccatcaccgcgatttccacatggatgtgacgtgaccccagcttccgaaatgcccaggtgactcacgcggggacaccccggggcggggcgagggagtttctccgggcgcctgcagggaccgggcggggcggggcagcggggcggggcagggaaagggggcgggggcggggcccgcaggcccggtcgggcggaggccgcgcgcgcccctcgccccctgcgccctctggcggccggctggacgcacttcgcagcccgacccagagagtcacgtgactttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtaaccgccgcgcctccccgtgccgtctgcctcgggctcaccgcagtcaagggctgcgggtgcatgttgggcagcgacccccgggctggcaccgtctacctggcgttggttttgcagcgctcctggactgggagtttgttggacgtttctgtctgggttttgaagtgctgggagttgaggtcactgctgcagaggttggagtgacagccctggatacctccagccagctgttcctttcagataatgcacggaacttaagctgcagctgactggtgaagaggcgcccctcgggccctccgatcgggtggtcgttggcgctttgctcctttcgtgtcttttttggagccaagcgttgcatgctcatggccacgtagaccttgcagaagcgctgcggctttttcccaaattgtgcaggaccagcccgacggggcgtagggtaccgcagtggccgccagcccggcggaggtggggggcttcagtcccagagacagcttcccagacgctcacgggtccttgcagggggctggggtcctggcgcggggttcagcttttccagtagcagcagtgtaagagaagtatgcatgtagacgtgggtcgctggcccctgctccagcccctaccccacggttagactgtctttgtcagctggagtcgtcccacatcctgccacctggcctctcagaaaagcagtggcattaagtaaggaaggagcttaactctttttgagcccgctttgttttcggttctcctcgcctcagatcttcttgccttggaaagccagtctggtcaagtgtctcagggtagcattttggcagaaccattgttaattaaagggacttctggaccgcaaccttaatgtaccagattattgagcagccaatgaatgcttcattctcattgtttaaggtgctgctttgatttttttttcaattctttgtactatttttgattttttggagaggcacatccccaaatttggatgaggtatttgttgataaataattcatcaatttccacaatgcagacaaaaatgtctgcccagagtggaaaaataaaacaagggggagaagagtttgagtaacggagaagttctgtggaatcctagtgacaaaagttgagaaactacctttaaataagacagtgaggtaacaaatgttaaaaaaaaaaaaagttaagggtaatattgcattgtttgccacttataatgtatctgaaacatttgttctttaatcttaagcgtagagtggtccaagacctggaaatctgggcagtgggttttgatttctaaggaggcagttttacaggctgtgcaaggctaaccctaccaatgagatcacactggcgtatccgatattgacatttgcatgtcttgcctatggtttacagctctcactattttagatctttggtgaaaaatctttagattcagaagagaaaaataagagtcaggcaagcaaaaagagataacacctcatttgtttaaaatcttcctactgcccatctctttccatctgattgtggcaggcactgtagccacaggtttggtgttgtgggattgcaaggggcaggtattgaaagacctggctcctaggcaaaactttgcccctgaatggctgtgggatctgagcagtacctgtaactccattgccttagctgcagactaaggtggtagtgtaatttcagggaagggaataaggtcatctttgacttttagtcccatcatcaagcatggtgattggccttcagtaggtggtcaggtagtgcttgttgggtggatgggtggatggatggatagatggatggatggatggatggatggatggatggatggatggacggacggacggacggacggatagatgatattgtgaaagagacttttgctgtgccacaaaggaaaggtatatgtgttatttttatcctgctatgattttgcccaattccacctgtagaggacgtctgacatcaaaagagagcaccatctgatccagagaatgactcccactatgcctttcccagcaatcagattaagaatcccaatctaaaactatcaccagaaaactcctcaggagaaaccatgggtcatctagtccaacctctctcctttgagtgggccacaagaattatctcaacaccttatcaatggtgttgagagtctagacccacacagaagtagctaccctaaaatctaggtttcttctcctccctcttccataggtttaacatttttattaactggaaagttgccctggcaaataagatgttgcaggaatggaattaacaatcactgtgaaatttcctagggaatgtctttgtgctctgaaaacttcttcatcttcttggaaattaggaagtgtggccagacaccctactaagggctagtaaatcacagctggctttttacagtgttccacactggagagatcctacatcatgttaatttgcatcatcctgcgctgttggcatgggttgtagatgctggtctttgccacctttcctccttcatttgccagagtggcctcctggtggaaacttctttccttgtctacttctagattttcattccttctactagttgattatgcttaaagatttcagggtgaaaagccaggcagacttgcctctgtgttggtacctggagggtgatgataaaatttcattggcagttgagttaaaatgattgagctccaatatctgttcttagaagtatagaatttattgttctattattattttgcggtttttcattttttgttttcgtagagacctaggtctcaccgtgttgcccaggctagtctcaaactcctgagcttaagtgatcctcctccctcgacctcccaaagtgccaggattaaaggcatgagccaccatgcctagcctattgttagtctgtttcttattctgatatgaagtccggtgcggaggttctgaaggaatgctgactgctcttaaaattgcaaagcatcttgctggaaatggacttttttattgattagaaaacattcggttttaactctttataaacatcagaataaacttcatgattaaacactttataaatacttctctttggggctaaagaggaaacaccaaccagcagcctaagtgacagcataaaattgcaagatttttcataaagtattttactgtccttccagcatagggagggagtgataactcaagagtttgcccaagagcaggagtgcttggtggtggtctgaggggaggagctacagacttgtcagggctactttgagcccttaactggcatccagtactccccaaatccagtgctgttcagggtggcctcagaatgaaacgggagcttaagttggttttgaggagcagtacctgttgctgacagacagggttggctccctgacaaacattactgaaaacacgggttattcccctcctcctcagtacccactctctgccttccttctcttgtttaggctaatcttttaaagtgatgtaacttaaaacagtccagtgtgagttaatctctggggccagctagtatcccgggagtagaggtgctaagatcttttgcctacagatcagggtaatgacaagatcaaacactggggtttcctgcaggcagctatagaggagtcgtattaaagtcaggctaatagaatggctttttttttttcctttccttttcaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtaagacttgttctgttgtgtttcttttgcctgggtgatagctcccgcctgctggatccccattcatgaagctttaataggacaagcccaaactcaaatcaatcttgagatttagtattgagacctttatatagaatctctattcggggtatgtgataatagcagacttgttttgtgaatctatttattaaggatattttctgattgtgtatattgcagagcacattgaggcttggagaatgcatttgtaaacaccatacctccattaggtgatttctttctaattcttgcaaatgtctaatcatctgtaaaatacccttctctggcccgtaatggaaatgttaaaagcctttaagttcaaaaggaaagaatggtgtgaaaactggtagtacatttgtttcccactgtcattagaaaatgcttgtgatgttcttacacttcttgaattggtagcattttatgggttaaccagtgaatggctgttgaagacatgaagaacttcttttgtctcctcctcctctctgacctaggttctattgcctatgccctgcaaggtgaaatagacagatagctgagatttttagcatgaattttagacttcaccttcattatttttaggggttcttagtcactgaattccttcctgtctgtgctgttctgccaatggcctttaccactagtagctatttcctattccaagctttactgttttgttttttaatcatttcccttgggtaagaatatgtgcatcaacaggaatgtcagagcatactgtttcatgcaggcacaaaattctgctctatggatgtgcataattatgacaataaggaagttgactgtacaagctcaattaaatgctcatagtctacataagagcaggaatctcaggtccttatatctgtgacagtcccaaaccatcctaatagaaataatatgtccaagggcagaaaatccttgttgacaaggattacgataagaacactaacttaattaacttcattcaaaagccaagtacattaactttggctttttttgacttgggtaacttagagtgattggtggacatgggtttttaaattttgattctgggggctcttgtacattaccccaacgtcttgcctagatttatgaaacactgattcttagaaacatagatagaaagaaaactggggatagctactatctgcattgttcttggcattaaattaagtgatacttagaggtaggtaattatgtgaagtcatcatcacggggtttatgtgcctgacaatttgtggttttaatcatctcccatttgttaccaaaaagagatggagtcaactttgggggagttggaaacaaagattctgctgaattaaaaatgtggtagaaagaggaacaccttattaagagaattaactgacttttagctttatttccttaagaaaggaaatgctctatttccactagaaaaaaaaaaggaatataaataggaaacacttattttgtaaacatgtcatttaaatcaacaaggagccacactacaaataaaactacaaaagcaggtgcattttggtaacattttctgggaaatcatttttagactcagagtccttttgtttcttcactttcaagaaaactccttaagattctaaaaaaggaagaaaagatatttagggagggaggaaaacaaatgactttttctttgattttaattagcaccttttaaaaaaaaattaatccttcccctgataggagggttcttcaaaggcaatatctgtttggggagggggtgattcacaagtttgcatttgaggatatgagactgcggtgaatgaggaagggagtaggtggcataaaattgaaacttcatgtgaaaaattccagcgtctattggctgcagcgatttcacttgtataatgagtagccctattccagctcaccctgaccacacccacttggaaagtccagggtgcacttcgcagtttaaatgtctacacaccagaacaaaaagtacaatagctgttgctcaattgctagtcaaataacttagcactggggaattccagatgttacttagggaattttatactggtgcatctcaataaagaactgaaagtaagcacaagaagaaaaaaagccttatctttgctctagattttgcaaaggggaaatttcaacagaacgcaatcattgctacacgtctgccaagacacaaggcttgggcgatcttttttgttcatttgtttgaatacttagctagtttttctaaatgtatacattgaaggaatactggctgtggaagtatatttgagggttttttggtttctttacagtttgactgtaattacaatttgataaaatttcaaatagctctattgccctacttatagagtaatgtaggaaacaatgtaacttttcattataaaaattattttgcacttgccaaaggagattaaggagttaactttttttgttttaaacattcccccaaaatatttatcgtttgggggttgaaaaaaatgcagcccattgaattgtgagttttaaactggaaaggtcacagattaatggcatacaattaaacctgtttttttgtttgtttttcttctcaaaatgttagccctaaacactgaattattttcaaatttagacacccaggtgctttttaacttttgtactttacagttactaacaagcaggtttgcataaggcatttttgagagccggactagcaggccataggtaattccgtgttgtcaacacgactttccacaccaggagaggaaactcccagggcccaaaggctaaagtggaatggtcaagtcatttgccattgagtcatagccagaccatccctatctagcaagccatgcctgcttcctggtttgtgcatgttgccctgtgtgctcctccttagaactagagagcagcaatgccagtgccttcaccagcaaatcaagggatggtaggaagggatagggctttagagatcatcacttactgccctcatttcacaagaggaaaaatgcccagtgaacttaaggaatttcccccaggtcacctaaactagttaggagcagacttaagctagaaccaaggtcccctggctcctttgcagttggtgtcattcattaaaaagaagaataaaaagaactctttttttcttaaagctgtcatcatcttgtgaaatatcagtttgcccttgactaggaaattacatcaaattaaaccattcagtcccctagaatagcagtagggctggtttattctgaaaacctttgctgggtcttacatgcagataacttgactttccttctcttctcctttctgtcctcaggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcgggtaggtttttccccctaattatctactaacagagctccatggtgggcatagggtacccctgggcgagtccctgccctctggtagcatctgatggactaggtcacatgaatttggctaagcgaagcatactcaatggaaaacaccagaaacctccagtgggactcacccaaggcttttgccctgcttttggttagcagattcccagctgtggatccgttcctgtagcagcgagtcttttgatcatggccttttccactggtgttttgttgtttttcagtttgattgcccttagctttgctgagccagccagtaagattaagacacgtgcctcaccatcctcagtcacaagtttggaatttttgtgaacatttggataaggggctgcaatatgatacctcatcagggatttttttttaaagcaggtgctgtccccgtcctccccaacttttgagtttgccttgtagtggaaaaaagtaaaggaagaaaaccgaaatggggaaaaaagggtgatcatttgaatgatggtttcatgaaaggggaaaaaataagctgagttatataaatgaataattgtagagtgatgtcagaatgactttttagtacagggagtacaggatacattcaagcttttttttcaccccgctccccttagaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcaggtgagatgcctgcagatcacggatctgtacttaaatgctttcagccttatgccttggctcctggagaaaaccacactgccaaagttcaggtaacagagttcaatggaatttgatgaaagtcacctaagggcctcattttcctttctctttctttgaacagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctggtgagaaaactgcattaattcacatctctaactagacactgaaacatcagggttttcctttttgcttcttattaaaacagtcttatttaagtatattatttttatttaaatatattgttctgtgacttgcttggttagtaagagtaatgcagtagcagtaatcataataccctcatatctttttgaatatgacttggaaagtactttcatacatgataaattaaggcgcacagtgctcttaatacagtgcctggtatggagcaagtaaacgcctgtcaggttagtttttttctttttgagacagggtttccctccattgtccaggctggagtgcagtggcacaatcatggctcattgcagcctccaccccctgggctcaagcagtctctcgctttggcctctcaaatttacaggcacgagccaccatgcctggcctgttagctgttattttaatagcctcatgtggaataagcactgtgctttggaaatattattttactgcatttttatccttttagcattcttgtgagatgtaggccttggtagccttattttacatattagacagttaaagctcagagaggtcaactaacctgcctaatgccacacagcttgatagtgacaaagccaggattcaaactcaggtcagtctgattctaaagcctgggactttaaccaataagatccaccacctccaggctggttaatgttatgtgagtttcctggaaacagtgcatttttatattagattgtagcacattttgttttcccatttgggtttaactgtggctaagaatacttttctattctgtaagttatatcttttatacattttcaaaatgagatctacttacctatggccttgtttagtagaatactgttttacttatgtattatttttttccttagaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagtaagcagtttatgttcagctctctcctgtgtcatctgtaactgtctttaacctcagccacctgagttgctgccaccctgaagctcaacagtagagtgatttgcggccagtttctgccaatgggaaacaaattcagagtcttgtgcatggttagagaggattatgtaaggcagtactaacttgggtttcaaatcaaaacatgtcatttatccataatgattttcctggatatctggatcccaaaagtcagaattgcagaattatgggttttcaaagtgcatttacatcaaggatagttgttgtttcttgtttttgtattttaattactctggtacatattaaaaagactagtgaaaacacttggaaacaaaagcctttctctcttggcttcttggtaagaacaggcacatcagacatagatggagctgtagaattgtttatgttgcagctcatgattctgccacatggaaatgggaggaaagccccagaatacccattgtgcaggtatccggtctttaaacattggctttatgttaaagagatgcctgtttctgagcacttgaaacgcacaacagatgacaaggaagccgtaagagaatctgtctctcaatgtggagattagcaaattacagagtcaacagtaaatagacaagcgcctttgagtgtgtctgcgtcttagttactcatggctgctaatgctggtggagactagacacaagtttaaagttagtaacagcaaaatacccaacctgaggttccaaagtagtttgtactataaagtagactagtcccaaaccaatggcctcagtaatattttactcagaatttgatctctgagaaattggaaagtcaactgatttttcttagcccttgttttagaactatctataatttttggatggaccaagattgattaaatgaaactgtgattttaaaaataaggaagtcttagcaaactaactgacatcattcttgactcgaacatgttgggaaatgtgtcagatcatgttgcgtgaaaagtgttagctcttcatcacaggcctgcatttcagtgaatggttctacaattcttgccataatccacattctaaaactttgttctatgagctaatgatgtaaaatcttgtgtgtgattttgtgtattctcatacatattttttccttttggtcttcaggttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacgtgagtgaagtggttgacttcctaacacagcggctgctgtccagaaggggttttgttcctgacctttaagaaaaaaagcccatgtaggcagtcaggcagaactgtcaggacctaccgtgcttttctaccagcttgtgcaggggacagtcacggtggccctgccagccgcccatggaggcaaaaggcactgcgtgattacagcagctcctaatatcacattccaaaaaccagagtgccctgtagacagagctcatgggatgtgcttttactagaccattcaggtctggcatatctaagagagtctaagtttaaactagacttattttgcaacttagatataacagaacaatcttaaaatctgaagagtagtaactggagagaaggaagtctctgttgacactgtaaggaaacagatgtggtttggaaatctctcattggaaagaagggtgatcaggtaatgcctgctccttgcctgttcctgtgagcaatcagtgcttcaagttcaaaatgagagattggtaaagccaaagatgtttccataatagggatgttatttcttttgctgaatttatagacttaaacatatacatatatatatttctatacatttaaggctggcctaatctgtatttggaacccatttatttctctactgtcagcatctctgtatcggtggggtgacccctatgtggtactaactagcatccattctcatgtagattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactggtgagacacttggaggagctttccctccctcccgtgtgttcgatgctttttgctggagcgttttctaccgacagtgacaagcaggctttcctctctgccaggttctgtctcctcatgataaaggattaattcagaacctgaaggggaatgtccatgtcactgtggctccccaggtccgaaatgctacctccaattttcatgctccaagtatgctttcaaatttattttaaaaacaaagaaacacagccattgcataaaacttcttcaagcctccaaaaagccagatggtgatcagaggcttctttgatttgtaagagaagcacagacatctaaaaagcagcccttcttaaataatcctttatcataaggagcgaacagacagagcttcccaggggcctccacctaatggcgcgtcagaaaagccagctttgacagataggtgtgtcgcctgttgctcacagaatggtagggaagctatgtaagaacagtggtttttggtcccaacagaagagagccagggaaagtttgcaggccaacttaggcttggcggttttcctcagcctccctgggggccaagtcagctttccttgagactggaaagaaacatccttcgagagctctggctcatagactgcaatgctctcctgttcccttgctcaggcaggtaaagctctttgtagactccacactctccaatgagatttcattgtgctctccctaagaaatgtgagcaatagtttcctgactttttaatgatctgcctgttctttccactcagagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattatttaagaacagattgtgatgttttcaattgatgaatgctgaaagaaaaagaaaggcttggatattaagactgtgcttcctaagcagctttattttgaggtgcacctgagcaatgcacacatctctcatccatggtagcaaggcagcttttcataaataataactgtatgaggtccaggcccagtcctcaagcacaagcccccgcttgacaatgaagacactcttcctctgatgggaagaggaaagggatgctaggaccctgtggcccttttaagcttcctgccctaaacttttataaagtgaagaaagagaaaacaagagggaggaggagggaaagacaggaaagagagaagtaggcaggcaggaaggaagactgatgtaagatctcctgggtcagacaaagcagaggaggcagcgtggctgtgctggctgccagaaccaggaaattaaaaaataacacattcctccatgcgcaagccttcatccccacctcccatccagtacaaatggactcacagacgactgattcagcaggactgcgcagctcccagaatctacttttttaagctcctcgggtgatctggatgatcagccagattttagaatcacactttaaaaaatatatttataatttttttttaactttttaaaagtagaaaactttaataagaaagtgacaagtactataaagagccactctatagccatcctccagtttcaataattaccaacgttctgcccaatttgtttcatctatcacatcctcttttttgtttttcctggactacttgaaagcaaatcccagatattgtgtcttcatacccataaatatttcagtgtgcacctctaattgaatagaatatgtccttttaacataaccaccattatcagagccagctaaattattttattctttaatatccaaattccaagtatgtattctaatttctcagtttatccaccatacaagacaaagtcttattgctttcgtttagtaaggatcttttcttttttttttaatgtttagcaatatttattaggacgtatacctaccttatgatccaaaaattccaatcctaggtatacactcaatggtatacactctactcctagctatacacccataaaacagaaatgcatgcatatgttcaccaaaatatggtactaaaatgttcatctcagcagtattcataatagctccaaactacaaacgatccaaatgttcattaacaggagaaaagagaaatatattgtggtatattcatataatggattatcatatagcagtaagagtgaataggcacctgtagttccagctactcaggaggctgaggtgggagaactgcttaaggctacagtgagttataaggctctatttatttatttatttatttttgagacagagtcttttttaaatttttttttattatactttaagttctgggatacatgtgtagaacgttcaggtttgttacataggtatacatgtgccatagtggtttgctgcacccatcaacccatcatctacattaggtatttctactaatgctgtgcctctcctagcccccctaccccgtgacaggccccagtgtgtgatgttcccttccctgtgtccatgtgttctcattgttcaactcccacttataagtgagaacatgcagtgtctggttttctgttcctgtgttagtttgctgagaatgatggtttccagcttcatccatggctttgcaaaggacatgaactcatccttttttatggctgcatagtattccatggtgtatatgtgccacattttctttatccagtctatcattgatgggcatttggttggttccaagtctttgctattgtgaatagtgccccaataaacatacatcatacatgtgcatgtgtctttatagtagcatgatttataatcctttgggtatatacccagtaatgggattactgggtcaagtcgtatttctggttctagatccttgaggaattgccacactgtcttct

SEQ ID NO: 12586 - DNA, 18082 bp, Human
agttgtgtgcacattgaatttgtacaactacatatgtgcacaacttcagacttaaaaaaaatttatttgtttatttatgttgagacagggtcttgctctattgcccaggctggagtgcaatggcaggatctcagctcactgcagcttctgcctcccaggctcatgcgattctcccgcctcagcctctggagtagctgggactacaggagcccactaccatgcctggctaatttttgtattttttgcagagatgggtttttgccatgttggccaggctggtctcaaactcctgagctcaggtgatcctcccgcggcttcacaaagtgctgggattacaggcatgagccaccgcgctcagccaaaaaagttacttttaaaatgtgaaaaaagaaactgaaagtagagttctagtctgtcaccagttacttccagttaccatcccaggtggaaagcaacagctgtgaaataaaaagcaaaaataattactttgaaggagtccagaagcactgtagcttcccagtgtttactattatttacttgttttcatgtgataattagatgacaaaacccttaaatcaaaacgactttgtcagtacgcaaaatattggggagttagtaattgggaagggatagaaatgttggtggtggctaccagcaggagcagataaagagggaaattaaggtgaaaattggaggagccctgagaactcaataataggtggttgggaaaggtgctgaaggaaataaatacatgagacttaaacaacaaaaaataacacttgccacaacctccacccctgaaatcctattagtctcaaaagttaaaaagctctaatgcaacaggtctgtaaagaatgaacacagggccagggtggtgtctcatgcctgtaatccgaggactttgggagactgaggcaggaggatcacttgagcccaggagttcaagaccagcctgggcaacatagtgagacccccgccccgccccgccaccccgtttctacaaattttcttttttaagctgagggtggtgcacacctgtagtcccagctacttggggggctaaggtgggaagactgcttgagcccagaaggttgagtctgccgtgagctatgatcacaccactacactctgcaatagagaccctgtctcaaaaaaaaaaaaaaaggcaaaaaaagaaaaaaagactaacaaagaaagaatgaacatagatttgttccccatatcttgtggtattaaacctagggtctactcttcaagcttacatcataggtttagcattaaaacagctaagcagcaaagcagatgctgtaagcgatagaaattcattaagataggaaagagtgggaaatatgtaaagatccaaaaagaatatatatttaattacgatttttttgaatacttaataaaatatgctattcctaagtgccatgccatagggatttcacaaaactatgaactgtgattagcaggaattcctcatgaagtttgtactctatgtgagaggtctggatatgtttatgaatcgagaacagtaaagtacagggtatgtaacggagccaaacgcgaatccagttggaatcctaaggatccatgaagtgctccctcctccaacactttcccagcctcctattcacagctccagcctccccacgtccgatatctacccccaggggaccgttactattgacagcgagcgcgcggagctgcatgggcacacaaggcggaggggacaccaaggtccgttattccccagcacgttcactgccccagcgacagcgcaagcctgaggcacgcagacgcgggaggaacccgaggcacagcacacagcaggtgaggggcgtggtactccggtaccctcagtcggccgaccatagagcttgtagacctccaggactcctagagagcttccggaagtgcctttggggcaagatgcgtgctggccggtgttgtgcctccgcagatttagaagttagtggccggaggggcctggtccgagtacagctttcatcgcctttactccccgaccttccttcgagtctgtttatccgttgcagcctcccttccccacgacggggcgcctctgcaactcacagtgagtacggtcgggctctgggccggaggaaagtgggtgctttgtggctggtccaggccgcagctgaggactggcctgaggggtccggagaggggcctgtgcggtgttcggcgccgcggaccgattctgacgccttagttgctgttgcaggcagagtacgtccccacgaattgcccttgaactttttgcgagggaaccttttatgaagctttcttcatagataatcgtgttgtggtatgtttttgtagtcgatcttgtttatcttaaaatggggaacgccccccccatgttattttttatccaactatttccagagtctgaattgttttcacttagcgctcttttgcgtttaggtcacaacaaaattctcagtttttaaaaaagacatattttgcttttggaagccccgtttatccatggaaaccaatttttgctgttactcttctttctttagtgtattcagaaactggtggtgtgttgactagataattgtacgaaagttttttttttttttaatttcagggtaattcagaattcaacattatcagaatgcctatttcatttgttaaagcaaactgaagttagccaacgaggaactctgggagggccccatttccaaaactctggttagtcatgagtaatttttgtcaggctactttgactgccaccaccacctttaaaaacatatttctgttgtttgttagttccgttgagtatatttacgtagcaatcattgttttagcaaatacatacatgttttgaatttctgttgtttaaatgtaaaatgtgatagatgttaattaaaactttcagctaatgcaatttgagataacaaagcatagtattggcttcacctactttttcttggattttaaatcctggaaaatgtcttttttgttttgttttcagttcccaaacatttctcaaattagacatagtctgaaggaagaatacattccttccacaactattgaaaaaataatactgttaaaattgagttgtgccttcagcatctcacaggattacagtatttaaaatccagaggaagctttaaagattgccttttaaactcatgtaaacttgactaggtgttctttaaggagactatgtaaaaatcagtctgtatccacaaagtgctcaccaacttaatacagacatgtacgcacaaaactgagaggaaggtacatactggagtaattttgcactcagttatttataggttgtaattctcaaaaaccagctgatcagagagggaagagacttaaaaaaatggaaaattagccactaaatagaataatcaagatgggcaatgggcaagacctgttggctgatttggtataaaaaatgaacaaacctgataattagctggttttcatcagtgttgttattgagactttttaataccacatcaacaatataaagttcttgaatgctgcgcacttcacattaaaatattttatagcctcctgtactggtaagtagtgggattgcacctgtgaatagactctgcactcaagcctgagcaacatagtgagaccctgtccctaaataataataataatattttatagccattatggatgaggattgctcagtaatagatggccagttgttcagtagttaaaaatgaaccttggctttaaggaaatttataagaaaacatggtaagactaccactatataacatcacattctaaacagaatttatgtcccatgtattgacctttaagtttttaacattaaaccataagtagctattttaagaaaatttaagagtttgttttgatttgaaaaattaaattattttaaaattagctaagaccattttaaaataaattatcttaaaattatagataatttattcaaacaaaaacaaattgtcaaaaccaaattgattaccctttctcaacaaaatctcagcatcttcctcaaattcactcttcccccaaatctcactattctagcaaattcctccactttcctgtaaagtcataatcaatgaactatacccccaatgttaattgatatatttaaccatatcttttgctccttggttcttctgatctgtagtttactctccaccctgttgttcccggccttgtctaacttgaaaaataattttcaaattccctttcttttctgtacacactctctatgtaggatttgtttgtatgtttgtttgtttttaaccttcctggcattcttggatggcctttgagtctgtgaactctgccgaaattgagtatacaattttgtatctgtggacattttgctggaaagaagttctgtgttttctttaggttgaagagtctataaaccaacccccctcgccccgtgccacaactccaaaaactgaaaagataagcactgccttgatgatccgtatggggaactgtatgtacagtaatctgatttttttcctaagtacctatctcttctttgtggactataggtctctggttttatcttgatgttagcatctcatgacaactggtttagggtatgctacctttacttacactcttcttcattctctacagtatctttgaaatacaaagataatggtcacctctgtcaacaaacatttgcaataaggccatggccacattctcacaatgtgataagtcctatatttggaccatgttaaaaatgctttggtaggaatgacaaatggcagggggatgacagagaagaactcatgaaaaaggtaatagataaattagagttaagagttgaatgattttaggccgggcacagtggcttacgcctgtaatcccagcactttgggaggccgaggcgggcagatcacgaggtcaggagatcgagaccatcctggctaacacagtgaaaccccatctctactaaaaatacaaaaaattagccgggtgtggtggagggcgcctgtagtcccagctactcgggaggccgaggcaggagaatggcgtgaacccgggaggcggaggttgcagtgagccgagttcgcgccactgcactccagcctgggcgacagagcaagactccatctcaaacaaaaaaaaaaagagttgaatggttttagctggaccaagatttatcaaccttggcattgacactttgggccaaataattctttgtggtgggggctgtgttgagcattgtaggatccctggcctctatgtacaagataatagtagcaccccttacccccaagttgtgacaacaaaaatatttacagacattatgaaaggtccctgggatgggggtaaggacaatattgccatcagttttgaaccactgagctagagtaaagaactctgtagtagaatggaagtatgagaaagccacagcccagaaaggctttatgtaagtgagtttaaagtagatatagccagccaggtttacattcataaagggccttgcataccatgctaaaaaatttggtccctattgaaatattttcaggaggtgagtcatgttagtcatattacatatttttaaaaaatctctggcagtacagggctactgtaaaaaaaaaaagtatcataaacctggtagtttaatagaatagacacttactgtctcatagttaggaaggctagatgtccaaaatcagagtgtcgccagacccatgctcttctagcttcttgtttttactgacaaactttggcattccttggcttgcagctgcacaactccatctctgcttctgtagtcacttagctctcattcatctgtgtgtgtgtgtcttcacatgaccttctcctttctcagagtctgtctctgtgtcttttttccttttaaaagtgtgccagtcatattggtttaatggcctacccattccagtataacttcatcttaacttgattacatctgcaaagccccatttccaaataaggtcacatccacaggtactagaggttagaatgtccgcatatctttttgagggacacatttcaacacacagtaggcaatattgtggaacatgaatgggaaaaaagcataaccaaagttaccattgcagttctaggcaagagatgatgtctataccaaggatggaaaccatagacatatatttcacaaagaaataggatcatgaaattgaacttttttcggacatcaggtcttgtttctaaatctcactcttacaagaaatataaacatgttctgtgtttgcaattgtaaatatggctaatgttcttcgattctatcaataagataaaagatatggacctttgcccatggggaaaatacaattaagttttgaagtcagaattcctttggaactaataaatatacagttatgggaaaagtaacattaaagcaatacacatttaagtaacagaggtatagaatgagaggaaaataatttccaattggagtcaccaggaaaggatttttaaaggcaacagtattttatcttgtcctttaagaaagtagtgtcggtactgatgaaagaagtcaaagaagacttcaacggagagacacattgtgttcacggaatggaaaactcactgttgttgagatatcagttgtccctaaaatgagctatggattcaatacaaatccaattcaataattttttgtagaaattaatacactgattctaaaatgtgtatcaaaagacaacagaactaggaaagtgaaaataattttgaaaacgaacaacaaagttgcaagacccacctacttgatttcaagattttaaaagttacacaatcaagactattctgtattggtgaaagaatagatgtataggtcaataaacagaacagagattccagaaatagacccttacatatacatacatatagtgaactgatatttgacaaatatacaaagacagttaagtagataaaggagaatccttaaaatgaacctccatccatacctcaaattctatataaaaattaactcaaaatggatcataggcctaaatgtaaaacctaaaactataaaacttttagtaaaaaacaggagaaaatatttgtaaccttggattaagcaaagatttcttagatatgacatcaaaagcacagtcaattaaaaaaatgaactttttttcttcaaaaggccctatgaaaaggatgaaaaagagggaatacttgcaaattacatatctcataaaggacttgtgtccagaggatgtaagaaactcaaaacttaattttaaaataactaaatttaaaaatgggcagaagttttgaacaaatacttcactaaagaagatatatagatgttaaataagcacataaaaagatgctcaacattattagtcagtagagaaatgcatactaaagccatatgagatattaaaaccataatgagttgccactacacatacacctattagaatatctaaaattaaaaacaaaaacaatatcaagtgctagtcagattggaaaacagttttgcagtttcttataaagttatacatatatgtattttatgacacagcaattttacctctgaatatttgcccaaataaaatgaaaactatattcacaccaaaactcatgcagatgttcatagtggctttattcatagtgattaaaaaacaaaaacaactcagatattgttcaactgggaaatggataaacatttaaacattcccactccagaatctcacataaataaaatcatatagtatgtagccttttgagtgtgggagtagacttttgggttgtagttgtcaatagggcatccaggttccttggagtgctccatagagagtttctgagttggaggtcacgtccatagtagaggaagttaaccttgagataggaggaaagatgaggggcacaggtaggataaggaatgttaggtggagaagagcaaagtgttaggaaagtttttgacaataccttgaattagattatgtagaaattagtctcatctgttaagagtaagggaaaggttgagagctgaagcgtgtagaaccagattagtacagctggtgtatcaaagactaaaaggggttaaatgagcagccctgaaggccagctgagattaaacacaaaatttcaactagacccagtctacatggtttcctgactttgcttagccatgttccacatccccaaacagggtgatgaaagcagaaggaaggggtttttctatggatgggtttggcatggctggcatgacagaaagttaaggaagtaagaagttatttctggaacagtggggaggatcatttaattggccgagccatgaagtccgtgtcatactaaggaacttgttaagataccatagttagttacaatgacttttgacttgccttaacactatcatattttcttcatgaagaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtaagtagaaggaggtatgcgtgctatgactgtgggagtcctggaagcttggtagagggacataggcatcacagtgggagagcagatgcttagcatcagtttctgttggataaggatgacaatagttttagtgtagtatgacttgtagagttctttttacttttgtaaaggatataaatccattttgtttttgtcgtcataacatccctacgactgtattgttcttgtttgccagatgggaacttgatgcataggaagcttaagttaatttttcaggggtatccaaataattaaaggtaaatttgagaccagaaatcaggctttctagttccttattaaaagatttttctactgcatagcactgctttaagtttgttgttttcctccttcctctgccttaggagtacaaaatattggtgttctgtgtaacagggaaggcatcagcagaaatcttttcctttagtactaagcaaaaatgatgcctttctttctgtgctcattacgtattcgtgttccttactgtccctaagaagtgaggaagattctgctgcttccttccccaagcatatatccctgtagatgtgttcgtggtcctctttcattgttcattacatttcgcaaagggattccttattatccaactgtctgttgtttccaggtctcagctcgcgtacatggacatagggtactctgggaggaggtagtacattcagcatctgcaccagagcctccaaatactcagctccaatctgaggcaacccaacataaatctccagtgccccaagagtcacaagagagaggtgagtagccagatttcattgatgataagggggggaagtacaaataaaagtccatttgggatacctatctagttcctgaagaaccaggaactaaaatcctgtttacagaccagtcccaaagtctgtgtttaaatgtttaggcttcaaatatagattattctttctagtggtaaactcatgaacaaattaaataatttgacttttttttttttaattttttttccttttattattatactttaagttttagggtacatgtgcacattgtgcaggttagttacatatgtatacatgtgccatatttctgttaccacagtacatttacaacatacatttttgaggttatgctggtattgtcatgccactttatttggaaatatttcagtatgtatttcctcagacaagagcatttcttaggtaacttaaataaataaattcctaaatttatcacaattaagaaatgtagtattgctacaatactaacctaggccatagttcatattttgacagttgccccaattatgttctttctggttcagagtctagtctggcgtcacactttgtggttagttgtcatggctgtttagtctcctttactttggaatagttcctcaacctttctttttttttgaagagtacaggtgtgttattttgtagaatggctgcagtttggatttgcgtgatgtttgatcatgtttacattgaggtcatatatatttggcaggaacacctcaccctgccaaggatacatgacctaaatcttaacaagagatgttgtactccttcttaggggtacaacaggaatttgtcctattattggtggtgttatctttgatgacttggttaaggttattcttgcagggttaatcattgtatagttactatttttccctttgtaactaataagtaatttgtggaagatactcttgagtgtatttaaatatcttagtcctcattaaactttgttgctaaaacactagttttagtgttcattggtacttcttgactgacttagtgattactagaatggttatgaaatagtgattttctaactctgtcattccttctacatttctttattgtaaaggagagtgctcccttctcccaattttattattttttatttatcagtatggactcaaattcgtatttattccataaatattctgttactgtctttattttgtttttgttttgtctttgagacagagtctcactctgtcatccaggctggagtacagtggcacgatctcagctcactgcagcttctgcctcccgggttccagcgattcttaatcctcagcttccccagtagctgggattacaggtgcacgccaccatgcctggctaatttttgtatttttgtagagacgaggtttcactgtgttggccaggctggtctcgaactcctagcctcaagcgatctgcccacttcagcctcccaaagtgctgggattacagccatgagccactgtgctcggccactgtctttattttgctaaatcatctcagatttggccatagaaggccccttcagtctggctcttgtatcctcttgacattttcccattgtttttttgagaatttttttactttattgcagaatgaggtgttccagtctcatcttcccctgcatttcatattttttcattaatgtgatttagagtagtttataaatatgaatttttaatatttctaaagaagcattaaaacacttaatacttcttgtctaaagtcctaaagcttgttacctgagatacagtaatctatattttaataataagccgtttaatatctatagaaagcaaatactgggagccatagtagacatttcagaaaggtaattaattaatagagactggttgattctgatacttggtttgccaagagattaggacctaaggaaatactgtatacagccacaaagacagaagtagttttgatggtagagaagaaattgaaaagcgattcctgttaggaaaccagtatactttctatttttgagtgtaacttcagtctgacttcagggacatcggggtgcgtatgttttgtggggcagccatagatatggccccagaatccaagatatcagcacttcatgtgcaaaatctttggcatacatgtatatctgctgaaataaaaataatttggaatgggtgagtgccagctcccacaaccacaggacaggactggtctcattcatagctcctttctcctctcagccatgtctacttcccagagtcctactcgttcccagaaaggaagttctggagaccaggaaatgacagctacacttctcacagcagggttccaggtgagttgtgctccttctcactgaaacgccatagctgtgcttgtcagtgtttgtggcatctgccctatatcttgactgtctagtttgtagcagtacctacccaaaaagttgtcccaaaaattcttttgcctagggacagattgatcctgaatttcccccagtaaatctcatgcattttcctcttcttcctagctattcagatccctttacatagtacattcccaagttgtaattctctcccaatactggtggatctctcaagctctataggtttgagctgtggaacagtcccagtccccaaatggggatcttgttttgtttcagactttggagaagattgaagacatggctgtgtcccttattcgagaggagtggcttcttgatccatcacagaaggatctgtgtagagataacaggccagaaaatttcagaaacatgttctccctgggtaaggagaggtgtggttattattgtcattttagattttttgtttgtttgttgtttatgtgtatagtagctacagcctttctgaaagacatagttaagtttaactcaggatccagcagagggatatgatgttgagatttcttgaaatcttacgtgaaacttttgttctcctgtccagaacttccttacattttgtaccagggtactggcgtttttgccagttggaaattgacatctcacaggtgctctctgagttcatatatttcttctccaagttgtcatgggattcctacatatatttttctcacataaattaattgtatctcctcccttttgatgactgggcattttcccatttctgtcctgctcattagttcttttagtagttccatattcctctccccaactttcacctcacttcagttcatcctttcctgactttagttccccttccaattaactctctttttttaatggtacctctttcccagttgactagctcatattaagcaaggtcactattaagaagctattttggagacagaagttttgtgtttacttatagctgttcatgtgtactttccttttcccctatcttcagttcctttctcctagcataaagaataggttgtgacattggcttgatgtttgtttattacatttttatttcaggtggtgagaccaggagtgagaacagggaattagcttcaaaacaggtaatatctactggaatccagccacatggagagacagctgccaaatgcaacggggatgttatcaggggtcttgagcatgaagaagcccgagaccttctgggcagattagagaggcagcggggaaatcccacacaagagagacgacataaatgtgatgaatgtgggaaaagctttgctcagagctcaggccttgttcgccactggagaatccacactggggagaaaccctatcagtgtaatgtgtgtggtaaagccttcagttacaggtcagcccttctttcacatcaggatatccacaacaaagtaaaacgctatcactgtaaggagtgtggcaaagccttcagtcagaacacaggcctgattctgcaccagagaatccacactggggagaagccatatcagtgcaatcagtgtgggaaggctttcagtcagagtgcgggccttattctgcaccagagaatccacagtggagagagaccctatgaatgtaatgagtgtgggaaagctttcagtcatagctcacacctcattggacatcagagaatccacactggggagaagccctatgagtgtgatgagtgtgggaaaaccttcaggcggagctcacatcttattggtcatcagaggagccacactggggagaaaccctacaaatgcaatgagtgtgggagggccttcagtcagaagtcaggccttattgaacatcagagaatccacactggagaaagaccctataaatgtaaagaatgtgggaaagctttcaatgggaacactggtctcattcaacacctgagaattcacacaggggagaagccctaccaatgtaatgagtgtgggaaagcctttattcagaggtcaagtctcattcgacatcagagaatccacagtggtgaaaaatctgaatccataagcgtttaggaacaacatcagttagagtttgagcattattcagcattagggaaaccacacactggtgagaggtctttcagtgtactaaaaggcagaaaggtcatcacaactttagtgtcagaatctatagtggtggcaaagttaggatagctctttagtaatttgggcccagtgccttggtgaaggttgattagcttgactgtctttgaaagtatctgatggagctcctgatgacctaatgtatcctttagaaatttaaaatagcattagagcaagttgcttgtcatggcttgaagagcttaactttgtcttttgggtgagtagctataggtttgagagaggctggctactcctagttcctgtgcttcttcccatctcctgtgatccccctctcccatttattcccttgaaggtgcccttgtattcctaatctgatctaagaagctgctgtagagtcagaagtagcttctgtgtgaaacttatatttgtatgtagctttctaggaaaattttacagacacttaaagtatttatgcttaagtgtgcatttttttattctaatattccttctagtcagtggaaatttgtattcccatacaaactcagaatgctatatttttaacagcactccagcatttttcttcatgtatcaccttcactgactccattgagtcattgagcatctgtacatatccttcaccacccccagtcccagcacctgtgtcagtaaagaaagtggacacattagtaatggttatgggagtaatacagagaaagaggtgagtggagactcagcccagctgctcttgagcttggatagttatacattttggtgacttctgactctccttccacctccccactgtacactgtggtacagatagttggcactatcctagttatggcatcaggtaggagaaggagacgaagatgctttaggaagataaaaaccttacaaagaatgtatactcatcttttttggcccattacaatactgctttctcaggttcttaacagcctgtgcaaactccctgactagatggtctgtcactcctatcattaccttgcacccatctctttagatggcctcagcacctcactcgttattctccatctgtttcttgccattagtttatatgactttaatatccacagtggtaatctaataccttacctcacaggttttcattcttttgaactctggtgcactccatctgtaatccatgtctataatctaccaacaaagatgtactcttaaactcagtatcaccaggcactatatttcatctttgaggcttttgttataccaaggaatactatataaagtaatgagactggtttaaagtaacatgccagaacttacgcatccaatgtgggttgtcacttgttattcccaagtactattattccatactactatattcttccaaatatttggaacactcttagaattcccatttaataaaccatatgagaaaaccctctattactcttacactttagttttaccatttgagtagccacttattcaccagagttggaattgagaaattttgggctttccaaaattaacctttaaacttaaaattgattacattgagcctattcagaaaaaaaattatataggttctgatgaaagcttcataatttcaccctgtgactatcctgaaaagaaataataatcattttatgattgatgggccaaaaaaagcaatcaaagtcttacgtcatagaggaccaccttttggatcataaattctttccctataacattccttctctgcctctctatggcccactttgaccactaacaacatcagaattatctacatcaatttcattgagccattggtgaatgaagacacccatcacttgtcatgttggtttccaacagtcctttcgattatcctttattttcttatcctcccttctcttgtttcttttatttataagttaccattcctagtttctttgtacttgaaattttaagaaaccagaaacaagtaaatctggttgtatctagatctttgctctgtgtttcagttgtgccttaccctctgtaagatactgattcttcctggggccagtattaccttgtatgcaaatattacatatgatgggtgcattgtcagagggaaaatatatgtgtatgtacacatgtgtatgtacacacacacacacacctgccatacactttagaagaacgcttctcttctattccaataaaaagtccttttagcaatgcaacatattaacaaaattgggtgcattcagggtggtatggccatagaccagagcaacacattgaaatgtatacagatgtactagctaaagtctctttatgtgtcagtattaagagtaatatgtagccagattacttaaatctcagaattactaagcatgtggcataaatttggagaaaataatatgactagaaaaattagtgttatattgggtgtgagaaaagactgtgtcttgaaagaattatcaaagctgatacagcacatatacagaattagccaaatggtataagacaatagaaaaaggctgtggattctttgaggacatcactagaaatcattctttgtctcaagttcacactcttagcatagaatattattgactaggctgtatgacattttgagctcttaactgtgaatggcattcattaagctcctttatcctatagattctatctttatgttcatctgaaatgaactattcatcagtactttctcctcccatcctaagcttctcattttaggaactgacatgataaggtggttctttcataactctaatgccatccaacatagccctgggagaggcatgttaggtttcagagattttctccatggagcaaggtgcagtgctagaatatggtggttgattcccaaacagagcagttaactttactcttggttctgagtctccaaataataatagccgacgtttattgagcacttactatgtgcccaaccctgttatgcctttctcaggctcatgataaatgtattagtctgttctcatgctgctattaaagacatacctgacactgggtaatttataaaggaaagaggtttaatggactcagttccacatggctggggacgcctcacaatcatggtggaaggcaaggaggagcaaatcatgtcttatacatggatggcagcaggcaaagagagaacttgtgcaggggaactctttataaaaccgtccgatcttgtgagacttattcactatcacaagaacagcacaggaaagttctgcccccgtgattcaattacctcccacttggtcccacccacgacacgtgggaattgtgggagctacaattcaagatgagatttggatgggacacagccaaaccatatcaataggtattattttatcccccattttataaatgaggaaacggaggcttagttgagtgagctgaccaatatcacccagccagtatgtgataaaactgattctgacccacacagtttgattctagagcctgttctgactactgtgctaaggtgtgtataatgaacatggtaattctaaccagctttttaaaaatatgtagcgcttgtcatgagaggtactggggaaaagaatgtgcagtagagtgcaaatacattacaattactggaaaattggtggaaaatgctttttggggttacaattatatcatttttaagtgttgatgctttgtagtactacaaagctaaattgtgcaaacaaaacatatttaacagagtaattgggaggataaagcaataataaattcaaatatatttttctccaaactgccaaagggaaagtagaattgtggagggaaatgaaatatccatgtaccaggccaggcagatggtcagttaggatgacaatagtaagttcatctacagcataaaatgtgaaatgctttcatcctcattgcccatttccaactaccattctgtttctcctctattgttcatggtttttcaaacatatctttgatttttcaacccccctttttca

SEQ ID NO: 12587 - DNA, 12128 bp, Human
atccttaacctttttggttgattttgcagtcagtatttcttgtctttgagttggtgtggcattttcaatattcagtacggattcccagttatatgttaaaaataatcccttctgtcccaggatactcatcaaagtactgctatagtggaatcttcccggaaacagacaaatgaaagccagtctctctcagggctaaccattgtgaagtccaacgtgctgcccacttgactctgggctggagcctgcctgagccctatagttgacccacttagcaagcacatataaaccagtgagagaccctaaccaactgccagtgagacatttaagaagtttcatacaaatattaaattgcatttacttgtcacagatggtcatacaaaatggaaaagaataacatatttaaacagtctattcaagtccaagagaaattgagcatttactctcatttcatagtttgttaggaaagtttgtaatgagggatttgcaagtgaacatggtatggtggaaaaagtgatgaggatttttgagcaaattttctgcatgttagtgctcttattgattatatacttattggatatttgaaagaaaaagaagtaaagcataaagcttgggtttatttaatgccctcagaaggctaggttgaggaaaataataaagaaattttccgagctactaccgttttggagttaaaacagatcatggagcctccattaacacacaagatactttcttactgctttaataaaataaatgataagattctgttaaaacaaacagaatatagtttaatctacgtgacaccatcattctggttggcatagtaaaactgatgaatgactaacagtacctacaattacgctcttttgtaccaataaaatttatttaaggctgggcatggtggctcatgcctgtaccagcactttgccaggcggaggtgggaggatcacttgaggtcaggagttagagaccagcctggccaacaaagcgagaccctggtctctacccccctcccccaaaaaaaatgctgggcatggtggtatgtgactgtagtcccagctactcaggaggctgaggcaggattgcttgagccaggagttgcagtctgcagtgagctatgatggtgccactgcactccagcctgggtgacaaatttatttaattggttttggtttgattttgtattattattactaaaactccagaaaacttttacagcaaaaaaaaaaaaaaacaaaaaacaaaaacaagaaagaaagaaaaggaaaggaggatgggagaaaggcaggaagggagggaggaaggtaggaaaagaggaagggagggaggaaagaaggcaagcacgcaggcagatgcctaaataaagaatacataggggcctggacaaataaattgctttatggactgttatgcacccatacaataagttagacttacatgatgagtaaagctttttaggatacatgaagtgaaaacgttaaaataagcgggggagaaaaggctaaatataaaataatgccattgtgtgtgtgagagaggatcacaatgatatacaaattccaggctaacggtgacagtggctgcctcggggagtgggactaaggaggggtaggtggggtttgacattttactttattaattttggtattgtctgagggtttttaaaccataaataatgtattaattttaaaaatgcttttaaaaatcatcattttcaatagttaacggtctatgcttcatcaacgttttccgtttaaaacctgtgtgcggcccacacacgtatgacattctgattatgtgattcactgctgaaaaagaactggacgccaggaaattgggggttgagtccgaagcaaggtgaacgccggacatcgagacatggaatcctagaccggcccggaagtgcctctgctccgtccgccttcgaggagaggtcggcatctttgttccctgcccggccattgttcgtgccgcgcttctagcaacgccgggccggtaaccccctctccctccttgcgcgttccgggtctcgtgagttggctgtggggaccgggaatggaggcgggtcagggagggtggggctggaaaaggggtgtggaaagtgaacctcagccgctgggaagtgggagccggaggagggggcggcggtcagtgccgggcggcttcgggcgtcccctagaccagagtggtcatccccagctgtggggacattgtacaagaaagggttgtaggaggactgcgaggctgaagggtcacctcggtgaataacgacaacaggcttaggactcagggaaagaaacacccgggagaggaagttaaggacaattaagactttggcagccttcacgatggagaacctgtataccctcttacctctagattctgaaagcaaattaaggggcgttgaatggactggttttcaagcgcagaatgtagcagttcccgattcccttttccttagttcattgattctcaaaccttataatacatacaaatcactgaggagcccgttaaagggcatattctgggtctccctgtacttctctccacctcccaattcagattccccagatgtctgccatagggcctttcaagctggaattcagctgctgcgctgtgcttcctggcattttggagacacacattttgggaacacccccatgggtttcaggtgcttcctgcgtctgtggagaaaacttttcccttgggcttctttggcttcttaggattgtcctcaaaaagaagttgaccttgggcaatctacttaactttccctggcttccatttcttatctagtgaaataattattataataaaacctcagtgggtaattgtgaggatgaaatatagtcttgtatctgaaagcatattgtagacttgtgcagtgttgactgttattcttcagtagcagcagggcggtgtggaaagctccaggacttggaatccacctaagcctttctttctgtaaatttagtgaaaataatactaaccttaaatggttgttttgaagattaagaaaactgaagtaaatagtaaagtaaatgttggttcgttcatttagtcgacagtaacaatatttccatttattctttctctaagttgatgtttatacagtgagttcaaactttttattcagactttctgagtgatcggtgcagtccctaattcatgggctgttttcctccatgaactctgtgaagcattattgctatttcttcttcacataaagaaatcaagattgaaagaagatttaaaaacttggcacaaggtcacacaactagtaaatattaggatcagaataaaacctaggtctgggtcagctgtggtggctgacgtaatcccagcactttgggaagccaaggtgggaggatcacttaaacccaggagtttgaggttgcagtgagctgtgattatgccactgcactccagcctgggaaacagagtgaaattccccatttaaaaaaaaaagaaagaaagaaaacccatatctgggtaacttaaaagcttatgctcttagcacattatgaatatatatatttccattatttccatcctttggtcaccaaatcacttttcagagaagagctttagggcctatgataattgcttgtattatcagtttctgtcatcagctattatcatttttctatataaataatttatttttactgcttaggcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgaggtaggaagggagatttgctagagaaaaatgtgtattttggcatgccaagaatccttgtcacttctgctttgtgtctccttgacattggtgataaaatactctcttcctgtttccttctttcttggaagtgtttatttcagacagttaatttcttcaaaagtcaaatcttgtctttttgtccccagatggtggcccacagacacagacaagaagtcctctgtaaagagatggtgcctctagcagagcagacaccactgacccttcagtcccagcctaaggagccacagctcacatgtgactctgctcagaagtgccattctattggagagacaggtgagggacagcatttatttgatgttgaacgaatcccacctggtcaagcaaaaacaaacaataaacccagagctgggaaaacaggagacccaaagactccttaccagatagcagtaatggtcagttcttctgagagcctagtgtgctcatctttgacccttctccctgcgtgcagacttctccctgagtaccaccctggaagctttctggacttctgatgcatggtacatgaggaaggctttcagggatcgctgtggagcacagcttcagagaatggacttcaaggtttgacagacaggttcagatcctggcatcgcctcatggaagctgcttgtattgggcagattacttaaccacttgacctcagatccctcatctacaaaatggggttgataatagctttggtttagtctacttgcgctgccttaagagaataccacagactggttgtctttaacagaaatttattttctcacattttcaaaggctagtagtccaagatcaagataccatcaggtttggtttctggtgaggcctcttcctggcttatagatggccatcttcttgctgtatcctcacatggcctttcttctgtatgcatacagagagagagcaagctctctcatcttataaggacagataccattcctacccgatagggcccttccttataacctcatttaacttttaataccttcctcaaggccctatctccaaatataatcatattgaggggttaggacctcagcatatgtgagggaatacaatttagtccgtaaccagtatgtacctcagaaagtcattgtgagtatcaaatacaatttatgaaaagcacttggcatgcattatgcttaatacatggtcactattgtcacaaatcaccagtgccacccttgctgatttgggttcatacttggagtagaaagatatcagatatgcttagtaagtggcagaactgtatgggagaatccagtgaaatcagactttgccatttccttctctgtaatcttctgagtggtggcagtgaccacccttgtggatatagtactgagcacttgggactgagtcagctgctttcccattctagccctccctgcaggaattggctctagcttgtctgatttcccacacataaaatcatgccctcttactgactttttgttaatgttctgacaatcaatctgtagcaaggttctactgttttcagtttcatattacccctatatgcatcaaagctgcaacttcccttgcctctttgtccctaggttctgtttatttcatttaccctagcaattatggatttctattacatggaactcatctcttgatttaaattaaagtgtatgtgttgagtaaattctgtgcagaccttcttatagcttctgtgactttatcagattaaaattgcttctgatatcattttccctctttatgagcatctttccagtcaatttgtttctttcttcttcctctctctatgaacttggaccttttattttctagccacttcctttcttctaccttccaaactgcatctagaaccctgctgagtatccccttttccaagaagcacatctatattttccacctatccacttatctatccatctatcattcaacaagtgtttattaagcatctactatggctgtaggagaatatccagagggcatctggagactggagtgttctccttgtaggatatcagcgcaggtatgtgttacaaatttagataaagccaatattataaaacaacatagtgtttgaaattacaaggaccaaattcaagttccagcttttcaaattcttagccaagcaatatttaataggtaagcttgagtttctttttaagttatgctgattatttaaaaatccaaataatacaaaagtttatatagtaaaaaatggaagttttccaaatcctactccctagaggtagctactcttgtcactttgctgcatattttgcagacgtttctctatatagtctgtctacccatatatatgtatcttcccatatttttctttttttttttttttgagacagagtctcgctctgtcgcccaggctggaatgcagtggcacgatctcggctcactgcaagctccgcctcccgggttcatgccattcttctgtctgagcctcccaagtagctgggactacaggcacccgccaccatgcccggctaatgttttgtatttttaatagagacagggtttcactgtgttagccaggatggtctcgatctcctgacctcgtgattcgcccgcctcggcctcccgaagtgctgggattacaggcgtgagtcacagcgcctggcccatatttttctatagttctttaaagagatgggataataacatcgagttttgtggtgagtcagtttgataatatatctgaaagtgcttcataagtcatgaaagttgtataaatggtaatcattaaaaggtgggaaatgtctgaatttttatattctacccagctcccttatggatttcagatttaatacgaagtttgaggagaagggcagtactgatcccacttggggcccatctgttctctacagacacatttttattttccaaacctgttgtgatcccccagctaaaaggaggaggagaaacatggcctaacaacagaggagtcctaagaggtacctattcttgtatgtgagagacaggacagttagatatgggagaaagaggcaaatattttggtcaaaagaggaggcctgggtctgttgtcctcggcctttttctgggttgcaaagtgaaatcagactatgtgccaggcatgtttctcaggaataaaacagaaggttcctcctctcgtagagattagattgtagcaagagggagataataataaatataaaagtaaagaaatgatacagtgtgttaaaaggtgatgaggctatggaataaggcaaaaatagaacaggataagggagattaagagtgctacggatgaggcaaacagattgtgatattaaatagaagaattaagatagacctcattgagaaggtgagttgaacaaagacttaaaggaagcgagagagtgggccttgctttcatttgaggtgagaagtttccaggaagagagaagcactagagcaaaggtcttatgatgggaatgcaccttggataattgtggatttgaaattcataaagtatagtagtcctcactattcaagggggatacattccaagacccccagtagatgcctgaaaccaagggtaatactgaaccctgtatatactatttttttcctatacatacctaagataaagtttaatttataaattaggcatagtaagagattaacaacaataactaataataaaatggaacaattacaattataataatatgccagcctcactacttttgcactttggggccattattaagtaaaataaggggtatgtaaacacaagcactgagacactgcaacagtcaatctcataaccaagatggctactatgtgtgcaacaggcaggcagcatgtacagtgtggatatgctggacaaaaggaagactcatgtcctgggtgagacagagccagatggcatgagatttcatcatactactcagaatggtgccaaatttaaaacttaagaattgtttgtgctgggcgtggtggctcacgcctgtaatcccagcactttgggaggccaaggcggatggatcatgaggccaggagtttgagaccagcctggccagcatgacgaaatctcatctctactaaaaatacaaacaaacaaaaaattagccaggcatggtgatgtgtgcctgtagtcccagctactcgggaggctgaggcaggagaatcgcttgaatccgggaagcggagattacagtgagccaaggggcaacagagtgagactccgtctcaaaaaaaaaaaaaaaaaattgtttgcctctggaatcttccatgtagtatatttgaactgtgattgactgtgggtagctgaaactttgtaaaggcaaaaccacagataagtggggactactggactgcctgaagcacctaagtagtagaagtttaatacttgttctgaaaatgaatgaatgaatacatgaagtaactttccttggaaagggtcactttgaggttatctcagaaaggagagagaggtgtaagggaatactccagagaagccaccctaatctttaaccatccctccctatgaagtataaaaaaggtactgccagctgggtgcagtggctcacacctgtaatcgcagcattttgggaggccgaggtgggtggatcacctgaggtcaggagttcaagaccaggatggccaacatggcgaaaccgcgtctgtactaaaaatacaaaattagttgggcgtgggggtgcgtgcctgtagtttcaactacttgggagactgaggcaggagaatcgcttgaacctgggaaatggaggctgcagtgagctgagatcacaccattgcactccagcctgggctacagagtgacactctggctcaaaaaacaaaacaaaaaacaacgactcaggccaagtctacatggggatggactgacctgcattatgccaaagagggcaaacgttcctccctacgtaggggaaagtgttaccacactagcccttctgtttctagcccacttccttttctatgatatatttttatagacatagtcaccttcccataggctcagggaacaagtgacatttacctagcctttttctttgtttcagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcgttttacctctttcttactcttactagctgtgtccctcttatttataatttatttatttttttgagatggctgctaaacccttctaataatataataaatggcactgccacagccaacatgcctgaaagatttggtatctgtgtttaactacaaaggataacagagttctactgatggtttataacaattgggtctttggtgttccctgtgaccagggtctacactataaacaccttttctaccttactgcttctctctgacacctacgtgactctcccttggaaagtgaccagcattggctgtgtgtttcagtgtctgcagtgtgtgtccgcttacttaaccatagttggtcctcacaacagccacacagggaaatgagcgttatcattatcgcattttacagatgaggactccaaggcttagaaaatccaagcatcagagccaaggctgaaaccctgaacttttatttttagtaatgctttaattttggaataatatttgacttacagaaatgttgcagagatggagttctcatattcccttcacctagattctcctaatgttaacttgtaacatcacacctttttagttaaaccttggcttttaactccaaatctcaatttctttatgatgtcaagctttgtactgataccagatttctacattttagtcacctggaactcccttagagtttttctatcacatcttcagtgttagaaagtcatctgtatcctgagtaccaggccacatcagagaactggattaatccaggtaagatgctagctactgtctgaaatgtcctcagtctttctcttctgtttgcttggcttaggtctagagaaaaaaatttcttccctgtgtagatctttaagaaaatcaattgtacgccaggtgtggtggtacaagcctgtaatcccagagcttttggaggccaaggccacagtattgcttgaggccaggagttcgagaccagtctgtgcaacatagtgagaccctgttgctacaaagaaaaaattttaaaattagctgcgtgtggtggtgtgtgcctgtagtccccagataggaggttgaggtgagaggatcacttaaacccaggagtttgagatgcagtgatcatgccactgcactccagcctggccacagagagagaccccgtctcaaaacaaaacaaaacaaacccagaaacgttgtctcaaaaaaaaaaaaatcaattatgctgcctccatcaaaaaatttaaaaaggaagaaaatttttttaaaaactggagaagacttacgtcgccttaagtgttctgccccagaggaagctctttctcagtgaagtttactcatggagaggaggaatctccctttcttaggactaaagacttgaggcttgaggtttcccaaggctctttgcctgccctcccttactcccttttatgattactaaggctgcaaccccatctcttccctttatgtatttgatttaaatgttcagaggtttcctgagagatggaaaagaagtgctgcaatttgctcaggatgagtccatacacagttgagttttgcactgttttcagtaactcctaaatgtgttgcagagcagtcaactcttgaattggggattatgtaatttaactcttttatgtaagattcaaacagaagtggaatagcatagtgaaccccatgaacttgttgacgaaaagagtcaaactccataaaatatttgaagagacttactctgagccaaatacaattgaccatggcctatgacacagccctcaagggggtcctgagaacatgtgaccaaggtggtcagggtacagcttggttttatatattttagggaggcatgaaacatcaaccaaatacatttaagaaatagattggtttggttcagaaaggcgggacaaatcaaagcgtgggcttccaagctgtaggtagatttaaacattttctgcttgacaattggttgagtttatctgaagacctgggattaatggaaaggaatgtttaggctaaggtaaaggattgtggagatcaagttttattgtgcagaggaatctctcaggtagcagacttcagagagagagcagattgtaaaatgtttcttttttcttgttt

SEQ ID NO: 12588 - DNA, 6299 bp, Human
tgacagggtttcaccatgttggccaggctggtcctgaacacctgacctcaggtgatccgcccacctcggcctcccaaagtgttgagattacaggcgtgagccaccgtgcccggccgaccttaatgtttttggattaccacccctactccagcaaaaggccaagttctctacacacttgattgaatatatgagctgtctggcaaactcctacttaaacttcaaaaccttccttaaatggctatttgaaggagcttgctgaatagaggaacaaaggaaggagggagggtagaggcggtgtcatcccaccagccccagactcacaggtcgctggccacagaggagttccgagacatggccttgggcgagagttcatagtcgctatctgagcggtacaggaaggactcgcgccgctggctgtgcgggactggagcctgcataatccggcccaggccagggctggactgagggtccagggccctcctcccacacgagagcccattttccaggtcaaagctgaaaggagagacggcatggtcagagacgagggtcatgacaactgggtgccgggtcgtggccaccttgtctggtgcgtcctccctggggctgcttggcagtcaggcaagtgtggtttccagcttgttcacctgcccccagctacaccctcaggaaccctgcacccctcacactttggtctttgagtctacactggactccaggacctcagttccagatcttcctcaaagtggctatgtggccatggacaggtactgactttctctggacctcaatcaccctatttcttttattttttttctctctttcttttttttttttctttctcgttctttctctctctctctctctctctctctctctcgccctttcttttctttttttttttttttttttgacagggccccactttgtcacccaggctgcagtgcagtggtgtgatcctacctcactgcagcctcaatctcctaagctcaagccatcctccagcctcagcctcctgagtagctgagactacaggagcatgccccaacactcggctaattttaaaattttttgtagagaccaggtctcactattttgcccaggctggtcttgaactcctggcctcaaacaatcctcccagctccgcctcccaaagtgctgggattacaggagtgagccaccgcacccggcctccccatttcttttttttctgttttttggggtttttttgagacgaaatattgctctgttgcctgcactggagtgcagttatccatgctggagtgcagtgggggaacgatctcggctcactgcaacctccacctcccgggttcaagcaattttctcgcctcagcctcccaagtagctgggattacaggtgcgcaccaccacgcccggctaattttttttttttttttttgagacagagtttcactcttgttgcccaagctggagtgcaatggcacaatctcagctcaccgcaacctccgcctcccaggttcaagcaattctcctgcctcagcctcccaaggagctgggattacaggcgtgtgccaccacgcccagctaattttgtatttttagtagagacggggtttctccatgttggtcaggctggtcttgaactcccgacctcaggtgatccgcccgccttggcctcccaaagtgctgggattacaggcgtgagccaccgtgcccggccaaagttttgtatttttactagagacagggtttcaccgtgttggccaggctgctcttgaactcctgacctcgtgatctgcccgcctcggcctaccaaagtactgggattacaggcatgagccaccgcacccggcctctcctgtttctaacatgtgcgtgatgtagcccatccccgagagctctttgagggggttacaaccgaacatccaaagactgcgactggatgaccatattgcaaagggacaaactgagatctagctcacatggtggacacgtggactggaaacagcttcttgggctcttctacctggaggaggccggggttctgcctagctcctgcgtgcgccttagtctagagagaccccactcctagccaacttgctcacacccttggctacctgccacgcccccagcgttccaggctccaccctcagcccataaggctccgccccacggccgccgaccacgcccccagctagccgggtcctgccctaggctcccccactcctccacttcatcttcagcctgaacgttccgcctgttatcttccacctccgggtctttgcacaggccgtgctttctgcccggcccaccctcctccctctccacactacctgtcccgttctaccctcaaaccctgtctttccctctggctcctcctctttggggtcagaggtcagagaaagggcgtagggcaagaactggggcgctagagaaggcggtgacctgggggtgggttttcaagaagggcaggcggaagcggcaccgacaggaagacaaccgggaccgcctgagactcggagctcccggccgagggccagtgtccggctggtcccggccaagacttttgggtcaaaggtcaccgtatccccgtccacgagctgggtcggcaccccgcgtaggctcagatctgggtagaggtgggggatttggcagcattcggtccaagtatgaccgggtctgagttgggtctgatcacgtcgaattggacttggtcacgaagagtttgttcgatgagttcgggagaattcggctacgtccgattgagctcgggagacttcggataagttcgagcttgttcgcctaagtccggttacgctcggtctgcttcgaacaagtccgggtgacgctcgggccgggtcgggcatgttcggtcacgtccggctacatgagggctagttcgggcatctccgactaagaccggccgcgctcggcctgttccgtccgactccagcgggtttagcagcaccgggatgaaccccacggccagccgaaggggcggggcttcttaacccttccctggcccgtctggggtgcgccgtgggcgctgtggtgcaatgggagacgctcttaggggcggactggaggcggcggataacccagatctgcccctcgagggggaggcatgcggatcgcgaccccctacccctctctcggctctccccaagggttccagaaaagcgcgtctgtggacaaatagggaaactgaggccaggagcggccacagggcgtgcaaatccggatcccgggcgcggagggttaaggactgggcccgggttttcttggggcgggggaggctgtttttctttctgctctaaacttagccgggagcggcggggtcaggctgtggttccatgacgcgggcggtgcgggggtagagccccccggctgtgggaacggcgcggctgcccattggccaggggggtaaactgagccagggaggctcggacttgggttcgggtctggcctgcgcggggccggccctcgttcatcctcacttctgagtacccgcgacgcgccctcgacgtccctgcgctgtctctagcgccttcaaaagggaatgtgcttcgctagtgtttggtgccccgaggtcgctctccaggacacggaacccccactctcccactccctggttgaaatggaaccaccaggaaccacggtcataccttctccctccaaccccagctatgaccttggagagggacctcccctctcagcctttgggtgccagacttaccaagtgggtgccaattcggcgcggaccaagcgcaggatgccagccacagtcggcgcccacaagccccactccgaaccccagccttgcccccatccctccccacgaggtcacagtcgtttctggaaaggcagggattcgaacccagaggggtggaccgagtgcttagaggatgcagcgcaagcagctgccgggcgcaggcgcgcgctcagcctgggactcccgaacgccctgcctcgaaaaccccctcaattcaggtcttcctccgtggacacccagagttcattgtgaggcccccagggcatctctttgctggcactgggacaggatgctggtgggagggggcaccaagggaaggagtgccccttccccctcctcccactgccaggacgcacagcctgcctgccccaggccggcgagggtcaggaggagacgtgagcctcagcccgtcccactctgggcctcacagctggaaggagacagacggctggtcccctgggcctatatccaggcggcgggtggagacagacggagacagagagagacagagtcaccaactgcgagacaaaagtagggtaaggtagggtagagggagagagatacagagaaagcgagggagaggcagagcgtccaagcccggactccggccccggccccagctgtccctggccttgtccctgtccctgcccttcccacctccacaccgggcgtcccggtgaccccgccaggccctctgtccagcctcaccacagcggatgggccaccgtgaagcgccgctgcaggcggatgctctgattcaccaaaagcttcctgaagagcccgggggagccgcgcggggatccccgaggggagccgggcccggggaccggggcgggcgcgggggggccctgcatcgccaggactgcgtggaggctggaccgagcgccggctgcgcgggaccttttctggacagctgcgggggcggggcccagcggggagggggcaaagggcgcatcggccccgcctcgaggccggcggctccctgacgacccccgggacaaacggggaaactgaggcacagagtcagacgcaactctctgctccttttttttttttttttttttgagacgatctcgctgtgttgcccaggctggagtgcagtggcacagtcctagctcattgcagcctcaacttcctgggctcaagggatcctcctacctcagcctcccaagtagctgggactacagatgcacaccaccacgcccgggctaatgtattttctggagagatgggggtgtctctttatgttgcccaggctgatctcgaactcccagactcaagtgatcctcctgcctcagcctcgcaaagtgctgggattataggtgtgagccattgcgccaggcccaactgtacttctttagagggctgcccctaagatctcagagcctggatcttactcagccttcctcggcacgtccctggttagtgcagcttgctgggccaataactgctaaaaagtgtagaatgagggagtcagaaagcaaggtgcccagagaaacagctgtcttgccttccattattgagggcatcaccgaggtatagagtttgccaatgtccgatcccacgcaatgtttctaatcctcctctgcccattttccagatggagaaactgaggcctagtgccatcaaacagcgcaccagaaactacaaacccttaatcctttgccaagtggggaaactgaggcttccatggacgcggtcacgggcatgggtctttgttgcagaaagcgagacccaaactcagggccccctctcccagcacccctccacgcaactccccacgtgatcccccacctgctctgacattccccaggccctgtctctggatgccttcacctctcctgctgtctcctcctagacaaacatccgcacatcacctctgccaagtcttctgtcctgcgaaacctcagccgcccacccctgccatcagagggacctcactgtcccaggactggggggggcctctggtgtctgggaggattcccagagtctgtaccaggtgctctaccctcagaatgctggagtcaggctggccttgttccactttacagaaaaggaaaccaaggcttagcatgtgtcacacaaggaggagggacctagaaacagccatgtcacaggcagaggcccaggggacctcccagcaactgaggcctgaccgtgccccttgctgtggaatgacctctgtctctcagcctgggccttccccccggggcggctgcctcagtcttggtgtccccagacatggtacccatgtttctggcagtcctggagaagcccattgatcagggatcccacaggagatcctgaggcaaccatgctaaggccagatacatgagagtctccccattctacagatgagaaaacagaggctcagaggaggagtcacacagcccagaaaaacagagagcctcaggtatctggccaggaagcccccctaacccccgcagtcttgcaaccagacacctggcgggaaccagacctcgctgtccccaagacaaaaataccatcgttgtctgctggggccagacctaattatagccatccctag
